United States Patent 7,868,149 (PLANT GENOME SEQUENCE AND USES THEREOF) - sequence listing, part 52

SEQ ID NO: 28244 - DNA, 14535 bp, Oryza sativa
  unsure (1)..(14535): unsure at all n locations
cctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctctaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcannnnnnnnnnnnnnnnnnnnnnnnnnnnnnnnnnnnnnnnnnnnaccagttcaaatctggttcctggcacagaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactagagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtcccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaa

SEQ ID NO: 28245 - DNA, 1062 bp, Oryza sativa
tcgaatccatgaagtaagacatcgattttgcaagaagatccactatgttcattgcataataagctcccttgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatacttt

SEQ ID NO: 28246 - DNA, 5436 bp, Oryza sativa
cccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaa

SEQ ID NO: 28247 - DNA, 11724 bp, Oryza sativa
tggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaag

SEQ ID NO: 28248 - DNA, 13839 bp, Oryza sativa
  unsure (1)..(13839): unsure at all n locations
gacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaattatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctatgaaacaaggggcgctttcggttctgtgcgtgcttcaaacaattttgtcttctccatattaccatatctctagagtcaataattttctatgaggaactactgaactcaatcacttgcttcagttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccacttcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaatgcggttgaatctatccgatctttatctttttgctcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28249 - DNA, 2388 bp, Oryza sativa
taatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattgtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcaacccggacgcttttgggatgcttctaataaccaacgaatggcaagtgctcttccttgtttagatcctatttcaatcggaactttccgcgtcgatcctt

SEQ ID NO: 28250 - DNA, 1569 bp, Oryza sativa
atatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttcgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgag

SEQ ID NO: 28251 - DNA, 762 bp, Oryza sativa
agagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaagg

SEQ ID NO: 28252 - DNA, 682 bp, Oryza sativa
cagcccgatctttccctcgcgttcggctataacagaaaccctcgaatctagagctgtttggcgttccaatccagttccaacaatgcacttctcggaccgagaaagcggaactgcttggcgctgcatattagaactcattaaagctcgattcgcatcattatgctcaataaaaggaatgagagaacctcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggctcaaaaaactatccgtagagtattcatacgtcaatcaaaaccgactccaaagtttgtggagtcggatgcggatctgttacaagatcaattcggactggctcttggtcgtttacaacatgcggttcaaaaaactatccgtagagtattcatacgtcaatcaaaaccgactccacaaactttggtaacttcaacttcaacctcgattttattaataactacttacgagaccttctttgtacatatcccttatctcaagttttgatcaaaccaatccattgacaca

SEQ ID NO: 28253 - DNA, 2600 bp, Oryza sativa
gatcacctccttttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatgggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggggatatagctcatatggtagagctccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagac

SEQ ID NO: 28254 - DNA, 795 bp, Oryza sativa
ctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccc

SEQ ID NO: 28255 - DNA, 709 bp, Oryza sativa
gagttagaggctgtagctatgagtgctacagatgggttgatgagaggaatggaagtgattgacacgggagctcctctcagtgttcctgtcggtggagctactcttggacgaattttcaccgttcttggggagcctgttgacaatttgggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctt

SEQ ID NO: 28256 - DNA, 276 bp, Oryza sativa
atgcccaaaaccccgattcgagtaatcatttatttggtaccactcaaggagcgggaactgctattctaactcttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattagggcgtgggcataagggcctttacgaca

SEQ ID NO: 28257 - DNA, 398 bp, Oryza sativa
  unsure (1)..(398): unsure at all n locations
cctattatttgtcatggtatatattatctgggcaaaaccatctgaaggaaaaaaaaatttctagacaacacagctgcagatgtggctacagtatggtggcatttgagatttccagagcaagatatcaaatttcccccgacctgaagcttctccaaacagcagatcctgaattgtaatatttggaacctcagcgttttcagaacctttctggtaactgtcgtagattagaagggatttgataggctttggttcactaattatccaagcgtatcgaggatggttcttgtccgtcttcagatcatgagggtattcgcttgccaagataagattcttctgcatgtactctctggtgccttnnnnnnnnnnnnnnnnnnnnnnnnnnnnnnnnnnnnnnnnnn

SEQ ID NO: 28258 - DNA, 924 bp, Oryza sativa
ctgttgctgcccaggatcgaactggagaccttcagtgtgtaagactgacgtgataaccactacaccacagcaacttttaatgttatattcacttgattcattataaatacaatttatgaatttttgaaagaacaaaaactgataataccaagtggagcagagtgcaaacgtggtgttaaaacgaagaaacatgaaaaatgctaggaatatatttttaggatgtggttggaacttacacctctacacagtggctaggtcttggcagcattctgtcaaccgagctatgtactccctctctctcaaaaacttggttgtataaaggtgaagaaaaagaaaagagtaataaaaaatattatattttgaattagtagttggagcttttgttgtcttaactactcaactctacaaattaaaatgccgtaagtatactgatcgtatcagtaatttccaaatttaagatagacaaaacacaaaggaaaaagtacgaattaccctccgaacaatcgtgttagtacgaattaccccctaaaccacaaaactggacatttaaaaccctaaactacttataccggacgaattacccccctaactcactccgaagcggttttagtccgatgtgacgcacacatggtaatccagtcagtaataccaaatacaaaaatttgtagggcccacatgtcatatggctttctagttcctcaatcctcaccctatcctcgctgaagcatgtgttggcggcgagggcagtctccattagcgctcacgctaaaggaaggcagggccgggtaggtgtaggcaggaacgagctagaggtggcggcgatggtcgcgcttgacccctcaagccacgcttccacgagccggcgacgacggtggcggcaacggcggcggcttccatcagctgcaaccttctacctattttaac

SEQ ID NO: 28259 - DNA, 600 bp, Oryza sativa
  unsure (1)..(600): unsure at all n locations
gtacccagattgcatcatgctttcaaataaagaataaacaagagggtcctaactgctcaaatttacaaatgtcgatgcgaacgacagtccaattacaaggtggaagcctatggttgatgtcaaacttcttaacattctcatacctacatttttctttaaccaaagactccagttagattgatgctgtacattttcagagttctgactgcagctgaattgctgaaagcatatagagaacaggagttaactcaactcaccttctcgaagaatatatggatgattttcccaaaactcgggtcctatgatatcgacatttgcatttgtaataactaagcgtgtcctttttatggggtttccacaacgatcagtcttcaccattgtttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28260 - DNA, 368 bp, Oryza sativa
tcctggcttccttcaccgcgcacccctccctccgcgccgccgtcgtcgccgacctcctcgccgcccgctcccgcgacccggtctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgttacactgggtggcacaggcaaggctgtc

SEQ ID NO: 28261 - DNA, 826 bp, Oryza sativa
ctgcactaccaccagagaatgaactgatacagccaccgttttgaaggtgagagcaactgtaccggtggaaggggcagccgtcgatgcgcacaacgatccaattagagggcgggaggaggctgtcgagctcgaactccctcttcacgtactcgtactcgctgttggccatcgccgtcaccccctcacctcaccgccacgacgaccagactacgcctgcaattctgcaaaggtgccagtagcagcagacgcggcattaacaggggcggatccaaacttttgggtgaacaaacaaactgttattatttaagagaggtttaaggctatcaaattaaggaggaggagaagatctagaagagaagcgcaagcaaattccagtcccggtggggtgggagagagagagatgaatcagaaagaggacgcaccaggatcccctcccctcccctccgctgcgatggagatcgccgcccggccctcccctgttcagccgcgactcgtcttggcggcggcgcaaggagcggagacaacgagagatttctttttcttttacgcgatactcgactactccccccttacctaacctacaattgtcagaacattttccatattgcctatccaacaaaggactgttgtgctagaattctatctaatcattttgagtcccttaattgtactctcaagcatgtactctgcttctaagtttaataaattcctggttctcaaaaaaaaaaaagactactccccccttatctcaatatttttatttaccactccctccgtccattagtatttttattgttattagatgataaaacatgaataatatttt

SEQ ID NO: 28262 - DNA, 8092 bp, Oryza sativa
caaaaaaaaatgaggagctaataatgaaattaccaattgttcctgcaccaagtccatctaaactcgtcccttcaccatatgattcattatccctgtctgcacaaatggcataataaagagaacaatcagaatatgcatgattcaataacatatgcaagttaagtgcaagaagagcaattgataaggacatgttgttaactaaaaacaacacctacaggacttttatcaaagggagcagctgtcattagatagtaaagtcaactagataagatggtcacattaccattcattgaagcaataagaaaaaaacgaggctatgagttaagcaaaagttgcctgctttatcctcactttttgctacccattttgctcaagcaagcttagaaaagaatcgaaaaggtatcatgctttcgccaaatccttgaactccctgacctaacattcctttccttaaaaaggttgaatataccaaaagaaagccgctggtatgcagagagtactagcctagctacacatcacaatggaagtctttctcagagatattaatgaccataccaaattgccggcacttgcaattgcaagatcatcaacttacacacaaaattaaacatgacatctcctagttctaaagaaaaaaaaactaaccaattctttgaatgggattattttttaatcttctgaaaaaaaaaaggagagtcaaatcacaaaggcgtacaagaaagagcttccattgcagtatgctggtcagcattcccctcattgcctagcaatcaaaacaacacaaattcgcacaccaaattctccccccatttttcctccagacaagagcaaagcttgagtaaactggatcaaatcagagcagctaggaaggaagaggagaggggacggtgactcggtgaggcaggttaaccttcgccgtcgagctcgccgtcgctggcgtcgcactcgtcggcgctgaagtcggagtcgcccgacccggagccgacgttgagccacttgcgaagcaccaccctgcgccacagccgcagcgcgccgcaccagcaatccacgccgcagcacagcatcatcgtctcggcgcacctctgcacaagccccttctccaccaccacccggagcagacgagagaattttcagaatcagacagcagcaacaacaagaacagcaataataaccgatttgatccaagaacgcgagcaaaaatgcaagggaacccaactccaccccggccaagaactggtacctggttctccctcctgcccccgcaccgcatctgggacgcggccatggctggctcctggagctggtggcctcggcgaggtaggagcggcgacgaggcggaggaggaagagcacgccattttcgctggcttcttgagcgggtgggcaactgactgggccgccgcctaaatgcaatgtgctatataattgaaggttattagtactaaatattttaattaattactaagtcccctaaaaactgcacgaagtacatttttctaaatattattttgcgggagtaatgttcccaaaaaaaagtcaacataacaccaacaaattctcttttataaatgtcaaaagactttacaattgtactattatgtaatgttcattaagatagacttgactatattattttcatatacctaaaacatatattttaaacaataaagtgtctagtataatgtattcatatgatttgttactactctacttttttctacagaattagtcaaacttaaagtagtttaactttaactaaaattaaatcactttatcacctgaaatagatgaagtactttgattgcgcacatgcatttttttcccaaatagtagaatgatattgtaatcactgttcgagagtagaaatgaatagattaattattataaaattgaaagaatcgatttaaatagtcatttaagatttattttataatcatatcatttagcaacttgagaagcgtgttgtattaatcaattcttcattccttcaaaagaacgtgcctaagatatgtattcttttatgatctatgggagttcctttgcaattgccaatcaaatatgtgaccatattttctgtttggcttgcaagcgcatcgtcgactcgtcgtcatcatctgtcgctcccagagatgtcctgccggatgccctgctgaaaggtgccgtactgctgtttgggtctccttgatcgatgtctgctttggaaggatttctaaacgatccaaacaatggagcattttcgctagctgctccgagatgagcatcgctggacaagaaaaccacagcagatgagaccaattgatcgggattaatgtgcattgatacgctacctcgtatcattcctgtaaatacttatcgtgtactccgtattattcagtggaatcaatgaatcagacagtcacttcagtgtcttttcttataatgtggtggtggcatatcatctccttgcagcgagatcaaagttttatgttttgtgagtgttcctgttcctgtcagcgtccgaatatttgggctgatatttatgtggacttggatccttcacctgttacttcagcgaggctaatatggtcctggaaaatgttgagtacaaacaatgtttgatgcctagtggattagcagaaaggtacaatttggattgtgttactgtactgtccttttcattgccataaaaattgtttgggtgatagctcacttatttgatcgtattaatactgtttaatgatgggttgcatctaacatgcacaaaaccgtactagtaaattgttacccagggatctgaagatgcatttgtattcatctgatcctgcaatgttagaaaggttttgtagactgcaggcaaagaaatttttctgatggctccgatccttttgctgaagtcaaagtgagcttaattagttctggtttatttttatccttttccggttcaattattgacgagtgctaatattgtgtcttactgtttgtggaatttgcttgcacattagcatgcatatggtcagtggtgttgtttgctggtgtctgcgtaacgtccatcatttgcatcaaaggagagcacatggattgttttctccagtgtcatggatctcagaggcattaaaattaatctctcaagttctatctatctttggatatctgcgttctttccacaagtttcccaacccctttccctcgttttccgcgtgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagccatagtggtcagtggacaccatgaaagagtttgcttcttacaatttgctaatctgatgactccactactttctctaaaataaattgaccatatttcaatttgtatggttaggagtcccagtcattatcatgtgtttaatatctggtgtttgactactggcatgaattatttttttctacataaaattgtggtggaaatgttgccacaatgggctgtcaattaataataatgtttttggtctctacagattgctgacaaccaataaggatattagattttttttacataatatattaaaatgtttaactagatgtttatagaacatgctgagatcttgatgaaagcagctttcctgtaaacaactttgtttattgtgttgatcacaaatctgaactatatgctcatttctctcctcacacctaccaaatccatcatatctgatcagactcgcaagcagttgcaagcagcatattcccccaatcattatttcattgccaattgttttgaagcagtcgcattaccaccgtctcattctgataactctatgggcatttttcaggtaatcgtgcatgcacttgcagcttaacaggttgaatatgagaaccgcattatcggaaagaacacggttggggatactgaaatggttggagctttgatgccgtaattagtttccgtctgttgtttggcagatttgcaagaacagaacagattgaaaatgctggagatttgttggcacctatgaatatgatgaagttacagtactagtacagtaccctgaagttcaccggatcactagaagaattttcatctaccattaattctcagtactgggcaaggaagaatctgcttgaaggggattccttgcacgaatcatctgtcaagaaaacaaccagctctagcagcaccaattagcgtctcaacccagaactcaaaagaagttagtagacagaaagggacagttaattgttcagaaatcagtataattcagtagaagtaggacgagcatatatagagaatacagtagcacacgcaacaatcctgaattcccatgccactatgccagtgatgacgaactggtgacgacgatgagtcatcagctagccattgtgcagcatggttctccatggccgcaaagaagctagcatcggtgatactttcctgccagaacaaggacggcaagtctctttgcaatgttcatctgtgatactttatccatttatgtatttaagtgattgttttccacaatagatggccaatttgtcagtatcagattcattccaagatctaccattttgcctggccataaaatgcacatgcatcacggaaagttttgaaaaagaataacagcaggcatcttaaaacatccaagttcctggcagcaaacaggtaaagaaactttcacacaggtacattggtaaatgatcgagcttgactgccaaggttcagtgccatcaaaagtgaaatggttttgcaaggttgggtatccccatgggcatctataacactacagaagcttcattgccacacacaaaaaaaaaactcttcactaaattattttgcagtcagtcatcggcttttgcctccaagagacgataacacaggttaaagtaaacagtcgtaaatcatccatactcaagccagccaatgaacagactaatcagatggcacgcccacgtctggagcagtctcgctggttttctggtcttccaatgtagcaagtcgtttgtcaagagctttgtaacgggcatccacatggtcttgtaggcctttgacctgagtatgcatttgaaaggtcagatgcttttacattgaaacccaaccagtatcatgcacagtggaattgaacatgcacataaattttgtgcaaagggagcaggattagaaccacatatagagaatcatagaaacctcaatcttacagctcaaacaagtggcctgtttgaaggacccaagaaaaatatgaaaagttaacttctcatatgaatagcctccttagctatgccatagctggacctggatggttatattgattggaggtaacacaagtagaccatccacccattttaaggaacctcttctgacaaactacagagtcacatatattgcatcttacaaaacagcttccagctttcatccacgtgacgtgattctacttttacatgagggtatcccaccattgcatactaatctaggactctaggttaatcaagcatatggactatcctaaagttcttccatagcactgttggcatatacatatcatttcacctttctcacaaaagagtcatttctcactgaagttccaacaaaatttcaaattggaaacaagttattggtaacagcaccaaggttcttgctgatgacaggaatgcaccagtttcaagttaaaatactctgaagaaaagccatttatagctgcaaattttatgttgcaagatgacgttcctgtgcaacttaaatgcacagacgttgcactaatgaatgcctatgtctatgataatataatatgtaggatactgggttcaattcaactccaaccacgccataatattaatattaaatggcatcctaaaattcactctctttttccacattcttgaacacaaagcattttctgtgcacgcaaggaatggcaaacacattgttttcagattcaaagtgaatagaaatctcataaagaatggtgttatggcattgtctagaaaaacatattcaagcaacagtatttcagaatatcaggttgtggcttctcatccttaggcgttttgaaaagctagttgcttctgtggacaatgtacattgtacgcgagagcccaccaagatgaccacaagctaaaaataattaaactgccacacgaaccttcaatttggcaagctcagattccacatgaagtggtactggaactgtcaaccaagccaaactttggaactgcgttgctagttaaattatacaattgaacacaagtgatagttaaattgaaagtggcaggaccatggaacagtagcctctatcacggtatcaccacagacactccacattatcagaaaataattgggcagaggaaaagttcaggcttggtttttaatccatgcatgttattggcagcccaatttcaggacagaacaacagcgtcaaatcccctttcggtcaaactgaagagaatgcagcacaatcatatgatatagacacgaagattaaattggtaaacacataaaaataaaaatctaggtaacgatctagacacgcatagcgtatatccggagttgcaagcttgaaaagcgggtatccctaaatctccctctccacaggcgacgtgcgggggacgcgattgaactgccagataaaccaccgacgatcaaggatccaagatcttgggttttagggaggagggggcgcacagacctggagggccatggagtcgtgggcgagcttgtagtccttgtagaggaagaagccgccggcggccccggcggcggcggcgccggcgaagaaggaggccagcctcacccgcagcatgaaccccatcgttctcgcgaggcggaatcccttgccttgcttgctcccttccccccttcctctgccgccgctccctgctgccaaaggcgtgcgtgccccgttgtttggtgttgtgctggccgcgacggcgccttgggcttgggcttgggctgctcgggctcgactggctcgtcctgcctgactgcatcgggcccatatgtcagtggttttgctataagtaaaactcaaaatttgtttaacaaggatactttgcagtactgtacttacacagtagtagtcgttataacacagtgttgctgctgcagctgcttacacaaatcactgtttcggccggctgcaccgcaggtccgcagccgcatgagttaagccgaacaggcccgtagtggttgacaggtggacccgatcctatatgtcagcggcagttagccagctactgcatgtgcagtactgcagataatccctactgaaatttgttccatgcaataaaaaaaggggtaaaacacgggcaaaattatttgcatagtagtttggtgaaaagggtaaaacgattaggcatagagtgcgatttaatgttatcttaaatataatacttcattgtatttatggtttcaaactgcaatttactagcctgatgtgatacacaaatggatttttttaaagaaaaaaaaatcaaacttctaccaagttgaaaactccacatcaaagttcatatctatctattttctttaaaaaacacggtttttattgttaataagattcatattcatatattagccttgaatatttctcttggtatgcctcaactcttttccatatacatcatccctaagaccagtatagtaacattaaataaaatagtactccatttgtctctaaatttttggttggatgttacacatcttagtataatgaatctgcgtagagagcctatctagattcattgtaatatgatatgttatatctggacttataaggacggatgaaagtattaaaacgggctgaaagtatcgggccgaaccgtcgctgcagctttactctggcccgatttcccgcataaaaatccaggcctgcttccgcgagaagacccaaaataggaaatatccctcctgttcacggtggccgcgccgcgaggagataacggctttcctacccacccactccactccactccactcccccacccgctcgcacgccatgccgcccccgtcc

SEQ ID NO: 28263 - DNA, 3593 bp, Oryza sativa
acatcgacgtcggcgccggtggcgagccggcgctgatgctggccaaggaggcggtgcctatgaccggggaggagtttgagtacctggcatgcgacgtggcgtcgaaggatgcagcccagttcgccgcggaagggaaggtgggagtcgtggtcagcggcggggaggggcaaggagaggcgacgggcgggaggaacggaaaggggagagggagaggttcgccggctttgggcgtcggcacggtggtgttcaccgaggtcctcggtcgaacacttggcgggcggccgctgctgtccgcgcgccggctgttccggcgcgtcgcgtggcacagagtgaggcaggttctctatgtctctcctttctacattagttggaatttgatgaactgatcacttagcgataattcggtagttcaatctctttttcatagttgatgcattactaatctatagacagagtcttgacatgatgctatcccagtcccagtcccagtcccagatacttcaaaccaacagttatagtactaagtaattctatcggccccattgtttggcttattcggcatatttgcaaacgagaagtaatttgtgaataaaatttttatatacgtgttcttagcgacctaaaagcaaaggctgaaaaataaactttgatgaaaaaaccctaaaatcagcttcaaatttaaggttgaaaattcaaattttagctgataagcataagcataagcgaaaagatgaggccgatacggttaggtctggagctcatgagtcatgaccaccttgtttgtagcaactagacccttaaagtaactgcttgctcttaaagctcgaaatgttaaagcgtagtgattcatcttgctattagattaacaagcacctaggatgtccagatcgtaagtgtctgaaatcacgtgtgttaaataggagttattagtatggaatcgtatgattatgagcttatggctcctatctgcactacgagttggcacaatctctatgcaccggctgtaagttattacactgtagagctcatgtacttcagaaattcaaggtgttacatgaatactgagcaatctagaggaagcttgtgtgatgaatatgtacaatgaaaatttttctttcttgatatcttatttgagtgacaatggatatggttgtcttacggaatttgcatctctaacacacttgaatgagaaagtttcgcgtaaatgttttttagagtgatggctgtccttttcttcttctgaatgctcttatatgactgtttatgtacacaccattgtccagataaagcagttaaatgtgcctatcaaggttaaaatttttgagtggaatgccggaggcctgctgacaagaattgaggtataattttactattctacattacaaggtccttttttcatttttatgactaaaacttatttcactcctcaggggcttcgggcattcctccctaaacctgaaatgatgactagaccaagaaacttcacggatctaaagaatactgtaagtacagcatgacatgtaatatcactttacatccctaggcacttggaatctgcattatgctgctttcctgttatggcatagcagcatgactgactgttttagcagctatctgtttaaggaagtggttgtctttcatgaataataataataatatttcttctacacaggttggtcaacagatccatgtctgcatcacaaggattgatgaaaaagctaacgaattgataattagtgaaaaagaagcatgggtaagttgactgcattgacatctagtgctcccctttgttttatattttcactgacatatcatttatcagaactgtctaattatttaaagtagtggttcttggtcaattcaatttctgctgtgcattaaattatacttatatgagtacagcaatgcttatctttgtttatcacttgtattaggcaatgacataccttagggaaggaactcttttgcaagggacagtccgcaaattgtttccatacggtgcacaaattacgattggcgacactaacagagggtaacatctataacatgattgtcaattgctatatatgtcatttcttcctattcaactgaatttcattgatcacccaaaaaatcaagcatatgttccagtgtggcttgttatctgcttgtatctgcccaattaggtagaagaaaatgtcgtatttaattttagcagcattgctaggagtcttggctttacgtgatgcaagcatccttagtcttgattgttagaagtagagtgaaacctgaggtttaccaatcgactcagattgtgggtttcattacaaatgctcacattatgcgaactgatgattagggctctctgcggaagcatcttctggctaagatttcagaaacttgctatgctttagatcagggtggttgcactgataatgcagtagatgactactacattttacacgtgactcatataaattcgtgcattcatagtacttctctttgttttggtaaaaaaaaaaagtacttccctttgatgaactgctttttttcctggattgtgaactggtctgcattatctcatgcccagtccagtagaatgcatatctagtccatattctaatggcacgcttgtaaaggtctgcaagtggataaatccacacgccaaatgcaacgtaactcataatgctttgcgttttgcagtggattgctacatgtctcaaatataacacgggggcagctaacatccgttggtgatgtgctaaaagtgggtgaggaagtgaaagctatcgtgattaaatcaacagccccgggcagaattgctctcaggtacactgcccaaacatgtaaccggataattgcttttgttgtttgatagcccatctgctgttcacagcgtctatgattgtcctttgaaactgttgatgtttcattctgcagtaccaaggaccttgagagcgaacctggactgtttctctctaacaaggaggtcagaaaactctaaatttctttctccattctggaccatcgtaaacatactactccatatgtcccactaaataaggcgcaattaaacttagcacggtcttcaaaactatttttttgactttaaatttctcatattctatagtgtttatagcaacaaaaacataatcatatgaaagtaaattttaaatattaatctaatgatattattttcatcaaataaaattaaatttataataaaaataattattggtcaaacattgaatcttaaaatatgtgtgtcttattcagtgggacggagagtataccgatgtcaacaatgtaggcttgccaatgttcaggcttgtcacattttttcatttttgtatggttgcagaaggtgttctccgaggctgaagagatggcgcaaagataccgggaccaaatttcagagaagcatcaaccagctgagttagactcctcgttcgacgaggttgctccctttgacgacgaggcagtgtcttatgcgaactggaagtggttaagattcagcaaatctgacaaaacaaactttaaccctcgtgctgaatcgggtttgtaatttgtaatacagagggaacctcaatttcttttgtttctcaagtccatag

SEQ ID NO: 28264 - DNA, 9776 bp, Oryza sativa
catgcatcgcacgttgattccatcatgttcaaggcttcatccgactgagatcgatgaacaagccggcgacgacgacgaagctcagaaaccttggggagtgaaaagggatcaggattcaggacgacggcatcgtcaattcgtcgtccacttcatccattaattcctttgtcaaaagcaaacactgctgttcgctgctcatctttctccctgccatatatcctttcgattcgtcctcttctcaatccgtcttcctcatcaatcttgccggtcttgtcatatttttatcgtttatgatagtgtgatcgccagctcctttgctcggatgaatctgccagtgcaaccacccaaagtcatactacatcgcattaataaagtttaaagaaacaaagggatagtagtagtagtagtatattagcatcgatcaatggcgcactttattcgtttctggatgacactgacggttcaactcttagcctcttaggaagagcattgagcaacaagtttctgctgtgcgttgtctaccttgttaattaattaacctacgtgttggtcttttatgtgtagctaatggcactttttatgtaagagacgaaagcgaagcactaacactatgtttttttgtaggttcgtgttataatactaccatgagattcctcaagtagaagaagcttcagttcaatgacagggatgtgtttcagtcttctctaggctctagctacctaaccttcttgtattgtatatatagcaatatctagcgttggttttctgaaggagacagaactcgatccgataccaaatcccattatttctgccgttgaatgtcaccgaatcatcacagcggacagtggattatgttttatgtgtggatcgatcagaagaagccaaagaagttccctgtttcgctgtcgtttgatttgtctttggcctttgtaagtatcccgcttcagtactcggtagcagtatcttcagggatactgagtatagtagtcgtactggcaggaaattgaaggccggcaatggcagcttcaagtacccgatttactactacaggagggcacagttaggttggcatatgattggatcattggagcagcagggtacggaaacaaatcctcggcagtactagtagcggtgattgacgtgtgggtccggagccacacgtcaatgtctgctactgtatcagtagtactgcagacaatccacactggtaaagtactacctgatctaccatgggatcgccatttgccgtaaagaagtgttttcattcctgaatggatatcttctcatttcttgcataccatctatttaatattaaaaaaaataaaaaatacaagataaattagtataaaacatattacaccagaaacataccataccaaattcgatttctgtaaattaaaagtagttaacgtatgaaaaacgagagaatgtttcctccatgcatggaagaaaattcacctcccattagctgccagtagtagtggtcggtttgttgctagcggctgccattctgtccatgtaaaaacaagcacatgaggcgtttgatggcggtgcgttcggtggaccagtagtccagtactactacgactgcacaacacagaaccacactgctcaatggagtgcgtgtttttcgctgcaggggacggtggtgaaagtgaatgcgatttttatacgtcgctcgtgcggtcgtgccgcgcgcgccggttgccccctccaccgccgttcgaccgtaactccgcgcttgcggctctctcgtacgagaaaccgcggcgcgcggcggcgttaaagcgcggccgccaccgttgcgcgatcggcggggagttggaggcaagcatgcacacctgaaccttctcggttggaaggttaggggcggagcttaaaaaaaaaaaaagtatttcctccgtttcaagttacaagagacttcttatagaatgcggacaatgctagaaagtcttataacctaaaacggaggtagtaccactcattcgttttattttactttgaatcgagttgaagctaatacgtgtaagtttgcattgagagatgcatgtagtgaaaataaatgaactataactgaaaagaaaaaaaatacctggttactgggcatctccttttatagtgtagctccgcctttgtggtaggctagaaaaaaaatgtatttgtttaagctagggctaataagtcatataatctctatcaaatcaagaaaaacacacggcaccatacaacgaagaaccgttctgtcaacgaagatcggtcgcctcagcaccacgttacctctcgcgattgataattgcttcgctggtggtcagatcaactagacaattagtatcggactcggagattactactgcaactaacagggcggcaaagtcaaggccagctgcatgcatgcatgcagattgcagagcgatgggccggtagttctgtagtcggtccttgtgtcgcccggagtttggagtaacttgcttagaaattaaagcagattggtgcattttgcgttgctgaaacattaattccaacttgaaatataagtggattccatatgatattcggaagaatttatttttttcaaagaaaataacagatttgcacaattttcacacaggagcatcaaagaaacatccgacgtaatgagacgagctaaactaggtttttaactcgtgagatcattttcatatgcactttctaattactccttccctatcataacatgctcatttttagctcttatcatttgtgttttttaaaaaatatttttagagtaatcattacgtcacggtttgttaaaataaagaataattatattgggaatagataaagtggatactaattacattggaattataaaaatagatgtattctagtaattttggctatgtatttgtatgtgtgggatgagtgaaaaataaacttattttgggatagagagtagtgcttaattttttagctataggtttagtgctttaccattattacgtttatgtataataaaatgataggaataagacggaacttatttatgagccagtacacgagtgatgagtcgagtcaaattaaacattttgcttgtaaaattaacaagacgaagctgatccgactttttaattaggagctgtctatatgttgacagaaaaccctataaatcttgcaacgagctcagtccaccctaatcgcatagacaagactccatttcaaaacgagcagagcgtcaaaccgtttcctaatcaggccataaaaggcggttcaagccgttaatcaccacacataccctttaatctctcggtgacattggaggcgcatgcacggcgcccgctgacatgtggtcccaccctgcaaatactgtgggtggggactcgggttgacagctagccggttaaaaaagacgaggcttcccgcttttctcagtaaaaaaaaaaaggctccagtaccacaccagctgtacaaaaagttcgacatggcccactgacaagtggaccccacctcgcttcggccccactcctccccccatcattttttttcccaagccacgttcacctcgccccccaccgacgagccgcacccactcattaaaaaaaacaaacaaggccccacacgtcacactctcaggagcggggagtgggacccacatgtcagtgaaggtgggtcagcctcacctggtcaggcggggtacccgtactgggacggacgcgaggtggtggtggttccgttgggcggtggggcccgcacgctggctcagtcatcagttcgtcacactactcgccttttttttttcctctccctttttctcgcttttttttttttggcccaatttgttttatccgcttcagcgctctcgctgctgttttctttttcttcttctcgctgagctctactactgcactacactaccactctcttcgcgttctctctcgctgcaatggaggcgtagtgttgggaggagggagggagagagagagggagagagggagctagggtttttgggccgccgctgcctccttgagttcgtcgtccctccggtgagtctgcactctctcgttctcagatccggtgagtctgccgccgccgtctagatctgcgtctgctgggcggtgtaggcgtggttcttgggtttttcttgcgcggatttgagctggggttgcgtggatttgagtttgttggagctgcatttcggggggagttagttttctgtgcgagatatttaaccgtcagttttgttcttgcggggtttgattgctttgctacgaggcttgattccgctgggaaaaaaaacactggccttcgcttcttcttgcgtttcttgtgggccttttcgtagatagaatttttgaaaaatgggtattgggtgtagatctgtgagctgatgtgcggtggtattgcaggctccgaacccttgggcgtgcggcagtgtaggctccaatggggaagtctccggcgaagtggatcaaatccgtgctcttcgggaagaagtcatcgaggtccggctctaccaaggcgaaagatttatcggtatgttttacacctctttgtttgcgcggcaaatactgttgttgcaaccgatttcttgatgattatggagtccagttatggaattgtagttagatagaagggatctgttgttgtaaccaaatttattactttccatacgcagaagggctcgaacaacaaagggtatgctgctgctgggaaggatgctgggtttgagagctccccggtgatatcggagccggtgctcgttacacctcataacaatgaggcctgtccaggaggtgggaggggtgagaattccagcttacaaggtgaagtggtggtgcgcgatgtcagtcaagacctggagaagcagaatactgtcgtttccgatgcgtccaacgaccccgagaggttgagagaggaaaaagcggccgtcaaggcacaagctgccttccgaggctatctggtaatgtttcttttttctgattcctgtttgatcctgcatgccttttataaaatttccttgcgtcgtgtagttctgcaatccactaaagaacccgacaataccttgtaaagttcttctttagaattatgcatcctaaatttagcatggtattggtccaggcacgtcgggcattccgtgcgttgaaaggaatcataagactccaagccttgattcgtgggcatctcgtaaggaggcaagccgttgcaactcttcgtgcaacatggttgattgtgaagtttcaagctctagtccgtggtaggaatgtcagactttctactaataccattcaagtcaactggaagcttgttcaacaacagtcgggggtaaatttcttgctgatcctgtttcattcagtacctgatgtattcatcataatgatgcccctttccttttaatctgtttcactgttatataaaaaaaggcctacaaggccgcatacaaggaacatgtgccccaaccttttagcacttaagccacataagcagccaattatgctgtataagagctacaaggtggggtcaccgcacgaaaccgcttaccactttttaaaacattgcaagtctatcatcaaaatgctcctggttcaacataagcaagtaatagcactacaatcatgctaaatagaacattgctacacatatttttgcatgcttgcattcatcgcttttagtttgtttgggaagctttgttaaaactgacagattcgcctagcaagatatgctagttatatgattctttccccttttgcagagtggtaagcgggatgcatggaaggagaaattgtcttcaaatgcatttgctcgtaaggtatactaaatttagtcttctaatggcttgatacaaatatgagaatcttgaatctatgcattagcctgttatactcattactcacaggcatatatcactcttttgtttcctgtatgtatatgttttcttcttttgtgctaattgtttttttctataaatgctgtagcttttagcttcaccaattctggtagaggctctccattttcaatatgatgagagggatccaaattcagccttcaactggttggagagatggaccataggtcgtgtctggaggcccatttcacatccaaagagagctgctgttactgatgccaagccacacacaaggaaggccagttatgcaatggaaacagagtcagggaagttgaagcgcaattctcggagaagttctgctgcaccagttgagtcctctcagacgaacatagccatggaaactgaaaaatcaaggcgaaacccaaggaaattcactagctctactgctgattcagtgcccgaaagtcagttaactgaacttgagaaggtcaaacgtaaccttaggaaggtaactaattctatggctgaggcttcaaaggtatctactcctgcaactgagatccctgaacgccaagaggtccaatgtgagaaaccacagcgaactgcagaagaagttccaaattatcctgagatccaagaacctcagaatggtaatctgttggaaaatgctaagacggatatcctggtacctgatcttcaacctgaaccggaggttccttcttatcaagttgaaactgaagaaaaagttgctgaactgactgttgctgaccctacggtagaaactatgccgctgcaagatatccacaatgaagaaaatgctttagtaaatgatatggaacagagatccaaagaagaacctctttctactgagagccttaaaagcagcaagaggaggtcttcattctcaaccaagacagagtatccagaaaatggttcaaagaattcgcctgctgttcccagctacatggctgcaacacaatctgcgaaggcgaaactgcggggacagaattcacccagacttagttctgactctgcggagaaaaatggcttcaccaggcgccattccctcccatcctctaatggtaagttgaactcgcactcgccgcgtacacaaaggccaacccatgctggtggcaaagagggagtgaaggctgacaagtctatgctatcatcaagagacgcaagtggtaagttgtaaacaatatatctgaatattcattgtttgcattagtatctgtattgtgcctaacattattatgcatttaactttaccttccagtatacgcagaatgcatttggatattaagaggaatttgaataatctagaagaaagttgatagaataaaccaatttcctgttttatgcataatatcttcctatcaccctcattttgctttacataatgaaaatgaaacatccatttcttcattatttcacataggtgggcgctgggacaccatctatcccttttgttatctagatttgttgtgatgtacatgagcttagcttgattgttaagagcatatcagtcctaaaatattcaccgaaatctgtagatatagtgagccttcagtcaatgtcacctgagatccaaatgtttagaatgtaaaggaacagatatatgacttcacaataatagctgtccttgtgacttaacaatattcctgttgaatttagtgacctcaattcttagtttgttttgctgattggaaagcttgatgtttcccatgttcttaaacatttttaaatttcatacttgtgggctcaagaaaacctgcctgttttgtttatcacatttatgcgatgtatgtttgagatgttcttttcacataccaagtagtagcattgcatagccattgtcacaatttctcaggccacttattttttaaaaaactacagaaagacctgccaaagctgaatggaaacgctgaagagttcatcgatcgagcaccaaatcctcctgttgggttgcgcaacattcgggtggatgacgacgatgatggcgtctgcagtttgatccaattgttttgcttccgatgtaaaaaagatgttctccccatccgtgacagtgaaccagctgctttgttgtggtttgtatctggtgcgatttgacttatttttatagggtttttgcgtcctttcctctgccatgttcatgtatagctgaagcgtttccggtttgcttttgatttccctgcctccccgagacaccctgcttttgttgagcaagagagctgctgatgttagagagaacttgttggattgaacaatcttatcccatttggacatctcttctgcgttttcttcttataactgactagcgagttgtgccattccatgacaccctgtttgtttactgcttttcttggcctccttttcatgtcgagcgctccagttgttttgcctgcactgtgaatgtgagatggatgtcatgttcctgaatcctgtgaaaattatgtactaccttcgtctcaaaatataacaatctaggatcagattagacatattctagtactatgaatctgtacaagaattttgttcagattagtataactatatgaaatgtttaattcaattttagattgctatatttttaagatggaggaagtagaattctaagaaatctcggcaaaattccggccttgtgttcaaaagggccaaaatatagtaacaatctagaattggattagacacatcttagtttcatgaatttgcacaagaattgcatgggatatttgttcagatttgtataactttaattcgattttagattgttactacattttgagataggagtaaaattctacaaaatctctagaaaattccggcattgtgttcaaaaggaggccaaggattcaaggcgaaatcgagtcccgcataagacatgtcggtcaccaccgtccgtccccaggtcccgcgacaccggcgtgtggccgctcgccgtctgatgggcgattcgacggcgaggtaagccatcgtcaggtcacggcggcggctgggccgcgctatcgcaagcccaaggatggcatgccatgggctcgtcacgcaagcaaaattcctcatttctcaatgacggcctggttgcggccccgctcgattacgaaaagtttgtagaaatttttaaaaccaaacttttcaacttgcacggtaagttgggaataaaaatcgtcgctgttcagacgttgactctcgttgtttttatagtttttgtatggatgctctcgtgtcgtgtgtctcgccatagtgcatgatgaccttaatttgattcccagaacataaaataaaagggaaatataaaatgtgctgataccattattgatcatcatgtataaagttttttggtagtatgactagtttgcgatcaattaaccaaatatgccagattatgtgatcaattattaccttgcttattcctaatatctatactaatactaatactaatctatactaatataaaaaggaggagttgctcctctctaatcttataggtaaaatcatccggattaatctgtaccgtccatccgcgcgcaagaggtctccaccgcacgattgagtactgccgcgaagactactctccattcacgcgcggagacttcgctcctcctcctcctcggcgtcctcgctcgctcctctgtactgccgccacgccgctgcatcctcgccgaagccgccttcttctccgtccgccgccggagccgaggtccccttccgccgctgccggatcctaccatccgtcgcggccggcgctcctcctcctcgctcgctcgctcgctccggattactgccgccgcgccgccgcatcctcgccggagccgaggtccccttctgccgccgccggatcctaccatctgccgcggccagcgccgagggaggccccatccgccgccggcgccaccatcatggccgcctcattcccacttcgcgttgtgcctccctccgctgctaccgcataggctcc

SEQ ID NO: 28265 - DNA, 1333 bp, Oryza sativa
caggagtagggtattacgcttcccagcggcccgaacctgtctacatcgcccgtgtctcgtgcgtttgctctctcgcgtacattccacagatcgagggtgaagaacctcactcagcgcccccggccgaaccggcaaaggggggcctgcgcggtctcccggtgaggagcctcacgctccgtcatctggcgcgccaggtagggggcgcgtgtgtttttcgggccctcgtcctctttcgtgtgcgccaagtttctcccgctcagcccaatggccgaacgggtagtggcgcacaacctctctccgagcgctagcggtgacgacagggagcggaacccgcgccgtcgagctcgtactccaccgtctccctctcgccgaagtcttgggcgggaggaggcgctcgaggggatcgaaagatccgcgacttcgccacccacgggtgatggagaaggacggcgagacggggagcgtcgcctcctcgtctacggcgatggcagcacgccccagggcgcgctccaggctgcgggcgcgctcctgcgtcacccgcccgtcgtccccgatccagagactccagctcgacgttggctggatgatgtggctaacttggtcatgacggcgcagcagcgcctaggcgccggcgggcggtcctacgcccccaaggcctctggcgctgctaccaccggctccgtgtcgtcgaggcggagggcgcggcgaaaggcggccgttacccgccgttcgtctgctattccctcgtcgacgcctccgacccaagaagatgtgcgtggggggccggatgcccgcctcaatattgagcgtcgacgcaatggtcgtcgtgctgcccacgcaacggagggcgcttcctcgtccggagcgccacttcagtttgggcatgggggccagcctcccatgtccccggttggcggtgccggctgtcgagcctttgtggcgagccttcggaacgtccgttggcccccaaggttccggcccaccatcaccgaaaaatacgacggaagcgtcaaccccgccgagtttctccagatctatacgaccgggattgaggctgctgggggtgacgacagggtcatggcgaatttcttccccatggtcctaaaaggtcaggcgtggggttggctgatgaacttgtcacccgcgtcggtacactcttgggaggatttgtgccagcagttcaccatgaacttccagggcacatatccgcgcccaggtgaagaagcggacttgcacgcggtacagcgaggggatgatgagtctcttcgctcgtacattcagcggttctgtcaagtccgcaacactataccgtgcatccccgcacacgcagtga

SEQ ID NO: 28266 - DNA, 12422 bp, Oryza sativa
  unsure (1)..(12422): unsure at all n locations
gggggcgtgcggcacaatcgcatgctcgtatagatcgcctccaaggagccccagaccaccgcggagctttttcagcctgcggactgtgtggctcgcaaggaggaggcctggacctggaactctccggttccggtgtggcagctccggccgcccccgggtccgctgctcgatcagggcggcgggacaggaggaggaagaagaggtcggccctttccgacgacgaggggcacgtcctcgccgtcgagggcgcttcgcgggccacccgaaaggggaggcttgcgagcgacagaaagaaggaggccggcgctcccagcagggagcgcccgaccggcaagtggtgctccgtgcacaacacttccctccacgacctcgcggactgccgcgcggtcaaaagtttggctgagcagacgaggaagtgggaggaggagaggagacaggagcgccgtgagggcaaggccccggcggcccccgccggcaaccggcgaggtgaggccaagcagaaggcccccgccgaggatgtcgacgatggcgacgataacctggggttccaggagcctcaggccacggtcgccaccgttgatgggggagcgtgcgctcacgtttctcgccggagcctcaaggccatgaagcgagagcttctggccgcggcccctacccatgaggcgacgcggcgggcgcgatggtcggaggtggccctcaccttcgaccagacggaccacccgccgtgcgttgcccggggaggacagatcgcgatggtggtttcccccaccatttgcaatgtgaagttggggcgtgccctcattgacgggggtgcagccctcaacatcctttctcccgcagcctttgacgccatcaaggccccggggatggtgctccggccgtcccagccaatcatcggtgtgacgccggggcacacttggccgctaggtcatatcgacctcccggtcacctttggtggttccgccaatttccgcacggagcgggtgaactttgatgtggcggacctcagtctgccctacaacgcggtcctggggagacccgcgttggtgaagttcatggcggcagtccactacgcctatctcagatgaagatgccgggccctggtggccccatcaccgtccatggcgacctccaagtcgcgcttgcttgtatggagcagcgttcggaccagctcgccgcggcgtccaagcccgagggtggcgacgagaggctcagcgcccccgtcccggctgccccgaggcagcggatggtcacgtgcgacgaggtcccggtcaaggaggttgccctgggcgacggcccgtccaagaccacatgaatcggtggtcttctggacgacaaataggaagacgcgctcgtctccttcctgcgggcaaacgccgacgtctttgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatctgtgaggtcatccatccggagtggctggcgaacccggtcgtcgtccccaaggcgaacggcaagcttcagatgtgcatcgactacaccgacctcaacaaggcatgtcctaaggacccttaccccttaccacgtatagatcagattgtcgactccaccgcggggtgcgaccttttgtgttttctagatgcatactctggttatcatcagattcgcatggttagggaggatgaggaaaaaactgcattcatcacccccataggaacttattgttatacgacaatgcccttcgggttaaagaatgcaggttctacttttcaacgtactactcgaatttctttgggtagccagttaggacgcaacgttgaggcttatgttgatgacttggttgtgaagacgcgcaaccaagagaccttactcttggatctagcggaaactttcgaaagtctccgctccgcccgcataaagctgaaccccgacaagtgcgtgttcggcgtgcctgcgggcaagcttctcgggtttttggtcactgcccgaggcatcgaggccaaccccgagaagatacgagctatagagcgaatgcgcccccccagcaaacttagggatgtgcaatgcgtcaccgtctgcatggccgccctaagtcggttcatatcgaggctgggagagaaggcgctacccctgtttaagctcctcaaacgttccgggccgtttacctggacggaggaggctgaacgggccctctctcagttgaaggcgtacctcagttctcccccggtcctggtcgccccgaaaccagatgaaccgttgctactttacctggcggcaaccccgcaggtggtcagcgcggcgttggtcgtggagcgcgacgaggacaaccctcgctccgcgcacccccaccctgtgtcggttcgacccgggagagagcagggaggagaggcccccgagccgaacggcggcccgaggcccccgacggccggagctggccctctgcccgcttgtccgacgttgccaggcgcccccgacccacaggatggccccggggccactgcgggaaggccgcgcccgttgccctccgaccccgaggtcgacgacacagaagccgagtgcgccccgcgcggcctctcggacgaaaagcgccctggagatgcggcccctgacgaaggggatcggccccgccgaaaggtgcagcggcccgtctatttcgttagcgaggccctccgggacgccaagacctgataccctcaggcccagaagatgctttacgctattctgatggcttcgaggaagttgcgccattattttcaggcgcatcgggtctcggtggttacgtcttaccccctcggccaaatcttgcataaccgagagggtactggacgggtggtgaaatgggcaatagaactctctgagttcgatttgcactttgaaccacgccacgcgatcaagagccaggccctcgccgactttgtggcagagtggaccccagctcccgagcccgtctccgtccccgaggccagctcgggcccctcgcagctgcctcacaccgcctactgggtgatgcagttcaacgggtccttgtctcttcagggtgccggtgcgggagtcacattgacctcaccgagcggagacgtcctcagatacctggtccgcctcgactttcgggcgaccaacaatatggcacagtacgagggactccttgcgggactcagggtggcagctggactggggatccgccgcctcctggtgttaggcgactcccaactggtcgttaaccaggtctgtaaggggtaccggtgctctgacccgcagatggacgcttacgtgcgtcaggtgcggcgtatggagcgccatttcgacgggatagagcttcggcacgttcccagacgggataacgcggtcgccgacgagctctcaaggctcgcttcctcgcgagcccagaccaccccgggcacttttgaagaaaggcttgcccagccgtcggcgcgacccgactgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaagatataaccaaaggaagctagaggttcttttgcataaagctagcatttaaaaacggtagttgaaggcagtaaaacagttgtagtaattaatcaacattaaccaaacactgtccaacgctacaccacgttgcaacaggcccaaccaaccacttgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccactcctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactcacaccattgcggtggcaccaatccaaagctatgctcatagtcaaagtctatgtaataatgtgatccccatgtgtgtgctagttgaactaagcatggctaagtatttcctaaaccaacatctagtcattttgatacccaagttatcaatggcataaggtaaacaataaatggctgagtattaggacctatcccacatgacattgtaaaaggatgcaacatttaatagaaatgcgggatatttgtaaattgggtacaatatgatcaaacgtattgcatgacttgccttgctctcgaactgatgagacctcagcaacgtcttcgagaaaccgcggatcgacgaaacggccgaagcctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcggaagggggggcggcgccgacaggcggggcccgcatgtcagcggttcaagagagaggaagggggcgccggcaagcgggccccatgggtcagcggcacaaggtggccggtccaccgtggaccgggaccacgcggggggggggggggccaccgccggtccacgggaccgacggtccggatcggccgggaggccgatcggacggcacggcggcggctaggcacggctcggctcggcttcaaaaccggccggccggccatggcaaccggcggcgacgcgcacggtcgccggcgacggcaatcggcggcgcaggaagcgacacggacggggcgaaaagcggcggcagcggctgaaggcgacggcgcacgcgcgaaggacggcggcgcacacgggagagagggaaaaaggggagcggaggggagcctcaccggtgagcacggcgaccaaagcggaggatgaaaggcggcggcgatgaccggcgacgcggaggcacggacagcggcggcgacaccctaggagaagatggagaggcgttaggagaggagacgacgaccacggcggcttgaattgccggccggagatggaggggagggaagaactcaccggctcgcgaggggagaagcgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggagctcgggtgtgacggcgcgggcgcggtagggggcgtgggagaggacggcaaatgggggaaacgagggaggggactcgggggagtgcttttatgggcgagggaggggaggacgtggccgggaaccctcccgatttggccggcgacgtggggaggagagagagagagaggtggattcaaatcgattcccgcccatttgcgggcgcgcatgcgggccgggagatgcgggggagagggcggcgacgtgggcgcgaggtgcgggcggagtggggcgcggagaatggcgggaaacggcggcggcgacgagggcggtttcgacggcagcagcagttgccggaggaaggagacgaccgacaggtggggcccacctgtcggcgtcccgagagaggagggaggggcggcttgggccggcccaacaaaggggaggccgggcgcgggagggagtgggccgacggcccaacagagaaagaaggaaaagaaaaagaaaaggaagaaaggatttttcctgggattaaaaattgcactttggtgatttttaattggtaaaaattatttccaaggctctgaaaattccactaaaaatcctgttaatatattgtgacatgtggaacccaagaaaaatcccacaatgccaattccaattattaattgcatttattaattagggaattagctctaggttaattaagataatttcttcggacgatttatttagccaatttttaaagcaaggagagggggaaacttcagggcgtgacaaacctaccccccttaaacggaatctcgaccccgagattcggaagggctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctgaatttcgatgtgatccggacttgcctgttcctcaggaactctcaaacattttttcaactgagagacgtggaacacattgtggatgccaagcatgttggagggaagttcgagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtccatacagtgcttcaaacggtgccatctgcagactagcttggtaactgttgttgtacgagaactcagcatacggtaagcttttgtcccatgctccaccaaagtcaagcgcacaggctctcaacatatcctctagtatttgattgactcgctcggtctggccatctgtttgtggatggtaagcagtgctgaagtttagacgggttcccaattcttcttgcaatttctgccagaactttgaagtgaattgacttcctcgatcagacacgatcttcttaggtacaccatgtaaacacatgattcttgccagatagagttctgctaatttcttccctgagtaggtagtgtgcaccggaatgaagtgagccattttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcgcagagtgctacgaattcagctatttcccttctcatgctgacccaccagaacttttctttgaggtcttggtacattttggtactgccgggatgaatggaatattgagtttgatgagcctcggttagtattaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcaaatgtcccaaatcacgttgaacctcacagcatagttcctctacccatgcgacgttgcagtgactcttcctgctcaaggcatctgcaaccacattagccttgccgggatgataatgtattcccatatcataatccttgatcagctccaaccatcttcgctgtctaagattcaaatcaggttgagtaaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagttggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgaccgaaggtctatcttagagaacacagtagctcctttcagctgatcgaacagatcatcaatccttggcaaaggatacttgttcttgatggtgacctcattgagtgcgcggtagtcaacacacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgtggtcagatcgtccggaaaaacctctggatactctctgactatgggaatatcctccagcttcttagtggttttctccactgctacctcttgttcttcaccagcagcctggtttaaactgatccttggcttctgcggcactggggactggaaggttaccacctctccttttgcattggtcaacttgatggtgcggctggcgcaatcaatcactcctctgtgccttgtcaaccaatccattccaagtatgacatctaggtccttggattcgagaagaatgaggttggctggaaaaatcgacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctaccaacctcttgggctgttctggcagagctggctgaactgattgagctggaatctttagtgaactcggagtagggttgagactgtgctgctcactgttgttgtggctgccactatggtggttcttgaagaacctacccgggtggtagggacggtgctgncggataatcatggtggaaggtccaccgtgatgtcccatcgtgaaccgaggcttttgactcttncnctggggagtcctgaactgagctgcctttctcttacggtttattttgttacagtgctcctcctgacggatagccttatccaccaacttctcaaagtcctcataatctctagagatcaactgggtagtcaattcatcatcaagaccagacagaaacttctcctgcctctcggcatcggtacgcacgtcctcaggggcgtagcgcgcgaggcggtgaactcatgcaaatactctataactgttctggttccttgttgcagggaacgggaactactctcttacttttgtggccacaaattcccctcgggtaaccctagtgctttattggaaacctatgacaataactctagtccaagctaagcttctgctcccagcttgggacggtgtcatccatggtcagttgtacccacgcataatagtaagtcgggaactcttcgtagtctgtgtgtgctatgctaaaagctaactctttctctctgcatcgcttgtcatttgcataaagtattcatgcttgcttctacaatggtctatgaatcctagtcgtcgggctctctgattggtgttggtgtgtgcttgagtaaagttggcggtcttgacactgaagaaattctaacagtttggactgatgatgtgtatgactatactgcatgttctgctgctgcagctgtgcttgctgctgcacctgctgtcaacacctgatggaactgttgctgcatctgttgcatcatcattgtcatcatctgagtctgattgtccaacacctgagcaaattgttgggttctcgggcggtgggagacggactgttgtcaaatgcaccgttggcacgtgctccattgatcggctcttcgctgccattggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaatttttttcttttttttaaaaaaaaaatccgatccgaaagaacgaccaagatttttcccgcaaaccaaaaaggcaaaactccaaattttcccgaaacaattccaggtgcaaaagggcatatgcatatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28267 - DNA, 542 bp, Oryza sativa
cccgggcgggttcgagtatctgtatgtcgctatcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtggctactgcgaagacatgggcatcaagctctgcttcgcctcacccgcccatcccagaagcaacggccaagtggagcgcgccaacgcggaaatccttaagggcctcaaaaccaagaccttcaacatcctcaagaagcacggcgactcgtggatcgaggagttgccagtggtgctctgggcaaaccgaaccacgccaagccgagcaactggggaaacgcctttcttcctcatctacggcgcggaggcggttctcccatctgagctcaccctgaggtcccctcgggtcaccatgtattgcgaggctgatcaagatcagcttcgcagagatgacctcgactatttggaagagcgaaggc

SEQ ID NO: 28268 - DNA, 12813 bp, Oryza sativa
  unsure (1)..(12813): unsure at all n locations
tgaattagcacgctcgtgctcgatcctgcccacgggggcccgggccggctaaaatcgccaaaaggggcccagaaccgagccgtgccccggggcgtggtgaactccgggggggaatcggcaaaggcccacaatcgggtcatccataaccctcggtcaccacgctcccggcctggccagtctcgacatgtggatttccccaggcactggctccgacccgtgccgtttgaggctgggacctgggcacgagcccttgttcaagccaagacacagaaggaccgcggcacagaccatcctcgtctcatacacacaacaaatagaattgacacagaaatttcctctttatttgattgcagattaagttagtctatacaagaagggggcccgaaggcctcggaagaagaaaggaaaaactatataaagattggcaggggcctgggggctcattccgacacgcccgggtcgccggcctcatcaccgccgtcaccgccctcttcgtcggaatcgagggcgaatgcgagccggggggccgtaccctcgaagctgtggacgatgtggtcggcggcgtcccggacctgcgcacgcgcgtcgtcctcggtcccgggaggaaactcgtctagtgctgcccacggggagaagtccgggtccctggcctggtagcttgccagtacgagctccaccaccccccgggcgaggtccctcgaggatgacttgatcgtctcctcaagctcctcggggagccgctggagggtcccggccatctctgagaggcgctgggcgaggcccccctggttggcggcatacttcacggtccgcccgccccagaggcccgcctgtcgcccggcgcggtctagacgggagacggcgtcccgaagcatgccgggacctacctcgttcgccaggcggagggcctcgacctccccggcggacgagtccaacgcgccctgcagatcggcgatggtgtgttcggcagctgcgaggcgggcggctaggtcgccgtcgcccgcggccgctcccgccgctgcgcgccctcgcgtccaactccttcacccgcgcctcgagctcagcggcccgctgatccagtgcggccctctcggcgcgggcgccttccagattacggcgcgcctgctcctcccgcgctgcctcgcggagggacaggctgtccgccagccgctgcgccgcggcctcggcctcctcgagagctcgctcccgctcggtgagcgcgtcctcgcggaggcggagtgcggactcctcttcggcgcaggcggcttcgtgcgctgccagcgttgcctcccggatggcgacggcggcctcgcggtccgccaggtccctctccctcgcgcgggcgcgctcttccagcgccttggcgcgagcttcaagggcctcttcgcgccgctgggacgccgccttgttctccgccgcccgccgttcccgtgcagcggcggcgtcaaggactccccgggcggcgtcgagtttcttctctagctccgccgcccggctcccgtattggaggcggagatcatcccgcgcctcgttgagcacggcggtggcgatgagggcagtctcccgctcctcctccacctccctagcgatctccgccagctccctctgacgggcctcgagctctgaggcgtgccggcggtgtgccttgcggcccgcctccaccatggcttccaccgagcgccgcccctcctcgacgcgcgcccacgccgcgtcgagctccttccgctctgcctgcaggacctccatctgggcacctagcccgtccagcaccgtggtgttcgcggcggctaaggcctgcaggaggggctccgcgttcagtcgggcagcggaaggcagaggggagagccgcctcggtgcgggcgccgcgtggcacggcccgccgatcgacgtgccggactcgggagcgtctcccgaagctggcacgtcccgagcgtcgcccgaggggtcgggcccgagcggtgcgcccgtggcctcgtcgtgggtggcctcggaagtcgtcgtcgcctcgggtggagtcgggtcgggggcttggcaggccgcttggcatgcgcgcgcctcctccgcctcccggacggactcctcggcccggcggagtttggcctcctcccgagcggcttcctcagcctggcgagcccggacggcctcctgggcagcttcctcggtttcccggaggcggtctgcgtcttctcgccggtcagcctcccgcctccgggcctccacggtcgccgtctcctcagcctcggactggccggacttggaatggcggggggggggggggcgacggaatctcgctgaggcagaagaaaaaccagaagacaaaaagaaacggatgagtgaaaacttgccttgggagataggagaatgaatacagccgcagtgggcgcggggacgaacctgcgaggaggtcggctaaacgaccaccttgggggggagataaggtttccccggcgtggttcggtctcccccaccttgcggagccgcttcttctttcgttccccctcggactgcgacgtcggcacggcaccctctgggcgcctgctgctggcacgcgccgccccgccccctcggggaggagatggggaaggggttccttcttgcttcctcttcccccgggcgtcggtagggcggctgcttcccgggcccccgtcgcggggcccagaagcacgaccccctcccggggtagattgttcccccctgtggctcccgcccgcgccatcgtggcctcgaggaacccgttcctccgacgccctgaccgcctgcatgatggtcaggatggtggtgcgatctggatcgctgcagaggggaaggactccttgggggatgagggatgcttccacggagctgagattcagcacccgttggaccactatcttgaagtcatcaggggcccagtcccatctgaccccctggtgggtcctcatgcagtcttcagacccggtatactcccaggcgccccgggcgcgccgctggagcggcgcaatccggcgacgaaggtagtcgccgtacaccatggcccccgtgagcccctgggatcgcagacccgccaggcggtcaagaacggcgtcgtagccgtctcccagatctaccggcgcccgccagctggagacctgcgctgggggctggctcggaagtcggaggcgcgcttcgtcggcgagggggatgtagaaccagtcgctcttccagtcgtcccatttcttgcggaggacgcagggaatgtagcggctcagcaccggcccccgcggctagaagtagcagccaccaactaccgacggcggcgacactggctgtacggtgaagaaccaccggaacagccgaagagatgggcgcaccccgataaacatctcacacaggtgcgcgaagatggccaacgtcattactgcgttgggcgtaaggtgcaccatctggagatcataaaactccagaacatccatgaagaaagaagagaatggtgggaccagccctgccattgcgaaagggaggaagaagacggaccgccccgggtagtgtggtgccgggcgtccctcgcccagctcgaccgcctcccggccggcggcagatgccggcatgaatcggcgcggcagcccggcctgcctctcgctcacgatgcgggaaggcggcagcacgctaccgtcgagcggtgcggagccccgtgccatgacgccggcggaggaggagattgagaacgagtgagtgcggcaaaggtagggcacaggaaacgaggagttagggcgcaagcggcgaaggcaaggggaataatggcgagaggaaggaaacgaatctcttccttggcacccttatacccttgccaacgctattcctggctcctcgtttcccgcgcccactatctcgccccctcgtttctcgcgcccacgcctccactaatcccactcgcccgtttgcggcgcacgaggcggatgtgcggccgtggcagtcgagatgggacatatcgtgcgcgcgttaactacgctcgccgaccgaagcgtcatcatcatatctccaggcgaaatgaaccggctcgtcccgattcgcgcgctatttcgagaaatgtagcggtctcgaagaggccactcattattatcggtcatttttccctagccgatgcgcgcgatttgcgaccgctgggttcctgcccgcctgtagaggccggtcccaccggtcaccagacctaaggagtggcgtcacgcccgagcgcttccctcgaggggggcgatcgccctggcataacgccgggggctactgtcggtgacatgggatcgggggtatcgtgactagaggcttgggcagccgcggtcacccacgtggcctgaccccctcgggggggtcgggcccgagggagacttggccaccccctcctctgtctccccgaggggtcgggccccttctgtttcggccccgagggctggggcgccccgaccccctgtggtattggcgccacgtgtgtgggttaggtgggcacagcggcgctcacctaaccgcatttattgcgggatgaacaagcgcgccacgccgcatttaatgcggcatggcgcacgcatatccggtccgtgaccggtcgcagtgtgtgaccggtcacagaccggtcagatcgcgggttagatggcagcaggcagcctgtcatacgcctcgccccgtcccgtcggaatgatgagagcctcttggcactcatccctagctggagccagcatggtaactcctgggattagcacgtcagtcccggctcgattcatgccaggcttcatcgcaaccattgcaaggaaggcactgtatgaagaagggcaggtgtgtggcatgccgaactgacgcgtggtggacaagaatgaccggtctgtcactggtccgacgccggtcacgtcatcagcagacaaccgtgctctcatattgcatcagcttccggcggagtggaggcaggtatgacccatcccatcggagggtcattcgaacagcggccattgcaaatctccgccggaagatgaagaaatgacagggtgatcccctgtgtctgacaagtgacggcgctgggcatcattcaaagacaggcgttgattcagcttcaaggcggaggcgcgtgtcaagatttggtcaagatagggtgggtctccacccaaaggaagagtagttagaagtggtgcatgtggtatccccttgaaatataaaaggaggaccttgcccacgagaagagggggagaaaaaaggaaagagaagaaaaagaggaggaaaaggaggaggaaaaaggaggggttctagagctggaactctcttgcttgccggctctctgtaactttttctcacacatgcccaccagaacacaggagtagggtattacgcttcccagcggcccgaacctgtctacatcgcctgtgtctcgtgcgtttgctctctcgcgtacattccacagatcgagggtgaagaacctcactcagcgcccccggccgaaccggcaaaggggggcctgcgcggtctcccggtgaggagcctcacgctccgtcactaacattgaacaatgagaaacaattaacaaatcacaagccctttttaatttcataggcctcatacttagggattagtaatttataccttaactttgctggttgagaccgtcgcctaccctttcctcctgggcgacgcctgctcaagcttctctccggcctgctacaccctcccatcgctccctccggcacgcacggcgacccaaggggtgactcgcggcggcgatggcgatgtggtcctgataacaatgaaacaacagctcgaccgggtcggacgcgcctttaaaagggcctgttgaactcccattgttcgacaggggcggtggagaggacctgtcgaacgcccccggttcgacaagccgcgcggcgccaggtggtgggaccagccgaactccctccgttcaatacgctgccctgttgaatccccagcattcgactagccctagtcgaacgcttgccattcgataggtggcctatcgaagtgcagctattcgaccggtccccaaattcgcgatttcctccggatggccactaattttgtgatttttcattaaaataatattatttctaaaaaaaattctgctggggagtaactgattggtggaaagttagttttttttggatgatttggtgctgcatgttgttgatttagctaggtttgttatctctggatgctttgagctcatctgggtgaaacaaagaccctagctactgtgccgattacgctgtgtaacaaaaactcttttccttctaatatattgacgtgcaatccttttgcgcgcttgaaaaaaaaagaccctagctattgagctagatgttaacaatatatataagctgtatttagttcacactgaagtttggaagtttggttgaaattggtacgatgtgatagaaaagttgtgtgtgtataaaaaatttgatgtgatggaaagttggaagtttggaaaaaaaactttggaactaaacagggccatagtttgatgttatttggattgcaatactgtctgtcatcaggcccagaaataactgcgagcagttgtggttaccctgtgttataatctatagtgcatgttcatcattgtttactaggtaggctgtttaatgtttgtgataagctgttttaggacaatcgtgtctagttctatgttgaaggggatttttgttccctatcgaaatacaggattaatctgggaattgtctgagaaatttaatacatgtgagatgcaatcatgggatttatgtttactctctgactggtaagtttgggactctgtttgtaccttgtattgcaaaatgcttcaacagctctgaggtcaccaaatattgtttgtctgcgtgttttctcctcaagtgccttatgtagttagtcctaaaggtttacattttggacactacctttgttgtttgaggctaattacttaagataaagtctgttgtcaacttcaactcttaattaaccaaaccaatagttctagtttgttgttttgactgttcataatatctttcagtgtccaagatgtctatcagtgttgtactatcaattaatcctgattttttttcccgtgctgcagtttttcttatttgatactccttccgtcccataatatagcaacatagtaccggatggaacatttcatagtataacgaaacagtcctagattgccattgacaatagatattatgggacggagggagtacattttatcctgacaaactattgacaaacttatctgactggcacatcaaaaattgcactgaaatacaaggatggtgtgaaacttgagcattattctttcgttcatattaacaaggcagcctattaacaaccgggaccacctatacatttgacgacaatttttctcctaaaaatttgacagaagtaattacactacactgtaacttatatgtaattacactgtaacttgcatgtaactagagtgtaacttgtatataagtttcacgtaattttgaatcgttaaatctattacaagatttattttggtgaggaagaaaaaaaatcacagcacacatatatatgtaaggatttgttcccacaacctccattttatcgaaataacatattacaaagagatttttgaaagttacatacaagttatactatagttacagtgtaattacactacaattatactataattatatctgtcaaatttgttagagaaaatttgtcgacaaatatatagcaaaatcgttaacaaccttaggaaaggagggagtataatttcctcagcttggacacaccacagaggatcccgttccggcccaatagaccaacgtaccccccgggtccggcccaggatggcagcacccccacccatccgtagggcccacacgaaaatcaaattccataactaccctttaaaacccacgcctaaactcgcgtaaacgtcgcgttgaaggtaggggcagcgaggtaatttcacgcgggcgaaacgatagcgagaggatatggactcggctcggcgcggctagtgggcaaaaagaaaaaaaaaaaagaaagcgcgaatacgactagggttttattcctttcctcacaaacacaccctatcccccctcactacgtctcttccttttctctttcgccggcggcgacggccgcggacttttgcctttcccacgccctcgatcttggcgggtggagagccatggcgatgcagtccggcaggcgagcctcgtagccaggaggggtcagttccccagtcacccaccccacacacgaagatagcgagcttgtagcgtgattttttttgtaggccgtcgaactcgcacctatggcgaccgcgaacccctttgacctcctcggcggcgacgacaacgacgaccccgcgcagctgctggccaaggcggccgtcgcggcgcagaaggccgaggcgaaaaaagccgcggcggcggcggcggctccggccgccgggaagggcggcncgcaaccggccgccttcaagttccccaccaagccggctcccccttcacaggccggtgagttttgtggttgaggttctggagttctagatctgggggatacgcgttcgcttttgttcctgttcttattctctaggattattaaatgatgggtcttgtcaacttatataggattcttctaacgattgtaccgaacagcataaaattttgataccatggatatgtaggttgtaaaagatatgagtattgatttcattttacccattttctggtaagtaaggcttcttttacttagtgaaatggttatgtttaatacatgttttgtttcagtgagggagtctcgagatggcagtgcaccctcacgcggagggtatgggcgcggagaacgcggccgaggcagaggtgggcgaggctatggtcaaaaccgagactttggaggtgaagaaatgaatggcttccagggaggatatggtggaggcggtggtagcagagctggaggtgaagaaggcgctcaggacagggagaggggccctcggccacccttccagggaggaggtcgacgaggtgggtatggtgatgactctgagaggatgtctcggaggccatatgagcgccatagcggcactggccgtgggtatgagatgaagcgtgagggttcggggcgtgggaactggggaactaccactgatgaaattctcgcccagtaagtggctcatcatttaagctgttcatgtccatactatggagatataagtacttattgtgttgtttgattggtcagggaaactggggaagccctgaaattggatgagaaggcccctgttactgagaagcaaggcgcaccggagggtgctccacaggcagatgagaacaaggataacaaagatgtcactccaaatgaggaagaaaaggaagaggataaggtatacttctgatcacttaaatcaatatggaatgcagatttttagatttatactatatctttagtattatagaaagtaagacacgttaatataattcgtttgaacttgccaattggtaaggtttgtgaacatgacttgttgctggcttcaaaaatgtcacttttccttgcctgattagtcatagttggatttatgtgtgaaaatgttccttttattgttagtcactgtggtcccaaagggtacttgcacaatttttagttttccagcagccacaaagttgagatggcttaatgacttcctttttctctgaggaaatggctaaaaatgagagtagcagatcttctaaagactttgagggctctccatttctgactacaaacaactgtccaatgaagtattgattttgatagccatatggccataagtttgtcataattattttgtaggttggccacaatatgaagtaacagtactctaagctgaaaccattctggctggttacttgttttcttttgattgcttgtgtgctcatatgtgagtactttttgaacaaataattttggtgcatactaatttttaggtgaattgtgcccttgttttctgaattactcctataacttccttttacaacagtcgtctaggagtgtattatatttgtccatacctcctctcttatgattcaaatgtttgatgatataggaaatgactcttgaggagtttgagaaattaagggaggagaagaggaaagcacttctttctttgaagactgaagagaggaaggttgaaattgacaaggatttgaagtctatgcaaccactttccaataagaaagaaaatgatgaagttttcatcaaactggtacctttgccatttacgccttgtaatccttccattctcttcaaccgatggaaatattgatggactgataatttttcgctgtagggatctgacaaggatgctttgaagaagaaagaaaatgctgaacgtgatgagcgtgctaagaaggtattacatgttcccatcttaccttagatatctctacctctcccctaacaagctaatggatttttactattaatattctggcataatcaaccacttgttaccatcagcctgttttatctggtcatggtaaatttactttgccttttgtattgtattcattttacactcctgaagtctgaactgctgttacaacttcatttacattttgtctgatctgctgttagcctattatctgttcatttgggattcttcatgctttggtgctttcaattagaagaaatgctttaattatgtactcagtgtttactgattgggggtcaattttttcagtctgtgagcatcaacgagttcctaaaaccagctgaaggagagaggtactatggcggccgtggtcgtggcaggggccgcggggatcgtggcggtttcaggggtggatatggtgagggccatcgctctgcagctccaccagctccagaaatcaaagaccaatcccaattccccactcttggtcggaagtgaaatgcatgtactgcctgcagtatcaagttatgtttgcggtcaactttgaattttgtctatccgtaaatcactgtgcaagtgctgatctgatcaaacaaataatggtgtcgcatttggtcaagagtccccgatatgtcagtcgaatttgtatatcggagttgcttgttacgtttcagaattttgtaggctgttattgaactcccttctgttaccagcaaagcgtttcctacgtgctgccagctttggtttcgtttgtgatttgattgggcttaccttgttcgtaaagctgtttggctggcacaagcagattcaggttcctctgaataaagtgacagctgacagctggttcatatgtactgcagaagcccgacgtgattaacagaaagctttactgtgatgcagattctatagggtacaaaacaaagggattttgcagacaaggagcttaaccatctgaaaatggatttattctgcaattatttgctacctaaagacctaattgcctattatttgtcatggtatatattatctgggcaaaaccatctgaaggaaaaaaaaatttctagacaacacagctgcagatgtggctacagtatggtggcatttgagatttccagagcaagatatcaaatttcccccgacctgaagcttctccaaacagcagatcctgaattgtaatatttggaacctcagcgttttcagaacctttctggtaactgtcgtagattagaagggatttgataggctttggttcactaattatccaagcgtatcgaggatggttcttgtccgtcttcagatcatgagggtattcgcttgccaagataagattcttctgcatgtactctctggtgccttcaagaaccctgcgccagaaatgggcgtcaagatgaacccttagcaaggcaccaacaacatgagcacaaaatagagatcttctcagctctgctgcaatctccatagctattgatgtcaactttggatgctcatcaggatctgcacttccaaacacaaacaccttgaagtagtaccagtaggcttcagttggcaggcatttcagcctaagagcacctgtcgtacctctgatcggcttgtgattatgatcttgcttccacggggaatgcggttttcggaggagtaatacagctccttccatgtatcttcatccacatcgcctaagatttcgatgacgagcaacagtgttttcggtgatgaggtacagttgttttagtgcttgatgatacatctgtctctgaaagtggccactgtctcatgcttcagctcgtctccattgtagaacaagatcagagagaagtggctcttcaccctctcatctctgcagacatgctcaatcagtgtgctcttcccgattaacgcgggaccaatgatcggaagaacacctatgtcattacaactaccatgaggatcaggatcaatccgcagcaagaaatcgatgacttgttctcgctcgatctgacggctgaacatacacttgtccagataaagatgcgtgctgaaaggttgccggtacataaccggagggcagctcatcagaaacacgatgaactcctttgtgtcagcaatggcgtcttccaggctacgaatcatggactccaaatcctgaaagctactagttctagcacgagagaaacggattcgcttggcaggattgagccttgacattgcaaacgagcttctcacctgttcatcttctttctcctcctctttctggaggagatcagcccggtgtctaaaggtgtcgaggacgtaatggcctctgacaagttgtcttttcatgccccttagcttgcggaagcatccccttggtgggtaatatgcttccctctgccctcctcgacgatggtgtgtgtccgtagagcagccggcgcagctgccgtacgccgtcgtcgatcgccgccggctggttgctgcagtatctg

SEQ ID NO: 28269 - DNA, 3817 bp, Oryza sativa
acgtttaaccactcgtcttattcaattttttttgaaattattattattttgtttgagacttactttattatctacagtactttgagcacaacttttcgttttttatatttggaaaaaaaatttgaataagacgagtggtcaaacattgcaagcaaaaactcaaaatcccttatattatgggacggagggagtaattagcaagctagtgcattttcacttggtcaggtcttggtctatggtctaaatttccgggcggaaatgaagtgacagagagtcaagttaagaccgaattgaagacttgatcggcaaagtgtccctcgtttttgcatgtcgtaaaaaaagatctgaagaaaatttgacggatcaacacaagggcttcggtgatcggtggtgtgcttgggtcgctatgcttttttgaactgcaacaacaagagtgttaatcaatggcaatcccgggaatgagattcatcaccgctgaggagtccgccaaggcgacccaatctcaccaatgatattcatcctcgtgatggattttctcagccttctgtttcaaaaggcggaacacgaggggctattgcaggatttgggaatccctcacataatctctctttatgctgatgatgtggtcgttttcatcaaaccgacgattgaggaggttaaggtcgcaactgaaatcctaagcatcttcggtgaggcctctgggctccggacaaattttggcaaatgttcagccctgccgattcagtgctctgaggagttgcttgctgagatacagccagaattgccctgccctattgcttccttcccctgcaaatacttagtctgcccctttccatcttccggttgaagaaggaagacctgcagccattcattgacagcatagcccagcggcttccagcttggaaatccaaccaaatgtcgtcgataggtcgtgtaacaatggtgcaggctgtactcagtgcaatcccaatctacctgctgatttctgtcgacgcacccaagtgggtgatcaaaggaattgacaaaatccagcgcgggtttctctgggcaggcaaagtgcaagccaatggaggttgctgtcggatcgcttggtcgagggtgtgtgctcctaagaactatggcggtttaggcttgccgaatctggagttgatgggtattgcacttcgctccagatggacttggctacagcggacttcactaggtaaaccatggaaaggcctagacatcccggggtcgcaaaaagagaagagcttcgtggctgcatccacagtctgtcagctgggagatggacaaacgatcctcttctgggaggatagctggctgcaagagggctgcatccggtccattgctcctaacatctacgatcgcgtttcgccttgcatgcgccggcaccggacggtggctgaggcactaacggatcgtagatggatcaaggatatcgccggggcacttgggatccaagccatcctagagtatttgaagctttggtcgctacttcatttggcgacctgtatccctaccactcctgattctttcagctggaaatgggaaagctcgggtcagtacatctcaagatcttcttacaaggctctgttctttggtcggatctccttcctctcgaccccgatttggaaatcacttgctccacctcgatgccgctttttcctgtggttggtagcaataaacagatgttggaccgccgatcgtctgcgaagccaggggttgcctcacctggaccgctgtgtcctttgtgaccaaaaggaggagagcattgaccacattctggtaggctgcccagagtcgaggcaactttggtggtggacattaagagcgttaggcattccagattgtctacccatcaacgaaccatcctttcacctctggctttgtggaagccggatgaaattgagagagcaacatcgctggggctttgacaccattacaacgctgatggcttggtcgatttggaaggagcaaaataatcggatcttcaatcagcagtccaagtcttggatcgaagtggcgaaagcaatggtggaagaagccgtactttggaagtcgacaaatgcaggggtcccttccattttacctctgtgaggtcgtggtagccaaatctagcgccagatatcatgttagatcactagtctccagtatcggtcccgtgcttgtttttcatttctcactgttaataacttttatttctcttaagggaaaaaatgcgctccttgtgtattccccaaaaaaaattttgatggatcaacgagtccttgttttgctgtagcgcgtcgtctgcatgtctggcctacagtacacgaggaaaatccacctcgatttgatgagcatatactcccttcgggtttgtattattaacgttttaaataaggttaaggttaactttttataattttgattaccaataactttaaaatatataatttaaagacactatcacgccatatgtaaatttattttacaaatcagcataataaaaataaaatcatatttattatatatattatattacaaaatctagttaaagatatattttagagacagtgttattattgtttaattatcgaatcggagagaatacttactatagtcactgtagctcgtctgcatgtctggcctacacgaggcatataccccagggcccaagagaagaccgtgacgaggcatgcaccgcacgtgacgtcattcccgaccatcgccgtcgtgtgttctaggcttctagcacacgtctaaacgagattacaggacactagccacgtgtttttatcacttaacacacctgtgtgtatgtactgtgtcctgagattaaatactggaaaatgtgatcgagcaaccgtgtcacttttcaacaagaaatttataatttgattgttggtcaaacaaactgccagtatttagtgccgattcttagtacagctagcatcctagtagtagttatactgcagtcggtatattttttgaactcaaggaaaatgaattcagtatcacaggagagaaagcagtctactgcactctgcagtgtcaaccttcagcatctaaatcagttcagaagttaaaaaaaaaaggaaatccataatgcaaataaccattccatgcaccaacctactgaaagcctgaaccacatgtcatttaacctagtacataacacaatttgatatgtagctgtaataaggaggaatccgagatttccacaccaaaacctcgaatttccctcggcgcctgacgcgtccagacagcaaatcaaccagcttaatctttggaccatcatcttcaacaagagccttctggtagctatcacgcagtacaaagtaattttcaggtttaggtctcacaattacccaaccgaacttaggatgatcctggcaatcacaaggcataagggagttaatttcgtctctgtactctctgacgaacgcaacaaacctgctccagaatttggagttgaaattggctttcagtagagctcctccgatgtgtgcacacaagaagcagcctcttagcactgtcgcgatctccatcgccatggatgcaagctttggatgctgctctgggtctgtggctccaaatgcaagaaccttgaagaagtaccagtaggcttcgaatggcaggaaattcagcctcagagcttgtttggctcccaacctgatgatcttctctgatcggcttgtgatcatgattttgatctcatgtgtcatttgctttctgaaagaagagtggattttcttgagtgttctttcatcaacatctcctaagagctcaatgataagcagcaatcttccatccatggcatcgtttgattcatttc

SEQ ID NO: 28270 - DNA, 4923 bp, Oryza sativa
ccttggggtcaccgatgattctcgcgaggctagtgacagtctgatgcagatcgtttgtgcttcttgtctgaatttgagtgttgctgctgctgtcagagaagcggatacgcttagcccggttgaatttggacagagcagaacgtggtgttacctcgtcctcctcctcatctctgaatctgaaggcgtcaagaacgcagtggcctctgaacatctgctccctgagcagctcgagctgacggatcatcccatggttcgtgacatgccgctgctcagcttcctcgacgacggtgcggatccgcacaaaaagatggtgcagcctctgaagattttcatcgaccgatggccgctgcttcgggtacctgtcgatcatgaaggttattgatctgctgacaaaatcgccaagaattgcagataagagctccatcaagaacccttctctgaagaaagtagtgagtgccatggatgcagagatgagagcagagaagtgcagttttgcaggtggtgttgtgttgtttgcttgcacaagagtagcaggactgaccaaacgccttatctaagggcagagtcaatgccgtgaggattgggtcacgaagtgcagatgattaggcgtacagaaactgtcaggtcagattcatcagaccaaatttactaacccttcctgttccataagaaatcacaggtcttttatctctgagatatcacatctttgacaaagattgtgatttgtgagttgaagtttggtacggtgataacaggggactaggttatttgcaccatgtagctactaataataaaaaaaacagaggtgttatgcattcttgcagaaaaaaatggcacaagtcgttgctggactcactagctgttgactgaataataaaaacagcggggttatgaattctacagaaaaaattggcacaagtcgttgctggactcagactgaaagcaacatttttgttttctggaacgaatagtaccaaacaatgcgagatttcatatcgatatagcaagaaaaaaaaagattataggcctgggactatgaaagcaacggaattagcacagcacagttccgttctgttcaatgcctgaacctttttgggaatacgcgagaagcacatcattgtattaagaaggaataaatgtatgtacaaaacggtccgaaaaattaaaaccgaaagggacaagatacaagagggggaagaagaaacaaaagcctaatctcccaaagaatttggcgacccatctccattcataggaactaccatgaccagtattgcggctctagccagtcgccaaagatccgcttcacccgtcatagccctagcaatctctgtccatggtctgctattctagttgaagacccgattgtttctttcctttcaaatcgtccacgctaccagtgctgtgatggtgttgaacccccggcgatgttccttggccatctttttgcgactgtgatacaaccaagaatgaaaagattgctcgttgagtggtaaacactcagaatgcccaatagctctaagagcaatccaccacagctggcgagactccgggcatgcgaccaagagatgatcaatcgtttcgtcgtattgatcacagagaagacagcgagccgggtgcgatataccacgactccgaagacggtacactgtccaacagcggttaagggcgaccaaccaaaggaagtaccaacaacaaggggtgccaccgtgccaaagacttccagattggcttgtgttggaggcgagttcttccaaagaagaggacacgatacgccgagcgggagaagtacagtcccgaggtctcccagcgccatgaaagcgtgtcgggttcccccaagagttgcatagatcgaaggaggtcccaaagcttgaagtactccaggatcgcttgcaccttcaacaccacacagatgtctcaaatccatctcatgtcgtgcaatgcctcagccactgtacgcctgttctagaagcgggcggggacagctgcgtagaaggccggcgccagcaattgaattaaagagccctgcagccaacatcccagaacaacaccgaaatcccgtctcccaccgagaataccatagacgagatgaggttgcctttcttctgtgaaagtggaatattaaacccctgccatggcttgtccagcgaggtccgttgctgccagagccatcgcgacctcaacgcaactcccaacctctcgagatcggggatacccaaaccaccatactctttgggtgagcaaactcaacgcaactcccaacctcttgagatcggggatacccaaaccaccctactctttgggtgagcaaactcgagcccatgcgacctgacagacgctgccagtgcctgaaactgacagggcaatgcaatgactgaacaaccagagcattcgctcaactaaggaaagcaagccattactaatctcgaacttacagaaatggacaagcataatacagccaacgtatgcttctaagatcttatagttcaaatagacatcagaatatggctcagatagagtacaaggaaaatgtaggttataactaaaaaagaggagcaaataaacacacatcaaacaccaactcgtctacaacatgctgtgattcgtgaagattgtaccacacatcgtgaaataaagttatggtagggtggaatctgggatttccatactaagatttcagaattgcttctagccttagcttttccacatagcatatcttgcactgttgtatctggaacatcatcttcaagagaaccttttgggtaaggttcatacatacaaaagtgtttgataggctgagctattcccttgatataggcaggatggttcattgtaacatcatctggatattcactgtacaaattgaggttatttgggatgtgctctctggtccatgcaagaactctgtaccaaaattgagcattgaaatttgttcttagtaagccggcaaaaacgtttccatgcatgaacgatccttccatctcctttgctatctccatggctatggatgctagcttcacatgctcttcggatctatacttccgaagatgcgtaccttgaagaaataccagaatgcttcacatgtcaaccgcctcagtctaagaggtcgcgtggtcccgaaacttgtgatgttctcagatcgacttgtgattatgattttagtaccatgtggcatgcgcagttctgaagagtataatctccatttctcctcatcagcatacctggagagttcaatgacaagtagcaatcttttgtggaaagcattaccccgatgcttaacgataaaattctctctcagagtggttggtgtttcatccttcatggaatttccactgtaaaagagaatcagagagaagtgatttctgactctctcatcgatgcagacatgttcaacaagagtgctctttccgatatgtcttggaccgatgattgggaggacaccaagatttgaactaccgggtggttccatctgtagcaagaactcaatggcatgttcaagttccatatgtcgattgaacatacacttgtccaaaaacaaatgcgtgctgtaaggttggcgatacataggacggtactgcacaagaaattcaatgaactccttcatgtcagctatgaggatttctagcctatgaaccatcttctgcaaatcttctacctccccaccactgaataccgtttgttgaggtttactagttgggaaacgaagacgcttagcaggattgaatctggacaaagcaaatgaatggctcacctcgtcatctttggccttgtcttgaatagctcggtatctgaagttatcgagaatgtagcagcctttcaacatctcatctctaaggatcttgagctgctggagcatcccttggtttctgacgtgccgcccttcagcctcctcgacgatggtactgatcctcataagcagctgccgtagcctctgtaggttctcctcagcagttgcctgattgcagttgcagtacttcccaactaagaaggacatggacctctgataagatccccaatagctgcagaaatgaacatctccattaactgtgacctggaaatggacatcttgatctctcctagagtcccacacacactcactgaagtctgaagatgatactaatcgagtctgaaggttcttgggagctttgtcacttgttgcagagtaaagcttcagcgcaggatttggataataaactgtgttatctgcaagactgccacttcgttatatattattcttgtgacccagctccaacgattgcggcaattgttttgttggtggttgactggctgtgtgctattcaaagcttatctgtctcgaggaaacagaaaatatttgccactgtgctccagttcgcccaggtgtgcagacgtgtgtgttgcgcttgacttccaaagtttcaagctcgataatgcctcctagttgaacctgtcaccatctgcaaaaataagagctatacctgttgccttgccagtcgccggcacaccggtatccggaccccgagaagttgctcatcgctgcaggtaggctgatgcagtgaaacggaagctgggaaaatgggcatcctttcgtgatagcagcaaatcaagttgggccaatgcaaacctgccgtcgccgtcatcgatcagcagttgggagcaccggctgctgacgagacccaagcctggagcaatctgcacctgcatctcaaagtacttgtagcatgcctgaaaatatatgcagggaattcgcaatttgggttaataagatgaacaccagttcatcagcagagtgaatgcaaccagattctctacaggtgctgaaaagaaataaataaaaaaaaaaccctccgtcccaaaaaaagaccaatcctacctacgaacctggagacatgtgtatccaggtttgtagctaggaattcgttttttttttggggggggggagggggg

SEQ ID NO: 28271 - DNA, 2534 bp, Oryza sativa
cagtgtatgatggatgtgactcatctacttgccacaagtgaaacagcatataaacacctagaagttctagaacccattgagttctatggttgtttatagctagacaagtcatggcaatacagaagattcactccttccctgaaagcaacctaccacactaaaaccaactcaagactgtttcaccaaaagggcacaactacctaatatgagcacttcctcaccacacatctcaaaacagacagaataagatacaatgggcaaaccagcaaaacaagaccaaaggtcaaaggatagcactctcaagaaaaaatggtgcccaagactgagtaaaagaatcttagctttagcgaaatatttagaaaagaattaccaaataaacatcctttcctcagatcctttgtgaggaaaaagacatttcctttcctcacatcctttgtgctagtttccgtatcagttctttaattcagatcttcgtcgaaacagggcttaatgcttacaggatgtcttaaatattaagttgctagtatggcttaaatattaagttgctagtatgtttcccaaagagcaaattcacagtatccaaacatgtccgcgtacgatcttaaggatgtcttttactttctagtagaagattgtggtccacatttgatctccaaccccagtggtttcccaataatgcagtttagcacattcacaggccttaaggcacacgaaaaatccaagtggcataaaatacaactagctccagtaagcaatgcatctgtggctagtacaccaatgatttctgcaagtaattgtaattcagaatttggttaaatcaataagttatgaactttttacaatgcaaagcaccgtgttgtcctatgcgaactgcaatgtcacacatgctattttaagcaaagtacatgagtgttaactaactgtccctagtcataatcagtagacatgcttaagaactattcaccatgtgcaagtagcgaaagacaagatatgtaaaaaaaaaaaggatggtgcaaacataagtatatgcagacaagataaagtgcaaagttgagctcatcacttatggaaattttactgaattgagaataaataggtgatgaaactgagacaaggtttactatttacctgctgttttttaaggaaagttattcaatgctcttatttagttctgttaatcaaacatatgtacaattataagtatctgcccaagagattagaagttaggaaccgaagcatatgaaaaataacagatttaaaagcaacttctgcaagcacacaagtgattcatcacaagagtttcaaggctcgacagatcctcaacagtcttgaaaaactaatggaatgcaattatcacaaaagttgatgcaaatacgacataatcaataaggataaaaaggcttgacttcaataacgtaactgcttgtacagataggcaaatcaaggtgtacacagcgaaagcgaaacaccaccacatgacgagtttccacatatcaatggataagtaaacatatggaaagtaatgaaaatgatccgtcaccagattcaacctgctagaagaagaaccttttatgtgcaaaaatgctttcagaaattctcaggagacattcatcaaccccttcaaaagcttcgaacaaattcttgcaataagagctcttgtaaactgacatttcgtttaatttacctaatgtaaagaaaatgacactggggatggggggacaatgtgacacctaaactgaataacaactccacaagttcagaatatgcattgtgacatcagtcattgtggtaaaattaaatcacgcacacagatatagcacctggagttgcatcatataaaatagcagaaacatcatatggaatctttacacaataaaaagttaaaatcgcaatctaatgtgtccttgaagcttgactcatctggcaaatgataaaatcaaaagttatacaacttttatttgactcatcatttcatcaatcaccagttatcagtacatgagcatgggcattcgactgataaaacggctgatgatacaacactacagtacagattacccaaagcacgacaagtacatcagtttttggcatatcaacactacggattatacagagaggaagagaaatagacctcggcgcgtcgccctcaaatggtgtagtccgaccactgtcgaatgaaggatgtgtgatccatggattccccgggcatgtcctcatccttctcaacctcaccgttcttcctgccaatcaacctggctggattccccaccgccgtgttcctcgccggcacatctatcagcaccactgacccggcaccaatcttggccccggctccaatcttgacgttgccaagaatcgtcgccccggcgccaatcagaacaccatccccaatcttggggtgccggtcaccgacagccttgcctgtgccacccagtgtaacgtggtggaggatggagacgttgtcgccgacgacggcggtctcgccgatgacgacgccggtggcgtggtcgaggaggatgcccttgccgacgacggcc

SEQ ID NO: 28272 - DNA, 11230 bp, Oryza sativa
ttttagggcggagctatctaattagcattcgcgcaaatttttacatagaccctgtggcataactccaagtcagatatatacgtatattttaaaatttatataatactccccccgttttacaatttaagactttctagcattgcccacattcatatatatgctaatatatatatatatatatatatatatatatatatatatatatatatatatatatatatatatattatagtatctatataaatgtgtgcaatgctagaaagtcttacattgtaaaacggagggagtaattataatgatttagaattttaatattttatttgaaatgagaaaaataatttattaaaatgttatcaacgaaattaaaaatctgtttatataactagaaatacctaactctggtccgaattggagctaaacaggactttagttgagcggttgagcctgggctgtaaatattttattttattttaatttccttttgccgttgatgtaggagtaggaaaaaaaaatggactaccttacatcagttgatgctctaggagttgacacgtgggattccaactgctgcaatctttaggcaagtgttgatgagatagtgtggccatgaacctggactgaatctagggaacatacaagtgatgcaatctctggaacatggttatccatcatccatcccctagaatttgaaggtcaactgttttgttttagtatcatagtaagctattgtggatgttgcatatcattgttttaaataatgttgatcttttctggattgaagaacatggataggttcaatgaacatttgattgcgctttatgacaaaatacgaccataggtttaatttgtttggaggtagcgaagccatctacgtgttacttgatgaaggaaaactacttaccagcaaggataccagcatgtctatcctaacaatgccattaaaagtcatcaacagagaagtttgcattaacggttacttgtaatttataaggtcttgaaggctatttttttttcacaatttaataaattttgcatgttgtaggacactgtcacttattttgcacgctactatctattttgtatctagtacttctctgtaaaaaaaaaggtaaactctagctacgaatctgaatacgtgaattatgctttttcttttagacggaggggtatcttatagctttattgtcaagaaattgatttaaatgtaataacaactagagtatattcgaagagtctctatgttggtttgcccggctagaaactgaaaatcaagtattaatttgatgggggaaaaatcctacacttctcatttggatgacttatcatttggatgacttatgagttctgtttataaccattgcaactaaagaaacatcataaatacttctatagttcaatgagaagtatgactaggatttgagtttaaactaaaaattaaaatacatgttcaatagaaagagctatgaaaaccatattctttagagctatttcctctgtttcacaatgtaagtcattctagtatttcgcatatttatattgatattaatgaatctagacatatatatctatctaaattcattaacattaatatgaatgttggaaatgctagaataacttaaattgtgaaacggatgaagtacatgacaagtacaactatgctagtatcttttaagtgaaaatgctttgcatatgaccattactatcgtatatatgaccacggcgaaggcgtattggacgtccgcgagttgacctttttgggctgtgatccgaatctaaatctcattgggtcttccaaaatcctagttacaaccgtggctaattaccatgtccggccgtgcgcgtccgtggaattaacaacaaacagattccgtgtgtgcatggaatcatcgtcttacatgagattttaatgggtcttcttcagtgctaattttcaattcttttcttagtttcttctattcatcagtacattgtataagtctgttaagacaaattgtttgtatattacagctgtgagagtataagtgggttttcacatgctattggaatgcttatggtcctcaattaatcatgcatagcttaattgttgacataagcacaatcgataattgataagctagttatatgaactgatattggtggttatactacataaaagagtaaaaaaaaaagaatttgctttacctagttatgtgaattgatcttgataacatctgctacactgtaaataatactagaatgttgagatcaagttgacagtcagtggattcagaatttcagattgacctaaagcttcggcagaaacagcatgtagttgtggccatgttgacatgatatggtgggtttggacttgtagatgggcatatgtacgtactcatagaggcaccatacctttgtcactgacaggtagactcagggttcatcggacccacatgttagtgacaaagacacatatctttaaaggtagaggagcctgatccggagtgttacgggcttatggcgcaggtccgatctagagcatcacttcacaccgtcgcccttcaccgtcggatcatttcgacagacgtatagcaggtctcatttttccataactgtaattgcactggaaattcgtatagtggcactggaaaaatactaatcataaaaatttttcaaataagacgaatggttaaacgttgaatataaatagtgcaaaactgtacttattttgggacggagggagtacttattctttttcatgctgtactgtaacaggagccgttcctacggctacgagcgaatgcagcgccagacgcagacggtccatctgtcccacactcactgtcgtccgggccccactccccccccgctccgcgccaacgccggtggggcccagaccaccgccagatagccccctccgttcgtttggccctccgccttcccggattgggattatgcagtcgactgcaccgtgtgccattgtcactgacatgtgggccgcgcgcggcgcacgagacacacgccgccctcctccttccagttcactccactccgctactttttccaaccgtcgccccacgcgaaccccgacgccgcgccccccttccccagcctccgcatccgattcccatggcgtgcttggcggcgggcgccgaggcggcccctctcctcttccggcggcggctagcgccgtccccagtcgccgcgcgccgccgccttctcgtgtcgtgccgagctcgccgccgcggtctcaggttggtagcccagagcgcaggatcgcgtggttgcggcgtggtcggtgcacccggttgtgattactggtgtgttgcgtggtctcgttcgttcgttctcagtagtctgctcctgcggcgaaccgggggaatggccttttggggtttgggttgggttgggttgggttgggtgacaggggatcgaggaattcaattcccttggtggtgcgtgcttgtatgcatagaatgcttcgatcgtgaccaagtggggatcatcaacctctgaatgctgctctcctaatattgtttggcttaggttctgaaatgcttcttaatcaccggaatgttccacctatctgagaaaatatcctagcttatgttgtgtaatcatgatcattgatcaaatcatcagaaatcgatactgtcggaacgctttatatttgtacatttttgttgttttgattcatagaatatgtcaagaaattctgttaagcttagcttcatttttgcgggttctaggactgctgcagaacttcctcggaagagtacaagtaatgataaacaccataatagggtgaatatgcagagagatgaagcatctgtttccagtgataaagaacggcaagaggtaccacagcacattcattagcaatttcatatgttttccgattttgtgagattgatataatatttgggccaatttcacgatactatgtatgtggtgtagattgaagtccccaaacactcaatatcccccttttaatacaattttctgtgtttttatattatttttacataagaaactgaagtgaaacacattgtcactaaactagctaaacaatttaatatccaaaggcaatacctgatattggcaggctatcttcacagaaaaatgccgggtcggccaaaggttggccgaccaatttcttaagattggggagaaaaacaaaggaatgttacagcgacattacaatgtcgcgctagtccgggagagatcccagacacagcgtgaacaagcgaaagagaaagagacaccatggatgcagtagttatcatgaagttactgtttgcgtcaatttcgtctttatttttatgtatgctcctacttgttcactgttgcttcttttaatattttgggctttgtgtgtttcaacagaaatatggagatgaaaatggtatatcaaaccttcaattggaagatttgatacaaatgatacaaaacactgagaagagtaaggggctcctttcttttggataaatgatatttataatgttgtaggcatgcacataataatcattatcttcaaacgtatttgtttagatataatgcttctgaatcaagctcgtcttcaagcattggaacatgttgaaacagttcttaaagaaaaagaagacttacagaggaagttgaaaattttggagacgagattgtcagaaacagatgcacggcttaagctttcagctgaagggcagttcggtactgagattaatgactctctaccagtactggaattagatgatataaaggaagagaatatgctactgaaggatgacatacaatttctgaaaacaatgcttattgaggttgctgagacagagaacagtatattcacattagagaaggagcgtgctcttttagatgcttcgcttagggagctggagtctagatttatagatgcccaagcagatatgttgaagtctgatcctaggcagtatgatgcatggtgggagaaagtagaaaatttgggggacttgcttgagactgcaacaaacaaagtagagaatgctgctatggttctgggacgcaatcatgatttggaagataaggtcgacaaactagaggcatcgttggctgaagcaaatatatcaaagttctcttgttattttgttgatcttttgcaggaaaagataaaatcagtagaaagagcgcttccaagtatgtaatcatgaaatgcattctcaaattgaactctatgagaattcaatagcggaatttcacgatattcttagcaagctagtggaggaaactgagaaacgatcactagagcattcagcaagtagcatgccttcagaattgtggagtaggatatctcttctgattgatggttggttgctcgagaagagaatatcctacaatgatgcaaatacattacgggaaatggtcaggaaaagggatagttgtcttcgggaagcatacttgtcatgcagaggtatgaaagatagggaaattgtggacaattttctaaagatcacattgccagggactaggtacactttctcctttgctagtaggagtaaagcctgtttataggataatactctgtctttatttagttttacaatttattgattaatgtagttctggcttgcacatcatccacatagcagcagagatggctcctgttgcaaaggtgatccttggtactcccttcaacctttcatcacgtgcatttcatttcattactactcctgacacaaatacatttctagttagtatattttgatatggttctgctgattagatgtgaaactactgatgtgatagttgactaagggtctaattggtagcctgggctgcggctgtgctgcagtcagctgctacagtcccttgcatgcagcatggcccactgctgctgctgaggctgcagctgtagttttggaatttgatttgttgttaatgctgattaattgaaatcctatcagttactctttaagtttgcttatatgcatgattctttaggttggtggtttggcggatgtgatatctggtcttggcaaggcacttcagaaaaagggccacctagtagagattattcttccaaaatatgactgcatgcagaatgaccaagttaataaccttaaggtatatagtttgtttctcaccgaagtttttggtcgcttcttttgtttgtttaagattttatttttctatcatgcaggttttagatgttgttgtacaatcctactttgaaggaaatttgttcaacaacaaaatatggactgggactgttgaaggtttgaagcatccctcagttcgacctttctgtaaaattaagtcataacattgaatcttcatcgacctgactaaatttagcatatgcaggccttccagtctattttatcgagccacaacatccagcaaaattcttttggagggcacaatactatggagaacacgatgactttaaacgttttgcatacttcagccgtgcagcactggaattactttaccaatcgcagaagaaaattgacatcatccattgccatgactggcagactgcatttgtggtacgtgtcaaatgcacttggctgtattggctaattgaccactgaaaatggatcatgctcttcttggttgatttgccaagttaaagatattaatttgctcatcttttactttgaaattccaggcacctctttattgggaagcatatgcaaatctgggcttcaactcagctagaatttgcttcacctgccataattttgaatatcaaggagctgctcctgctcaagatttagcatgctgtggccttgatgttcagcaacttgatagggaagacaggatgcgggacaattcacatggcagaataaatgttgtcaaggtactgaccattgaaaccgtgcaatagattgaattcaaatttcacctgtatgataccaacaaggttgttttgggttcattgttttcagggtgcaattgtgtattccaacattgtgacaactgtatcaccaacatatgcactagaggtgcgatcagaggtaattttcttgtaactttagttgtgtgtatttgattaactttagtttcagtagaccttctaatggcgagattagtgtttctcaaaatttatataccagttttttttttttgtgtgtgtgcatgtgttttatgtgtgtgtgtgtgtggtggggtgggggtgggggggggggtgagagaagggaagaagaccataagttgatgcacaattcatgggaaactaccacactaccttgttgttcattatgcagtttatttattccagtggcattcctacatgaactgaaataagctgctgcatcataacatagggagttgtttaagagcttgactgcttgataaatccctttatatgtaatgctatacatatcactacatcagcatatccatagaatgcctcaactatcctggactcctggtgtttctagtttccattattcaatatgtcttataccctatattgttacaagtgttctaaaagcagtacactaggcaccaggtagctgccacgattagcatttaatggtgcattaggcgtctgcccagctttgggggctccagtgttgctatattaatgttctattgtctttcttttatgtcatatgctaattgcttggaagccccttgttaagttgatcctaggcgcacctaggcactaggcagcgtcttgccgaccatctaacgtctagtgccttctctgattagaagttcattgtagtagtttcagtttgtaagcgaagtctgttggcattctgttattgacaagctcttctggtgctcagggtggacgtggactacaagattcactcaaattacattccaggaaatttgttgggatacttaatggaatcgacacagacacatggaatccttcaacagatagacatctcaaggttcaatataatgctaatgatctccagggtaaggcagcaaacaaagcagctctcagaaagcagctaaacttatcttctacaaatgcttctcaaccactggtacgatttttaatcccctcatctactgctaaactggatacagaaattatgaccatgtacctgtacttgaattaagaattttccctcttgtcagctttgcagtttattttagctatctggttttattatattcccttttttttttcaagtatggtttacctatgtatattgataaaacagaagtgaaatatttacaaggtttattgctttctttcatttgttatagaagtttcgctttcaattcaagactaactacacactaaagtttccttgagcaggttgggtgtattacaaggctagttcctcaaaagggtgtacatctcatcaggcatgcaatatacaaaacagctgagctaggaggacagtttgttcttctgggctcaagtccagtaccacacattcaagtacattttcttctgaactatagtagggtcagctaacatgatcatatttgaatgtagagaaaaggaaataaaaaaaaaaacttaactagctcgtgaacaatctatatatctaaagctggcgggtctccccgccagctgattggtggattttgccaccatcaatctgttgacacgtgtccatttcacattggcgcgcagtaaacggatcctactaggcttcgctggtcttgcgcatcagcccacgccgattggcttgccccgcctggacgctctattgatttgctgacagatgggccatccttaaaatatcctaattattaatcctctgaaaaaacaactgagatgggccatccttaagagctacggcagcacggttagaagtcattgggaaaaatatatgcatgtaaaaacatgcatgtgaagatatatacgtgcaccaatttgaaataggaaattttaatatatatgtgtatatataagccctattttattattcgtacatatgacaaaattatactaccgtcacataataaaggatgacaatatcacaaaaataattcttattcttacgtaaaaataacaaatgtataaaaaacaatccaaaataattttaatgtaaaactgcatacctctaatcagtaaaaagaacaaagaccaaaaaatacaaactatgaaaaaagacacaaaatcaatctaaaaattatgttctaaaattttaaatttttaacaaataggctatgagagtgcttaccagtttacaacttcctttaatactattagtccaaagtatttcctccagttccataattcttgatgttttgaaaaaaaaatgagatcaaataattaatttgatgacactaaaacttggtgtggtgtacagattggttaaaatactttagtaaaattaaatattgacctatttattatttatattattatagaaattaatagtaaattatagatatatattttgaggtccatttaattgtccaggggtacagagtccccgtcaaatgtagcatttttaatgaatcttatataaaataaataaatttgggtaaaatctataaagagaaataggctaatcagccggcgtgccaaaaggcacgcctattttctagtctgtttatatggatggagcttgttttttatttgaaaaatagttgctcttgctccttttgttgaacacctctttacttattgttgctatagtgaacatgtttggtgctaatttactttgcagagagagtttgagggtattgcagaccattttcagaacaataacaatatccgactgcttttgaagtatgatgattctttatcccattggatttatgcagcatctgacatgttcattgttccatccatgtttgagccatgtggcctcacacaggtgtgcctttacatacttatattacgtagtttgtattaaatgtaaatactgaaacgtgccatttagcattatccgtaatctgtttctttatttactatgcactctatgattgtcttgataaattatattcctagatataaatatgcaatgcaagcaatttctctgatcgtacttccatcttttttttcctatttggtagaggatttattcttgccttattttttttgaggtgtatgatatatgatccaatacctcataatatgatcattgaaaacttttgaacacaattcagaagtacagagtgagaaaaataaaatgtgccaagatgtttttccaattagtcaatgaaattctgccctttacccttgaaacccacagtagaatatgttctcagatttgaagaatttcatcaacacaaaaataaacatgtttccagagctttccaaaattcatgagcacaagcttgcagttctgcaaagctgttcttggttcattcctgttgagcaattctgacatgttctgtatccacagatgattgccatgagatatggttctgtgccgattgttcggaaaaccggtggattgaatgacaggtaaatagttattaattaaccaactatctcccaatattattctccttaataatgtaaaatgcccccactcacctgctttgcagtgtcttcgatttcgacgacgaaacgatacctaaggagctgcggaatggctttacgtttgtgcatcctgatgaaaaggtggatgtcgtttcagttcatctctcctcttttggtggacacaactcatgtgggtgttccttttttgacaggctctaagtggtgcaatggagagagcgttcaactactacaatagaaagcctgaggtctggaaacagctggtgcagaaggacatgaggatagatttcagctgggcctcttcagcttcccagtacgaagatatctatcaaagagcagtggctcgagcgagggcagcagcatgaactctggcggtttagtgagacctgagcctttctctgacgcggcgcttgatgccacaggcacagattctgccttctgaagaagccgcaccatgcacctctctgatgtgcgaacatggcttcatctgcagcttcgattcttggaatggaacccaagatatttaaagacatgatccgtcagactcatgcaggaagccgagatgttccatagtgcagttatggaatggtcgaagaactaaaatcttggcacccattgtcgtgtcccagtgacagtgtggactatacagttatataacttatagtacgtgattgctcagtcgtgaaatttcactagcctcgatatatttatcatgcgctacggtgaaatgataagttttgttctttgtatcacttgcagtgtgctttgttatttgtgcaaagtcgtgtgtgttgtctatagaatattctttcgtcaaaagcaaagagatgagagacagaccctgttttt

SEQ ID NO: 28273 - DNA, 37135 bp, Oryza sativa
  unsure (1)..(37135): unsure at all n locations
ccgactgcatgatcgtcgccggcacgctcaccaacaagatggcccccgcgctccgcaagtccgtacacttgcgccctttcccctgcgttcttctttacatataaccatcaaatttgtgatttatttcgtatcgtctctgagagaagagtagcaattttctgttaggatgctctattttgcactttgaattggttggtgatgctgcttatatagacttcggtagaggagggcgattggattggggattttttttttgtcatgtcaagttgcatacgatgtttaatacttcattgtgcagattcttttttgccgggtcggccgaacgaggccgaccaatttcattaagaatgattctgtgcagatcaatttttttgcagattcttttttttatccttataggcgtcaatcccttgcgtgttcctcataggagtagataaatttgcgcttagtctgagcttcccatgtgttcacagcttcggttttgtatggcatatgccgttgaactatttttcctcttagattatatagagaattgtatactggtttagcatgcgtttgtaaatcagaggcacgtgcattttttagtgtcaggaatagaacagtgtcgtgcttgttcaaatatcataagggttcattgaatagaataatggttttccatatcaaaacatgagccatgtgtcttgtgaacatggttgatgtaagtacaactgctaaatatgcattcatatccacttctgttagttgaaagtagttaagttttgtacttaaagagtgatttcccttcattgtttcttttatttgtagctatgtagtaccaatattagaattggtactgtttctaatgcattattaggacttaggatatggagagtgcaattcgtttaaatacattttgaataaaattcataggtacttcgatgagtttaaacacctcatgaataaaattcataggtacacagtacaataatattttgtgtgctttatgtgttacattccaactttctatgctgaaataaaaacatgtccatttgcttactcagagaatcccatgaaagcaacaaatctaaatgtatgcatcttgtagaagaaagattgctggttccttagtggagtatggtcacatactttaattaattgtagtacttcgtccaaaaaaaacccttcaattgtagtacctttgcaaaatgtatgtatatggttatcctagggagtatagctatttttcttataggaatttggtttaacctctgcaagtgtgcctatatggttaccctacggagtaaacctattttcttatgagaatttggttctgattgccgacatgtttattgctttttgaaagaacagtgttttttgtgttgatgatctcatggttctcaaatctcaatgtgcgtgtattatgggaatcataaggaataaggaccaacagtaaaaaacataatattggttggagacctttaaaacatgcgtacatgtaatttttatgtgaactactaactgacagacacctgtgtaaacttggtgaccttctccttagtggttgtcttttattcactaccagctcaataccgatagtcgcacagctatagtttgcaatgttgctgacatttgtagctgtctgttgttctctgcagggtttacgatcagatgccagaacctcgatgggttatttcaatgggcagctgtgccaacggtggtggatactaccactactcctactccgttgtgcgcggatgcgacaggattgttcccgtggacatctacgtccctggatgccctccaactgctgaagctctactgtatggcgtcctgcagttgcagaagaagatcaacaggcgcagggatttccttcactggtggaacaagtgaaccagcacttctctgctttcctatctgctacgaatacgatcctgtcaaaatgttatcgagcttctgtgttaaataaaggaaagcgtgtgctttccgatcatcaaactctctgtagtagatgcagtgatagtgagctcctggctaccttgatcaccgttcatggacaaaaaaacaattggtgatgctgttgcggtgttgctgctttaatactatgtataatattttgtaatttgtgttgtcttctactagtgatgtaacattgggtatgacgctcaatggcgttgtgatgctgtatactttaccaacttgtgtaaatagaagtgatgataatataaaaaaaattaatagaagtgatgataaattgttaatggctgctatatgttctgatttctttactcatcagtctatataacttgtatattggagagttcagaagttaagtcatgcgtactttttgttttttttctttttatcccaatttctttctttttaactacagtaaatataaagatagaatgtacaattgctgaccttgcacgatgacgtgatatgtccacatgacgtttttatggcgtttcttttggaccgaaggactatgttaaaccaattgataaatcttgagtatttgtttggataatttaaaacatcaaagactaaattgaccatggggcaaaattccaaagcctatatcactatatgggctattcacccgcagataaagtaaaaactatccgggtaacaaacgaatagtagatagtaggaaacacctgaataaaaatactcctaaatcaaatcgtgatttacccaaactaaaccggctttgaccccttccccaagcctaaaagccccaacccttttatacctccccacaagagaggcaaaatccgctcgctctcagactcgcgacgccgccttcttcttcgatcccctctccctccgatctccccctcccccgcaggtaaatcagagaaacccccactagatttcgaatccaaatcgaggcctcttcctcacgatctcaccgcatttgctgttgcgattcccacctcggggttttgtggttcggtttggagcagatctaatggcggcgctggcgtcgaagctggcacagatgcaggcgaaggcgtgcgacgcggcgaggttcgcggcgaagcacgggtgcgcgtaccacagggcgctcatggagaagaaccagaagtacgtcgccgacccgcccaccatcgagaggtgccaggagctctccaagcagctcttctacacccgcctcgccaggtcggtccaccctcacgatctccctccaccttctccacgatctcttagtcctccacatctgaattatctctattgtttagattgcgcactccattagaacacgatctcgatcacttccacattatggaaggccgaatatgggattctaatcatctatggcgaaacctaattatgttgcctaattagatagaccagcaattttggctgattgttttaattgaataaattagcagcacatcatgtaaagtgacaatgcaggaaattggtaccattgaaagtctggaaattgcagtgttgaaaagtgtgttatttttggtgatgttctcctgctatatcggaagttagaataatgatcagcgatgtctattccatccatcctaataatggaatctatgcttcccgtctcttagaagctgagcaatgcataatgcataatggtcatgttgtgaacatagtccatagtgatgcattgcaaccgtgttttgaggatgttaagtatttttgctgaacaagttgtcacgttgcatgcaattagccatggaaaacaagttcctcctaaattctatgtaaatgaagacgcaagagatgggtagtgggtttatatggtaatgtgggttgaaagtcactgatcttggccttagcaagattgatctgatgagaagcaagctttatttgagttttttttaactgtgagaaattactttgttttgagccaatgcttttctcttggacagagtcccagggatgtaattgttcctgatcagccattttgtcttcatttgtcttttgagaagaccgatactagttatttgtttgagctgcattttgcttgtacttcatagagatagagtagtagtttgtctatttcaccattattattcatccgtgttgtgctaaaagtgcgccttcagtgcacattcctctggttgtctttgccagtgctattatgaattataatatacatctgatatggtgccataatttgatgattcattacataggtgacagaagatacttgatcattcatttgataccataatttcactcacattataaggtgcatttcgtatcttcaatctctgtgtctttactgactagtgacacatttcttgcagccttcctggtcgctatgaggcattctggaaggaagcggatcaagtgaagaacttgtggagaaacagaaaggatctgaacgttgagcatgctggcgttgctgcactttttggcattgagttgtacgcgtggttctgcgttggtgagatcgttggtagaggatttactttcactggctaccatgtctgagtgctaagcaaccacattagtcgccgactcgccgtttctcattgaagactctgctagagtgttaggatatcagttttttgagatgggatgactgattgattcagagttttgttttccgaaatttctcgatgctggtgtaacagacggctcagttaaaccaacatgacgaagttcaataattcagtgaatcgtagttgaagtatgcagtaatttttctccgatattttattgaatattgatgccattgattgttttattttgctgcgtgtttgatgccagttctcattgtcgcaagcatatagtttctctgtctctctgtatgtggacatgcacttttctccttatctttcagttcagtgaccaagtctgcttttagcaaatttcagtttagcctctgttcttgataattgtcgattaacattagcaccaagcttattggtgtgcttatacctatatacacattacattttgatggcttatctcatacttatttcttctgagttttgagttttgactgacaaggatttgcattgcaaactcggttagttgatctctccctgttttatgtaggttcttatccattaccgtgaatctgtgatgtaaatgtatgtaactgcattacacttgtccatttctcagttaaagtttgtatcattatgtctcctcttcttagtttcaaggtctaatatagtaatcaaatccagctagattctgaacgaacgactgatggtaaattttctatgaagaccatttgtaaaaccttatccaacgtagacagcttgatcaaacaccggccgcccagatcaaggatagatgtgcgggtaaatttttcaaaaaagagccttgctaaacgtaactcttcaatgtgggaccctatttggatcgctataattgacagcgaccctaccttgggccaccggacatcgcttgatcgaacaaaaacggcccagattaaaactaagttgggtccacctttcagacttatcgaggagtaaggcccacatcggaccatcacgcggtaccgatattgggctgcatttatatgggcctaaatagtagctgccatgtggacttttatgatgggcctcatttatatgggccaacgaaaattatactccgcatttgcggtataatctagtataatttcgaaggttctgaagcgaataataacgcgcaggcgaaaaatcggcagcgaagttagctaatcggcgaacagatcgccgtccggtgactgctccggcgaccggggccggcggcggcgggtggtctcatgtactccgccgctcgccgacttctcctcgccgcccgcaccggtgccggcgccggcgccgctttgcggttgtccgcggcggtgtttgcgctccggtcctactcctccacgggccagtcctcgtcgccgcgtcggttcccgacgcctaaggagatccgcaggggcctggacgagttcgtcgtcggccaggacaaggccaagaaggttaacgaaacctccctcctcgttggtgtggtgtgtactgtgtagctgattgggggtgtgaccagtgatgacgctatgagctcgagtttgagcatgagttactttgctttactacatatatgatctatctgctagcaatttacaattgtgcaagttcgattgaaattatggaactatgtacaaatttcgcggctaggtttaacaagggtgctttgcttatgcaggtgctctgtgttgccgtgcacaatcactacaagaggatatacagtgaatcttcaaattggttagattctggaaatttcatttggtggttcagttatgcatcacgattttgacttcaatttcatctgtggtgatatagttctatgaagagctcggcatgtggcgatgttagtatgagtggtgatgatgacattgagcttgaaaaaagtaacatccttctgattgggccgacagggtcaggtgacgcgaacacatacgtggttcatctgtactgtgaaaatgctgtttgcttatctcgttcttttgctatgaacctatggcaggtaaaacactgttagcaaaaactttagctcgatttgccgatgttccatttgtgattgctgatgcaactgcaattacacaggtaggaaaggctggttcaagcattctgaaaatttcttctatgtgtgcttactccagcgtgtcatggctatcgtggcaaaaaaagctgattgtgtatgctattttcttctttctgatgccaaaacaacttccttttcaggctgggtattcaggtgaagatgtggaatctataatctgcaatcttctggcggtatgtaacagcctatcactctctttctggccatttatgtactctttcgtgctatctagcgtctgtaatattggagctgaacactgaattacattattgacataagctaccatgctactaacagttctcctgcaaattgttaataaccagttcctttttgtgtataatgaatcttggatcacctatcatctgcaagaaaatgttttggtgccaatagctacgttgggcataatctgaacaggatcaagcttatatattaaactattaaccattaaccataaaccatatattgcttttctgacatgttcttccttttaggctgctaagttcaatgtggaagccacagagcgcgggattgtttacatcgacgaagttgataaactcataaagaaggtcattgaacaaattagttttgaactacttccgtgcctagcgaatgtttctgcacttgcaataattggatacattcccacatccaggttgaatgcaatgaggacaggagggatgtctctggagagggtgtccagcatgctttgttaaaaatatttgaaggaacagtaagtgcatatattaatcttctgctctgtaaagtaaatttatctttgtatttttcatacttggtaattacactagcccttctgaagagagtgagatctgattaacaacacatgtaagtatatgtcaattaatgcatgtgtgactgatgctgaccataatttttttttctccctgaatgtacattcagtcatgttctgtctctgaaataagacccatttgttgctatcattcttaggtcatcaatgtaccaagaaaaagaaatcaagatagtatatccgatggttatgtcgaggtattgattctgaatcttttgattaagttgttaagtcagttaaattgttttgttaatagctaccttattgtttatcagcatgatagttttgctacagaacgaagttatgggttcttgatttcaaatgtaatttatcattggtgttgtcgtactctgcaaattgcatttgtggttcaaagtcgaagtaattactaagttccatctgtctctaaatataggttgttgtgggatttatataggtaaccttttactttgatcattgctgaattggaaatatatagaataactgcctgtttcttccctatcttaatgaaattggtcaggccgggcaaaaaaagaataactgcctggaaataataaaataggatttttttttcttgcaagatactttttatagttccagtatattatgatcaagaacactcaaagtaggttgttagaatttaaaaagacttattttgtgttgcaggttaataccaagaatatactcttcatctgtggaggttccttctctggcttggaaaagatagtatcagaaaggttgtgcacttacaaataatacaaacttctataattctctgaattgtccatctttatccagacttatatattgccttaaagtacttgtgctattgaagacaccgaaactgtcatatggggtttggacttccaacatctggtgatctgcgaaactgtggttggacaaatgctatcggggaatcatgctgtgttgaagctgtaagatcagttgctgacatttgtcaaacacattattttaattccacatagagataattttcaacgatttcctacttagattgaaagtgatgacctgattgcatacggcctcataccagaatttattgggaggttgccaataacagttggcttgaatgatctcagtgaagctcaattggttcaggtagcaatggttctataaatttgtaattttatgcaatttatttttgaccacatattcctaaatgaatctactttatctcttcaggttctcatggagccaaaaaatgcaataggaaaacaatacaagaagttgtttaaaatgaatgatgtgagtctggttctgttgtattgattgttttgattcaactgcaagttatgattaaaaacaccgtcttctgtggtatgttaacaacaaactattttctcattttacccatgtaaggtcaagctgcattttactgaaaatgctttgcggttaatagcaaagaaagcagcttcacgagaaacaggggctcgagaactgagatctataatggaagatattttgacagaagcaatgtttgaggtgacttgcacatgccgtaacttctatcaacatcgaccagcactaattttttcgttctatttgcagattcctgatgcaagagagggaaaagagaagataattgctgttcttgttgatgaagagtctgtagggtcagtgcattctcgaggatgtggagccaagattttccgggatgatggagccttagaactatatgtttaccagaataatattagactgccagggttaatccctgggaaccctaaacgtactcgcattgtcagcttctgccttttggtcgctttgtcagcaactaagctgtgggtttaccatacatttcactgcttctcctcgatatacgaatgggttgtgtcgatactatgtaaagccaacatttttacacaataaagcatagcattaagctttattttcgtcacggtgtcattgttgtctttttgataaatgggatgcaacaaatttgagcctggaaatatctggggctcacggttcacctataatattttgatatttttcacaactgccaaggttggtctccgtaatacagaggagaaagaattggtggcaaattgaaaaggaaagttggcaaaatatttcacactgcacaaatagaaaagggcctttaaaccgtaatgcatcaaaattttgtggccgtcattttattcgtatgcaataattgcagttacaaaagactcaaccagagttactgccgtttactcatttgacaccaaatgttgaaatcttcaggcttctgagaatttcaatttactgatcgatgctcttagaatcgatataaaatgacggggttatcagatccacaggcagactaagacatgatttcctgtggtcatcaaatgttagtgtccatctccttgtttagtttcacctcctgaagaagtgccttgaagcgcaccatctccagctgatgtgattccaaacctactctgaaacacaccatccagtgagtttgcatcaggtgcaggttctcctgttacattttcagtcttccttttatggccaaggatggcttcaatggcagcggcactagctctagctgcagcctcgtcctttgcagcagcctctgccctcctcttctccctttcttcccttgcaagagcttctgcccttgccttctcttcttctgcccgagccgctgcctcagcttttttctcctccacatcctcgtatagtttggttatgtcaccttccctccctgcttcacggagtgcgccttccaataggtccctcatttcatcgctgaacaccaccttctcatccaaaagaatatcctttgcgatgtcgattgatttatccaaactagcttcaccaatgtacgcctttagcagtgcctcatagcttgcaatgcttgggctaatttctttccccctcatcttatcgagatacccatgggcattgtccagcataccaaaaccaattaggccatcaacaatcttatgataggcagttgcgtcgggcttcaaccccaactcagccattccgtcaaagtaattaatgccttcatcgatgcgatcaaccctaaagcacccttgcatcagtagcacatatgtttcctcgtctgccttaagaccactttctcccatctccttgtatagcaactcggcctcacttaccaacccttgaagactgagatgccggatcaaattattatatgctgcaacatcagcaacaacttcccactcccccatcctcctgaaccaagaaattgcatcaccgaacctaccagcagcgcagtaagcatccacaatcacactgaagcttctcacatcaacagcaatctttagtggaggatcatgctcccgaagcattctttcaaacagctcgatcgcatcatccaaccttctgttccgcccaaacgcatcaaccacaccattataactctcagctccaaacctcacctccgactctgcaccgagaacctctttgtaacactccattgccttctcctccattcccataaggaagtaagccttcatgaggctcccatacacaatgccatcaagaatcggctcgcggccaatcttttccttcaattcttcgtacaattccacggctttggcgccatcaccggcttccacgaacccagccatgagaaggttgtagacctgtggatcgggcccgacgaacccggaggccagcatctcatccttgagctcgagggcatcagtgaggcggccatggtcgacgacgagggacttgacgacaacgcgatacgcggtcggggacgggggcacgggggatccagggcgcgagatgagncgnaggtggtggagcgcggcgtcgggnagncggcgcgcggcgagggccgagaggtagagcgcgtaggtgccgccggtgggcgggacgccggcctggagggcgaaccggtggagcgcgaagaagtcgtcaagccggcgcgcgcggaggagcgcggcgaggacggcggcgcaggtgaagaaggaagggcggcagttggagtggagcgcgtggcgggtaaggagcncggcctcggcgaggtcggcccccttctccccgtccttgnaggagggggacaggagcgcgaggatgcggttgtggagcgcgaggcgcgacggcgcgagcgacgggaggggctccgcgaggcgcacggcgctcggggacggcggcggcgtggggggcgtcncgacgaacgcgtcgcggcgccgcgcccggcgggacgccgcggccaaggcggcgtcggcgtgcgcgagcgggaaaagcgccgggacgaggcggcgcgccgagaacggcttcgacagcgacatctcccgcggctgggccggctgcggcggcggcggcggcgagcggcgagcgaggagagggttttggggactctggggctatgggaaaatcgcaaggcggtggcccgaaggcggtgtttggaaaaaatacgccttctctacaaagaaacggattttcgagccacacttcaaaatacttctgcttttctcggggattgcgaaaaaaaaataccaccttcatttcatattataaatcactttgattcttttagtcaaatttatttaagttttatcaaatttatagaaaaatttaataacaactatataaaataccaaattagtcttattaaaataatattatttattttttgataatatgtttgtttgtgttgaaaatatttttatgttatatatatataattatttgcaagaaattcatgctggggggagaaaaacgagcaatttcgagcttcgtatcagcatatgctattccctattggaaaaaaagaatatgcttgtgggaataaatggccatacatcactcttgcatttctttgattgcaaatttccaaggcagaagaaaatatgtgccaggtggagcagtatgtcattgtcaggaacaacaaagaacacaagaaaaatttcccaaaatccatttctcacaaacagaaaaaggaaaatttccgaagctgccaccacaagccaagctcaaaaactccagtgtcgactcgagctcactgggtccaagaccccgaccgcactggccgctccggccacgcgtccgccggcgattggccgcgccggacgccgagacggcgactccgaccacccgagaatcttcgcagtaatatgccaccgtggcgaattccccaaaacaacccctgcagcatctacccctcccatgccaccaaccacggtaataacgtaataacgcgagaaaaccaggggtaattttgtccaatgtgacatcggtataaaataactgaaccacctaatcgccatggccacaccaccactctccagtctccacctccgcggcgatgcggagcagcagccatggaggtgctcagctccagccgcttctctagggttttccccagcagcctcctcagccccgtctccaagccgctcaagcccccgcgccaccgccgccgccgcgtccagacgctatcctcctcgtcctccgatgccgcggcggcgccgtccacgccgccgccagtgtggccgcccgcctcgctctcccggctcctcgccgcggcgctgcggggagggcgcgcgggaggggagctcccggacctagccgtgggggcgggggcggcggcgacggcggcggggggaggggcgaggatagggacgctgctgatgagcacgacggcggcggcggtgaccaaggcgcgggagaacccgtacatcctggcgctcgcggcgaacccgacgttcgtgtcggggctcgtggcgtgggcggtggcgcaggcggccaaggtcgtgctcacctcgttcgtggagcggcggtgggacctacggatgctgttcagctccggcgggatgccgtcgtcgcacacggcgctctgcaccgcgctcaccgcctccgtcgcgctctgccacggcgtcagcgactcgctcttccctgtctgcctcgggttcacattgatagtcatgtatgacgccacgggcgtcaggcgccacgcggggatgcaggccgaggtgagccaatgcttcgattgcttttgtccatttctgtattgcatttagatgtatgtgatacatttttttttctgaacttttgattttgatagctaatttgtcaaaatgattcagagattgcttgttatttggggtaggatactttttgttcacattgttcaatcatcgatgaatgactgattcgatggcccttgtgaggtttgaacttgcggctggtggtatattttacatttttacccaatgttggagtgattatgggattgcatactcctatgttgttactttcaatgtggtagtatttgtggtgtacatacagattgattgcttatgttatcattgtttgggataacattggtgttcattttactctgcttttatggttttcgtctctcagcagtaagtgtaatggttaccatttgcaaatgattgtaaatttgtgatatgacttacaactgaaaatctgaagctaacattctgaactcaatggggactatgatttcgcgttggcatcattgcgatactattatgaattgtgctacatatataagattatggctgtcctgatataaaacaagccagccaaattgcaaaagttaatcatgtgcgagctgctgttatttgggctttagaagttgttatatggcagttttagtatcttttcgcataaacaaattttggctttgtcttagctttccagtggccccagatacttttttcaccatatgttgaactacaaacttgagtgtacttgttgggggcaatggaacggtgttaaatagttttgtgattgtttagtatttagcatcaaaatagatttcaggcattcaagaccaatgtcttgctccttccaaacaattgctgtagtttggtatgaaacttgtgtgctacattcaccttatttagctcattatcttttttgtaaatcataaaaccagctactcaaatatatattacttccctgattgaagcttcacatattaccttagaataacacatggcacagacctgagacctgcaatcattttgccaatatgcttttctttatcaacttactttaaggggtagtggtaacattactgttttatcacatggaaactgatagcaagcagcaaatccagttaagcttgccgtacatatcatctaaaaaaatgcagtccagatacttttttttggaaaggggaaaatcctgataattatcacgattgcattctgatgctcgagtttagattcaggaccatttggatattggttttggatagccatcacaacaacacagtagcaatagtgtgttatatatgacttgtgatagggtgcttatttcctgaatggtaatacacaataacaccagatgcaccaaatgctgtcagttttatagtactcgcttattgttacttgatatcttccttatgattgacacaggtactcaataagatcgttgaggacctgtttcaaggccatccaattagtgaaagaaaactgaaagagttgttagggcatactccatcacaggtttttgccggcgctttgctaggcatcatggtggcctggttctgttgtcagggctgtattgttcccatttgactgctgttgtacttcagaaatggaaaaatcgttttgacacgaagatttttggtgcatctggtgtaaccattgttccaggagatagctaattttatttcctggcctgtttgcctgtacatatatgtaactcaatagcagggatagccacgaatttgatattctcaattcatagttgagatttaagtccttttctgatctgattgacatcattgaatgtaggagtgttttgctcttagatctgaaaattctggagttaccctgtacaaccactgtgatcaagaagccataatttgggcatattatctctgtatcatatagtgaaaccaatgctgattgttactggcttcagtcaaacaaattctgtctggacaattaactgttactaacaactagtattggtgtattaccagcaagtacaaattggtctagctatgtttggcaaattgggtcatgctaagttgctgctttgctagggcacacgtgctgctcaatgcttttgtttttggtactactttacttggcactttggcagttcgcaccttttcaattgagggatctcgctccaaagtcgacgatggtatcgattttttatcacatgaagcatggcattgtcggttgtcaacgacgagatttccgtgaaactcaacattgacaagagcccagtggtgcgccacgaatcctgacgatgcctcagggcgtgctggttcacgaggccatattgccctattcgtgacaaggtggaggtatataacattctacaatttttttattaaaatacttttaaattgtaggataattacattgtaactactgtaatgcaactactgtataatttgctcatctaacatcaaaacgttagactaacttagcggatgaggtgcgcttttgtgaagcactgacatgtaaagcgagtgtaactgaactgattaggtgtttttttgtggaatatgttcatccagatttaagttctagatttagatcccgtttgaatcatttagtccctggattaaaattttaatcccctactatttggatccagggactaaaagggactaaagtcatgtgtaccgaagaagagaggggttgccactatagtcctataagtctcaatatgcacttttagtgctttttactcacccctgtttggattcttaaggattaaaatagagtgactagtggattagtcccacgaaccaaacagggccttagcacatgtgctcatatttacgattatttatttttttttaggggtagacaacattcatgccaataataacttaataagacgtctatagttaatttatgaacttcaagatataatgacctaatttttaagaggtgtttatagagtcctaggagtagggtatgtatgtgtgcgtttatataggtgagtttgcacacatctatatgagcgattgcgtccataccgtgttttggaaaaaaaaaacactgattttaaccagacacgttgcttaatcaggcaaagcatgacacatttttcactttggtgctttaggtaagggcgaaaacctgaaaacggctggaaagtggaaacgagtgaaaaaccatgttttgccatatatgtttatcttggttgataaaaaactgaaaatgataaagttaaaaacgaaaacgatattgggaccttataaaggtgtgttcgggaggagaggttaggaaccccttctttttaacacgtaaaaggaaacacacattagcgcatgattaactaagtattagctactacttagtctcgaaaaaagataaaccatgtgttcaaattcgtagctaggattaggtttttttaggacggatggggtatcttttaaaaaatagattaatatgattttcaaaacaactatatatacaagttaaaaaaatgtattgtttaacggtttagaaagtgtacatgttaaaaaggagaaaggtaaagttaggaacatagataagagcatactccctccgttaaaaaaaaccaaaaagtaaaaacatactctatgtctaaatttattatattaagatatgtcacgttataataataggttatgttttcagacggagggagtagccagtagtggtgatagtacattcagcccaactgaccattaatcctagtcaacataatagacaagacgtgttgctccctgcttgttcaccatctttggacgaatgactgggggcgtgactgcgtgtaataattctgtacaaaataacagatttttcaaacacaactcttaatcaggcaaagtatgacgctgattccaccttggtgctttaagaaaatagaggtcaacatggaaagaaacggaaagatggaaattctctagattcaaagaaagtgagataaagcagctccttggaatgctcatgtcatgcttgaaggtgtctgccactcattagagtatctaagataatagtgtcatcagtaacacactttagtagcggcaaacaaggccgcatgtcttgtttccagcaagtataaatgcatgtaatagtcatggctcctgccctttcgtctttttggaaaaaaaagatatcaatgttaagttgtttttgttacgcaaatgtacctggtgatagcaaaccgcacaccataattgtgatgaaaagaatataaaatgacatgctttcaggggtgtttctgttaggtacattcacgtgcatggacattcgcaatttcacacgcatattcaatcagagcataccatgatgcagtgaatggaattaaatgttagccatatcatgcacgggccattgctatcaccgtgctttgatcagttgagctgcgtcttaaaaggagagagaaacaagcaaaaattaatttataagttactccctccgtcctaatatgtagcaatctagaatgggattagatccataacccaccctaggactacgaatctggacggagagagtaaatctttatatctgtattagaagtttacatatatacaattttcgcaaaaatcatagtttagaagctcgtaaaacatgtcacgttaatctattgctatgttttcttaaaaaagagaaccaaaataaactctaaagcgtgacttgagttccaaaattcaaaggctacagttaataatatttggctttggtttttttcaaaaaaaaaatatttggctttggttaacatacggtgggaaagtcatgcatctttcaaatacataataactcaaaatcctgtgcgcacgtggtgtcgtggtgaaagtacgctgtgattggaaaaaaataatggacgttttagactggatacaataatagatggtagataatccatataggattttttatgagctaaagtagagaggggaagagagagaaggagcgagcgactaattagtcacccaactgtactctctgtccgagacgtcggcccaccaggtgtactctctgtctgagacgtcggcccaccaagaacgatgggtgcacccgcgcaagccgccgttgccacgtccgcgggcgtcgcgctccaccagattgccgctgttgcagtcctcgtccgccatggctgcccttgccatcgactacgtttatcgtgaccgtcgccgctgccctcgtccatcatggctacaatcgccatcgactgcgtccgtcgccgctaccctcatccgtgtccaccatcgccaccatcgctgtcgccatcaaccgtgtccgccgccgcctagtccgttgcggtcgtcggactgctggccttatcctccacgctcattgcctgcatccgcctcggctacaacctcatccaccgtggcagcccgtgtccggcttggccgcagccctcgtttacggcggccgccgccatcgctctcttctgctgtcgtcgtccttggtccaccatggtcgtcattgttgcgttcttccgccgcagcgggctcatccactgcgtcgtcgcgtccttctgccagtgtcgccttgtccactgtggccgcggccgtcgtgtcgccgccattgtgttgtcgccatcttccaccgcaattggcgtcttcgtccgccccagccaccgtgggcactagtacgccaccgtcatccacgtgcgtcaccgtagtccggaggactagaggagaagaggtgagaggaaaagattgggaaagatggtgggtcccatgaagataataaaatatatatatgttacagttaatctattactccctccgtcctaaaatgtagctatttctagcacagtgtcttgtcccaaaatgaagctatttcttcacctacctcctcctttcaaccaatcacaaccattcttcttcacacactttctcttttcaaccaatcacacactttctctaatcattctcacctacttttttaatacccgtgtcaaccgtaaaaatggctttattttgggatgaaggaagtatagacaataactatactgtttgttatagatgatattactatctattatagtcagcactcagcagtggactttctcttcaaacccaattcacctcttcttccgcccgccgttggctgccccgcacgcgtagctaaaagcgggtgcaccgagagcggccacgtagtactaacttctctttatcgagcgtcaacgtgagccgactgcaccaaaatcatcagtggaagcggagcacttttccccagcgaaaatcgagcgacgaatcatggcaaaaagcttgaacccggtcctgctttctctgaatttctagctatagccactcacaggattttgctcatgtgcagtcgttagtgtgactcatcttaaacagtcacgaccatccaaattgcatgtaagtatgggtgcaagcgggacgggcaagttgattttttattctcacttccagttcattttttatatcaccatacgagaaataaactagcaaacggatttttatgcgggtagtgagactacccacttgcatctctacatgtatgggttgaattctttattcttggagcactgttttacatagaaaatagtaccgtacaaccactgtagtgatggtgctatagcacttgatttacgtctttgatctaaaaataaaaaatgaatgataagataccataccgttattaacttacagttctagttgtgactgcatgtaatctcaatccacatttttctcatctttgcagaaaataaaggaagcgaaaggaaaggaaacttagtcctatttaaaatagattattaactgaattatcatagtagattaccaataaaattataattataaactaaatatttcaacgataaacttaataaacacttagagatctaactacttttgaaaaaaaaacatattttaagagacgtgaaatagttaagcgaagttctgaaaacaacgggaccttagtgacactgtagtgtagcacaggccacataggaatcaggacagggcacaaagtcagctggcgtcggcaaatgaagggtgtgttggttgccggtcacactcacactttgtcacaactaacattaggtaaattgtggcagccacaaaagtgtggtggacaaattgctagtcacaaagtgtggcaaagttagcaagaaaattaagtctatgacatatgagacatgctattgaaaaactgtggcaagccacaactgttgcagtgaaccaaacacatgcctaacaaactgtgccaaccacgagtatggtgtggcaacgtgtggccaagtctcatctcaagcgagctaaaagaaaatctcaagggagctactcctatgtgcagttgaaaccgcaagctgtggatacatagtaatactagtttagtccattttaagcggagcgatggattttcgtatctaatatttaactgttcatttttttaaaaaaatattaaatattaaataaatagtcacatataaagtactattcatattttattatataataataataataatatttttaaaaaataaattaaactattaaacgtttgatataaatagtgtaaaattgtggtctttctaggcgaacatagtactgaatactgatgtcgcacagttggggcgaaacgagttgtccattaccattagcgaagacgacgatgctgcctcgctccaagcccccaacttgcgtgcgtgtgatggcactagctctctctgattttttttgtaacgaatcagacagccgtcaatttcatttaatagagaataataaaactgtacagaaaacacagacactagctctctcatctcacagaaacttactttttaccgctcatgcatgatatcgaatggctgggagctggctaatctgaatctcgctcgcactttgacccggctcttgcatatgcatatgtaacattagtggtagattgctgaatgtactgagattattaaggcgtgatcttgttctgccgtggtcaaatcaaacactgcaacaatcttttgcccgaacgaagcaaacaattaatctttttgtgagtgtgcgaagaacgcccttatcttttttttcatggctttattcagggatttgttttatttatttgcgatatcttctgaatctggatacaagctgttattatcagaaattatcacaaaaaaatttcacatatatctgagatcgttagtagttcatgtatatactctctacattcccaattgatcgtcgtatataatttttaaattatttctaaataatcatcatattagtatttattttctaagtttattcgttatatgtgcctaaaagatactccctccatcctataatataaggcgtggtcaaacttggcactatcttagtaaataaaatttaatttataatataataattgttagctaaatatttttaaaattaaatattaaaatgtgtgcacgctctatttataggaagatggagtattcctaaatagacattgatgctgtattcatgcacataacacacataacagtgttttggtttattatcggttaattagtaaatgatacgaatgttgtatggattgagtttgttaccgagcaaagtcattatgaaagaatttattatgtactcatgcaatataatgattaactgagagggaacggatggagtattttccatgagaatctgcttgtcatgaagaaaaaaaaaaaaggcgccatgtgtgcgcacggtgaagagccagcttgatgtcggaagtaagcgaaaaggaaataaaatatccgatactgtgtgtctgtcgccggcttgccgagcaaacccatcatccgtggccgtcagccgctctcgcggcacggcgacgcgcgtacgcacgcacacaaaagctggggagcaccgccgccgccaccgccaccgccgcaccgtgcatcatcgtgtggactcggcgctcgctcacgagtcacgagcgcgatatagaagttaaaaaggtgacataagtgagctgtataagttgtcacattaaatttatacgtagagaagaaaaataaaagaaaaaaacagggattataaatttatagctaactgtaacacgaacttagataaagtactccatctgtttcttattccatctgtttcttattatgagtcgtttgtctttttttttctaatcaaatttgtgatcaagtttgtagaaaaatacagtagcattatcaatacaaaacaaacattatatcaaaactaggaaggtggcccgcacgcgcatgcgcgcacacttatattattgaaaggtaagattattatttgttcaaaattaaattgtcaaatagattaagggcaaactaaagttgggataatggcattttataataatttaagggttctatttttcttaaggtttcttaaaaaaccattcataaacatttgagtaggagatgaattaattacttaccacttttgaatcatgtttttttctcgagtaaataagaaactattgcttaattatcatacaatccatccatatacatatcatgtagtatgtccacaaatgaatagtgcgagagcaaatattcaaaattcttgtgattaaatcgcctcatgaagacgtatgatatagtaagaaagggagggaagcgtatgtaaggaaaaaaagaagaaaggggaaaatgaaaaaagggaggggaagtgtatgtacccacgtacgtaggtgcgcacctatgccgtgggaggagaggtgggacctcatagtatttagtgttttctaagatcaatttagtctaacggtttataatattggatgtgccaatttaagtgaaaatcaagtaatatatactttgcttttttttcatataatttctaatatttgctctaatttattagagcaccacgtgacagctcgagagcattttaagaaattttataggacttaacacatgtaattagaatattaaccatgtaatatatatgtatggggtatatggtaatatttgttccagcttcgtcgatgtttatatacatgtagagagaagccattagatgtctaattaatagcaattaattttgacacctatttaccgttgttcatagtagctcttacatattcatcttatgactctgagtatccattgatccccaatttactgtttacgatgactcgcatgaaaaaaatgtactacttagggtttaggacaactgaaattgatgaattatctgatttatgtgatagctatttgagggtataaacgaatgaattgacttctaaaagttaaaatgttgtttaaaaaaagacacaatttagaaacttggaaagcatgcaaatgaaattcaaactatggaatcgggaaaaaaaaagagggtcttaaactcccttgtcttagaagagttccattgatattcgttaatattgtgctcacatttataatataatgatttctttcaactgtacggacaaataatacaaaatccaaatacaacgtaacacaatacattataattattctgtaatcaactctcggttcagcttaaacggagctaagtgttccaaaacacaacccacagtgcttaattcttctctcgctgcatcacacctctaattttcttttcatgttattaacaaaatttatcatctccatatatgatttgacatgtagcaaagcggtagcgctgcggcgatcgtgatcaccttatgcctcaaacacgacgctttgtcacgcgtgcaaaaggcaaatgtgcatacgtgcattgtgcagcgggccaaaaagggaactttggatgctttatttattagcaaataatagatttgatgatttaaataatatccactggttttaatgtaagtgtaaattagttgatatagattttaaattgttaatttaatgggtacacaatataatgtcatagactgtattttgaaacaatgcattatttgagaatgatagtccaatgtaataaaaaatagatccaatgatttaaataatgggttcatcggtttaagtgcacgtataaattagttaatatagatcttaaattatttatttgataggtacacaatataattgtgtaaactttattttaaaatagtgtattatttgaaaataatagtacaaagtaatgagtacgacggtttaattaagtggaaattatcttactccctccggtttcattctaattgaagttttggataataacacggtctacaaaatatatctttgaccttatttttctattataatatatacgataaataaatatatgtttctattataatatataagataaataaatatatgtttacttttattatagtgctttgagagataaatctatatatgttgttctagttcctttaaactaaatatttttaaagttattgatagtcaaggttataaaagtttgacctcaaccttgtccaaaaggtcaattattatagaaccggagggagtacattattaatttaatgggtaacatataatggtgtaaattttattttcaataactgtaaagctaatttagttacatgtgagttgtttgatggtagattctttgttagtaaaattatgattatttaaaaaatatatatccattatatgtttggcaacggttgaaaaaaaaagaagggatggaatgtacgtacatatacctacacatgtgcggagaagaggagaggtgggnccccatagtatttagtttgtttattcttagaatttctatgattttctctaatttattagagcgtcacgtggcggcttgagagcatttgtaggaagtttaatggacttttagtatacctacacatgcccgggagaagaggagaggtgggaccccatagtatttggtttgcttattcttagaatttttaggattttctctaatttattagagtatcacgtggcggcttgagagcatttgtagaaaatttaataaacttttagtatataatagatatatagatatattttattttttaaaaaaatataggaaatcctgtcgattttctttccaatgatggtattacgtacatatgtttctttgactttattttcttctgtatattgtataagtacatgtatatggttttttttttcttgcggcacagtaggccagctttatttttttttcctttgaatcgtacttagtacaaacagttatatatttcttgtgtgggaggaaggtattatttttttaataacagatctaatataatggtcaaaaatataggggccaccaatttaagtgaaaatcgacggtgagattagatagtgccatgtggcggtctaggagtgtttgtaggagtgccacatggcggctttagagcgtttgtaggaagtttaatggacttttagtatataataactaagaaggtagtccgcgcattcgcgcgggcatgtatcataggctgcatttgagatacctataagtaataggctgattgtgttaaaatgtcgtatttgttatatagcaaactatatataggcatatggatcttatatcgttggtttggttataaacatatcaatagttaaagattagaaatcagacgtgaaacttataattatagattatttatctttagttaaataggaacgtgagaggaatgaaaagcgtagagcttgagacagagaggggaaggagtgggtgtgtagtgatgggcgcatatggagcggatttttttttgtattttttctaagtaatttaagtgaaagcaaattatcatatgttaatttcctactatttgcaagttttttttcaagatgtgacatgtcactgatttgatagatttttttttctaaaagtagatttgatagttgaaaataatattaataggtcatcgatctaagcaaaaactgttgggtagatgttttattttttctttgaatttataagttttactaatttttaaaatgtgatacttggtagtttagcatggctctaaaaggtcatacatggtgactttgtatttttctaatttttattatgtacaatgattaagatgacataatacatgttgtcacttttttaatgtttcagtgttgtttgcttgttggtctatgttcaaattacgtattttaaattttacatagtaaaatatgagcaataaaatcaacagtgtaaataattaaaaatagcatgttatctgggttgtcatgtaaagaatagatggcagttcaaataacatattttattttatagtaaaatattggtaatattgattttaaattatttagctgtctaattatgaaacaaccgttcaaataaactaaataaaaacatatatactacctctgtttcatattataagtcatttgtcattttgactttttcttgtcatttttttacgtttgaccaagtttatagaaaaatatagtaaaattttacaaaaaaaaacatattatggatatatattgaatgttatatctaacaaaataattttgtgtgatagatgttgttaaattttttatatgtattggtcaaacctaaagaattttaattaagaaaaaagttaaaaggacttataatatgaaatagagggagtaactttttagaattatgattattttgctatgtaactattatcttttttctaaattgttagttaaaaatagatttgttatttataaaagcatgcatctaatcattaatattttatatatttaggcatgggacacgcaatcaagagtccacagccattctcgtgagatagaagtgtagaaattaattattaagtaataaaagaaaaatcttaactaccatacataaaaaaaggaaagagatgaggagaaggagacgagaacttacgtaaggtagtaattgaggaaggatatttttttatgagataaatctaattggcccatcagtttaaattatatattttttctaatttattagagtgccacgtggcggcttagaagctgacggagctcgtggctcctcaccgggagaccgcgcaggcccccctttgccagttcggccgggggcttagggtgagatctcaagctctctctgtatgtggaaagattgcgtgcccggaagaaacgcgagacacggacgatgtatacaggttcgggccgctgggaagcgtaataccctactcctgtgttttggtggatttgtgtgtggaggagctacaaagtctgagccgacctatcccttgttctaggctctaaatctggaaaaaatcaatcctcccttccctatgggcaaggtcctccttttatactttaaggggataccacatgcactcttccctttccaaactggacttttcttctttacataaatggacggagatttgcacggttgccctccgaacgtccttctgatgggacggcacatacctacctccacttctgccgggggcaggcgcgtcgtgggaacgtggctgtgagctgacgacatgagcagtgtcagaccggtcacaaatcggtcatccttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgacccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgccatggccgtcagtcatgggcggtctcttcaagactgccgcatcacttgagcagcgctcgaatctaggcgtgcagattcgtttcgtctggagatatggtaacgtcgcttcggtcggcgagcgtaattaacgcgcacacgatacgatctatctcgactgccacaaccgcatatccacctcatgcgccgcaagcaggcgaatggaattagtggaagcgtgggcgcgagaaacgagggaacgagatagcgagtaacgagggagcgagatagtgggcacgagaaacgaggagccgggctcagcgatgggaagggtataaagccatcaaggaaaggacttgctcccttcctttcgccactattcccctttccttcgccgtttgcgccctaaactcactctttgctacgcctcaccttcgccacacacactcgttctcaaccctttctttctccgacgacatggcacggggctccgctctgctcgacggtagcgtactaccgccttcccgcattgtgagcgagaggcaagctgggctgccgcgccgcttcatgccggaattcggcaccggccgggagatagtgatgctgggcgaggcgcgcccagcaccagattacccggggcggtccatcttcttcctccccttcgcgatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccggtgttgaaccgctacatcccatgcgcccttcgcaaaaagtgggacgattggaagagcgactggttctacaccccccttgccaacgaagcgtgcctccgactcccaagccagcccccggcgccggtctccagctggcgggcgccagtagatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccactggggagtcagatgggattgggctcccgatgacttcaagatcgtggtccaaagggtgctgaatctcagctccgtggaggcgtctcttattcctcaaggactcctccccctctgttgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcgggaagcaaccgccctgccgccgcccgggggaagaggaaacagggaggaacaccccccccatctcctccccgagggggcggggcggtgcgtgccagcagcaggcgcccggagggggccgtgccgacatcacagcccgagacggaacgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccatcttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagctgctcgggaggaggccgcccaggctcgtcaggctgaagaagccattcgggaggtaaccgcccgggctcgccaggctgaggcgatggcgtcttccgaggcggttcacgacaagaccgccggcgcgtcgctcgggcccactccctcgggtgacgctcaggcgacaacctccggggcggctcgcgacaaggccgcgggcgcatctcctgggcccgctccctcgggcgacgcccaggaccaagcgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgagcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaaactcgacgccgcccagggggtccttgacgccgccgctgcccgagagcagcgagcaacggaggctgaagcggcatcccgacggcgcgaagaggcccttgaggcccgtgccatggtgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaatggctggcggacagcctgtccctccgcgaggcagcgcaggaggagcaggcgcgccgcaatctggaatgcgtccgcgccgagagagccgcgctggagcagcgggctgctaacctcgaggcgcgagaaaaggagctggacgcgagggagcgcagcggcggggcggctacgggcgaaagcgacttagtcgcccgcctcgcagctgccgaacacaccgtcgcagacatgcagcgcgccctggactcatccaccggggaagccgaggccctccgcttggcgggcgaaatagggcccggcatgctttgggatgcggtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggacggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcacattggaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccgggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaaaaaacggcacagatcatcctttaggaaattgaaactgcttttattgaaatgctgaaataagaaaagtaaggctgtgcatgtgtggtagcccccggctaaccctgcacacccgaggggggtgcagggttagcccgagcccgaaacctgacacccgaccccccccctcaggggtagaagcgacgaaggtgttcgatgttccacgggtttggcagttcagtgccgtcgcccgtggccagccgtacggagcccggccgggggacgccgatcactcgatacggaccctcccacattggtgagagcttgctcagtccagcacgcgtttgaacgcggcgtaggacgaggtcgtcgacgcagagtgatcgggcccggacgtggcgctgatggtagcgccgcaggctctgctggtagcgcgcggctcggagggccgcgcgccgccctcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccataaatcgccgtgcttcttgagaatattgaaggtcttggttttaaggcctttgaggatttctgcattggcgcgctccacttggccattgcttctgggatgagcaggcgaggcgaagcagagtttgatgcccatgtcttcgcagtagttgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacaggggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtacgcgaggcggaatgggctccgcactcgccttcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatcttagagatccaagcaatcaatctaagggagcttggagcgctcccttcgggtcccgaggcctggactccaacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggagatcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattatgcaagatttgaccgagggggtaagacgtaaccacagtgaccctatgtgcctgaaaataatggcgcagtttccttgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttccctcagtggcctcggggccgtcctgagggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcagaaggcgttaagtgcggccttcccgcagtggccttggggccctcctgagggtcgggggcacctagcaccgtctgacaagcgggcagaggtccgactccggtcgtctggggccgtaggccaccgtccgactcgggggcctatgctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgttcagcttcctccgtccaagtaaacggccccgagcgcttgaggagcttaaacaagggtagcgccttctctcccagccttgatatgaaacgacttagggcggccatgcaaccggtaacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcagggttcagctttatgcgggcggagcggaggttctcaaaagtttccgctagatctgaaagtaaagtttcttggttgcgcgtttttacaaccaagtcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttagggcatgccttgttaaggtcggtgtagtcgatgcacatccgaagcttgccgttcgccttgggaacgaccaccgggttcgccagccactccggatggatgacttcacggatgaatccggcctccagaagtctcaccacctcctcgcggatgaaggcttgacgttccggggcctgccgccgcactttctgccggaccggccttgcgcccggtcgcacggcgagacggcgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacaaagatggggccaccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggatgagacggctggagcaccatccccggggccttgatagcatcaaaggccgcgggggaaaggatgttgagagccgctcctccatctatgaggacacgccccaacttcacattgcagatagtgggggaaaccaccatcgcaatctgccctccccgggcgacgcacggtgggtggtcggtctgg

SEQ ID NO: 28274 - DNA, 1996 bp, Oryza sativa
ttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcactgcgtgtgcagggatgcaaggtatagtattgcggacttgacagaaacgctgaatgtacgagcgaagagattcatcatcccctcgctgtactgcgtgcaagtccgcttcttcacctgggcgtggataagtgccttgaaagttcatggtgaactgctggcacagatcctcccaggagtggaccgacgcgggtggcaggttcattagccaaccccgtgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccgataccaccagccgggggcacggagggctggtcctcacgtccatgtcgaggtgacactctggacgaggaggcgccctccgttgcacggggagtacgccggctattacgccggcgctcgatgttgaggcgggcatccggctccccatgctgatcctcccgagtcgaaggtgtcgacgagggagtggcagccgaatgccgtgcagccgccgccgctcgccgcgccctccgccttgatgacacggaaccggtggtggcggcgccggaggtcttggtggtggcggaccgtccaccagcacccaggcgctgctgggccgtcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttctcctgcatcacccgcgaccggtgatgctgcggatttatcaaccctctcgagcgcctccccctgcttaggactttggtgtggaggtgggggagtacgagctcgacggcgtgggtttggctccccgtcgtcgccgctcacactcggagagaggtcgtgcgcctttgcttgctcggccattaggcagaacaagggaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtggaaagattgcgtgcccggaagaaacgcgagacacggacgatgtatacaggttcgggccgctgggaagcgtaataccctactcctgtgttttggtggatttgtgtgtggaggagctacaaagtctgagccgacctatcccttgttctaggctctaaatctggaaaaaatcaatcctcccttccctatgggcaaggtcctccttttatactttaaggggataccacatgcactcttccctttccaaactggacttttcttctttacataaatggacggagatttgcacggttgccctccgaacgtccttctgatgggacggcacatacctacctccacttctgccgggggcaggcgcgtcgtgggaacgtggctgtgagctgacgacatgagcagtgtcagaccggtcacaaatcggtcatccttgtccaccgcgtgtcag

SEQ ID NO: 28275 - DNA, 52237 bp, Oryza sativa
  unsure (1)..(52237): unsure at all n locations
gagcaacccgaccccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagaagcgtttatagaaatctcacgtggcaacttaagagcgtttgtaaaaagtctaatggatttttagtatataatagatagatatatttaatgctgaatttaatgaaactaattctgtattatagatgttgattttttttataaacttggtcaaatataaagaactttgactgagaaaatagttaaacgatttatataatataaaacagaggaagtatgtgagaaatagatgaattatgtattaataatatagtatatatctataactaactagtactattgtgtaagtaggttataaatgatgttttaatttttagaactagtagctgattataggctgtgtttagttcacactgaaattgaaagtttggttgaaattaaaacgatgtgatgaaaaagtttgaagtttacgtgtgtgtaggaaagttttgatgtgatgaaaaagttagaagtttgaaaaaaaaattggatctaaacacggtctatattacgcttgctataagctgtcacgctcacggagcgcagaggtccacagtccacacgatcgccaaatgcacgcaggaaaaaacgcaatcttttttctttttttggcgacatatgcttagcgaatttgacttggagcgccggagaactcgctataaaaaataacggtgggcttgcgtaagctgcgacacagcgagactccagcgaggcgccgaggcggaggcgtgcgtgtcgccccacaaaatttttccgcacgcttctccagaaaattttcggcctcttcttgtcttctcctctccccgtaatctcaggtcagaataattcagatttcacctcgcgcgaatacgtgtgtgtatggatgatatcaaggagacaaggagagagagggagagtagctgagtaggctagtttcttctcgtcggcgaaggcatcgttcggatttcacggcgaggtcgccatgggatgcgcgtcgtcgaagcagttcaagcggccgccggggtacgaggagccggccgtcctcgccgcccaaaccacctgtgagcacctcttcacctatgcgttttttttttcaagataatggaagctttattgcactcgttaaatactttaattacatcaccgatgcatatgcaacaccattgatagttaagcagttattgttacaagttacaacggctgtgtgtttgttttgcctctgcattgtggatgattttgcagtgttcttgcagttacggtgaacgaggtggaggcgctgcgcgagctgtacaacaagatgagctattccatcatcaaggacggcctcatccacaaggtgatttaagcagagttgattagatagctgcctccaatggcgtttctgggatgccaatcttcttgatgatgtactaccattgttccttctgaatgcgctgatcatggtgtgttttttgttgagcaggaggagtttcagcttgccttgttcaggaacagcagaaaggcgaatctcttcgcagacagggtttgttcttgttcagtcctgattctgtcagcaggcaggagatggccaaccaaatggtcatcttgtttgattcttctctgaacaaagaatgatcattctgttgcatgtttttcatggcaggtgtttgatttgtttgatctgaagagaaatggggtaatcgaatttggggagtttgtacggtcgctcagtgtgttccacccaaaagcgcctaaatcagagaagactgcgtgtatggccctgcctcctgtgcattcatcttcttattattttcagaaataggcgtattcagtttatctttctcctcatcttggcagttgcattcaagctctatgatctaagagggacaggatatattgagaaagaagaggtgaatctgaatcactctctttcacggcaatttgtacttttcattattaaccctgaacttcaattaacaggttgattttgtttccctttcaagaaattaacagattgtgtttgcttactgaaacagctcagggagatggtcttggcacttctagatgaatcagacctacatctttccgaatgcgctgtcgaggcaattgtcgataatgtactgtagttaacaaagatccttctaagcatttactctctcaaatataattttcagatgatttttctgactcgatcctcatgctgctcctttttgtcttgcagacattcagtcaagcagactcaaatggagatggcaggatagaccctgaggaatgggaagaatttgttaaggcgaacccggcatcactaaggaacatgtcacttccctatttgcagtgagtagtgaaaatactgaattctcactagaaacattagaactagaagtgtacttttttcccaatctcaattttgtgttattgattattttcagggacattaccatggcgttcccgagctttgtaatgcattcagaagcccatgactgaaaatacagatcccattggaacgtattacaagcaaccaaaagttctccattgttgctgaagctcgaggcagctcaatttgttggatgcgccggagttcagaagcaggctgcaactgaaatgcgttgaccgtcatcgcatgagtgaatgacgccatgaacaacagaatggcatctgataataagtatcagagtggcttttcttctgcttatgcgagggatacagagggcccagcagcaagattgttcaacgaagcaacacaagcaaaattaagcactctgacctgctgaaatgccttctttttttcccgtcttgtatgtatagttgtgagtcagaagtgacactggtgaccattgacctatagttgaagagatgcaggagtgttcatttttcttcttgaaagtgattttgatggcccaaagcggcctagcagaatcaaaacatgtccttgtaaagtgtttgtcgggtgagaaatctgctcccaccatacgcacaacgacgggcggaaaatactcagaaaaatagatcgaccaatctcatagcaaagcaaacagtacaatgtttttttttcagaacacgagtagtacaatgtttacaagcctatttggagcacagaaaatctcgtaaaattctgcagaaaccttcaccttccccatgaaacaattcattttccacacaagctataaagtagtatatccacatactctctccgttgcacagaaaacaaatctagtatcggatgtaacatattctagtactacgaatctgatagtagatttgtagtattaggatgtgttacatccgatactagattgattttttaagggacagagggagtacataccaaacagcctctagtagttataattccctcttcattattcctagtgccaatatagatcgccgtgaaaattcaaacgtagcttgattgactaacgcgtcagccttagattaccgtggcatgtatgcatatggagctattctcttcgttctaaattaaaccaacctaaaataaaatgagacattaccttagtataacaattttgaacttgtgccgtttcaacttattttaggttggtttatttccaaacacagagagaagccggcaagagggtgcagtaaaaacgatggttgcctggttggtctcggtaacaatgccaatgcatcgctgaatctgcaatttccccgcgtgagcgcgataatattacggtggcacacgacgcgcggttggcttggcttggcccccgccattttgagatgggaacggatcgagatctaagcggaggagacggtggctggtgcagcaggttgggggggaaggggccacagctgcgcgaacttcaccttggagatgctctgcaacacctccaatggcgtcacgtcccccgtcaccaccaccttctttttctccaaatccacctcgaaccacgtcacgcctgcaacccaacaaaaacgccacaagttcaacacacccgcatatatattatctaaaaaaaacacaccagcatataagtcccttccttctaaaatactccctccgtttttatattatataagtcatttgactttttcttaatcaaacatctttaagtttgattaaatttatagaaaaatatagtagtatttttaacaccaaacaaacgtgttataaaaatgtatttaatgttagatttagttatactaattttatattttatatgttgttaaatttttctataaacttggttaagcttaacaaagtttgactaggaaaaaagttttttttaaggaaagtgactgggaaaaaagttaaatgttttataatataaaatagagggagtacataacatagtattgtataaaacactgtactgattcgtagtagaatatgtctcatccagtattaggctgctatatcttgatacggatgaagtattctctttgccaaaccacagcatagacttgttgaacaattttcatgtcacatttcaagtttgaaatggatatgctaacattataattttttttctggttgtcgcgtgtggattcgaaggatcaatcatgcaccacagcaccagggggaaccacacatgtacccagcgcgagcatgacacttggatccaccccccccccccccccccacccgggcgacgagcaagctcgatcgagcgacacgagaagcacgcaagaggagggtgatttgatcggtgacggtgacaagaacaccgtggtttttgatgaaattgatgacagcctgcgaattcatcagcgtacagtatgcaggagcaataatagagcaagcgagtactgtactgctaatgatctatggcgtctctgaattctgaattgccaagattgaggatcactgtgaactgttactactgctgtggccatgatcacaggatcatgggttgatgacaggaagatccaaatgacagttgcgagtagatccatccagattggggaacagaggaaaggtgaaaggattgtgttcgcattttatgctgccatccatgttccatgatccatcctgactactccctccgtctaaaaaaagacaaactgtgagttctcatgccaacgtttgactgtccgtcttatataaaattttttataattagtatttttattgttgttagataataaaacatgattaatactttatgcgtgatttatctttttaatttttttcataatttttttaaataagacggacggtcaaacgttgaacacggtaaccaaggtttgtcttttttttagtacagagggagtattttgctggtagagagtatcaagatctggagtagtacaaggacagtgaagcacagatgcataaaagcagccgagttaatgttcaccgtaccatgcgtctgtggccttggtctgtacggtgtttttcggttcatcggttgtactacagactacagtacagccaagaaaatgcccaggccatttacctagcaagcgactggagaagatgaattacagtctaaactactcttagggggtggttagatggggctaaaactttatagtccatatcacatcaaatgtttggacactaatttggaatattaaacatagactaataaaaaaactaattttataaatgagagctaatctgcgagacgaattttttaagcctaattaatccataattataaaaagtttactgtagcatcacattgtcaaatcatggcgtaattagactcaaaagattcgtctcacgaattagtccaaggttatggaatgggttttgtaattagtgtatgtttaatactctaaattagtgtccaaacatccgatgtgaacaaggccctgtttcccaaacaggcccttacatggcaagctctgaaaactgaactgatctttgcagagtgttggagaggggcaaaagcaaaaaaagaagaaagaacaaagaagggcactttgtccgtgactgaaaaagggtagcaaagtacagtgtatcttaggaaagttcatgaggtgagtgcaaatgtggagttcagcttggtctggaaaataaaggtattacctggcctgaaccattttggaggggatttatgttttggattctctaacgttagttgaaatgatcgagcatttggataaaaccggttaacgtatatgttcgatgaaccgatgaaggtagggagagcagactctcaagacgatagcagaagagttaacattctctacctatcaaacagtctgaaaactgtccggaagaaataaactgtttttctgaactgagaagttcgtcatagaaaaagctaaaagatgatgatgttttgttaccttccatccttgagatgtgcttctgaactttcttagcacacccattgcagtgcatggacaccttgagctccacagtctgcatcaaaacacaaccaaaaagacagagaatgcacatcaaccaatggcacaggcacacaatgacacaagcacgttgatcaattgcacttggatatctgatggaagacgaagacgaagaagattttgcatacctttggttctagatggaacccgagtgtcctcgtgccatcaacaagatcgcgaagcctgatcacctggtcgacctggctactactgctcaccagggacttcctctccatggccgcctcctcgtcgccgtcttcctccgacgcgcgcaagcagaggcagccgctgcttctcgcgcaacacatggagaaggagaagcagtccagcaccttgccaatgcgtagcctcctcctcctcattgccctcgtcatccactggctctcccacacacacacacaaccagtgacagagacaatctctctatttatctatgacctgaccttatctctgtgatcgaattgaagttgctatgaacaacaagcacagggatgtttaaaatggcagctgacattcccttcttctctatcaccaagattggatgagatctagcaagttgtgcccatgataaatgatggtgatggtaccgttgctatttggctgtgctattgcaagggaatatccatgagagtttgtacaagagctagctagtactggactactactagtagtagacttaccaggttaaggttagtactatcagtactagggtgagcaagatgagggccacagagtacagaggcaaatttgttcgtcagtgcgctcctcttgctcaaatacgtttgaaaagttacaaccaaaggacaggtaggtatttttgtccaatgtccaatgataagagatagtactccctccatacacaaatgtaagtaaaattctgagcttttttaagagggattaaggatgaagagaaaaaaaaagactgtgatgaatcttattaaatgagaggttgttgggggtaggatgaggtgaaaattaaggcccggtttagatggcaaaaaagtttgttttggggtgtcacatcgtatatacgtacatacatttgaagtattaaacattgtctaacaataaaataaattacagattctgtcaggaaactgcgagatgaatttattaagcctaattaatccgtcattagcaaatgtttactgtagtatcacattgtcaaatcatgacgcaattaggcttaaaagattcgtctcgtaatttacacgcaaactgtgtaattggttttttttcacatttaatactccatgcatgtatccaaatattcgatgtgatgggtgaaaagtttttattttgggaattaataagggcctaaaccataaacggttgggttgggaaagtaatactactgtagaaatgcttatatttatggatatatttcaaataacagaaatggttatatttttttatggatggagtagatgtttttcttgctaaggtcgagtttagttccaaactttttcttcgaacttccaacttttccatcacatcaaaacttttctacacacacaaacttccaacttttccgtcacatcgttccaattacaaccaaacttcaatttggtgtgaactaaacacaccctaaagagttgttgcaaacaacactatggttgtatttagttccacgtcaaaattggaagtttggaaaaattaaaacgatgtgacggaaaagttgaaagtttgtgtgtgtagaaaaattcaatgtgatagaaaagttagaaatttgaagaaaaaaagttggaatctaaacaggcctatatagcatgccgtgctggatgctgacaagttttggcttgataggtgggaggagacaagcagctgggctctccatgtgacaatgtgcaaccttggcaaacatgcactagtggccactgatcagtgatgtgctactgatactggaatcgtgtagttgttccatcataggagagaagctaaactggaagatgcaatggaggacaatatgttgtgcaaaaaaatagaaaggtcgaatcattggtgccaattgccaaagagtaaccaatcatgctgccaatagaccattggccatttcttttaatatattgcaattgttctaccttggcatggcatggacataaaaattcaggaagcagagaagaagaggcgtatatgcaggcatcagattatgagtgacagatcgccgcgtatggttctgccattttcttgccatgcccatgcgtttgtggatcagaaagatcagaaaagagaagcttcaggcatatgcatgggtgaccaatggaccagcgcaattgcagaagaatcgttgggatagtgcaactgtgcaaggtgataacggcacgcaaaccaataagggattgtgcgtacggcatggtactgctcctgcgtactaaatgcaagataatgatagaagtaattcctttcggaagaggaagtattagtattattgaactgcacaagataaagtagtagtaaaactacggctgtgtttagttacacgtcaaaattgaaagtttgaaaaaattagaacgatgtaatggaaaagttgttcatttatgtacctatgaaagttcaatgtgacggaaaagttgaaagtttgaaaaaaaaagttgaaattatacagccatgtcagggacaagaaatcaggtcgtgtttagatttaaacttttctcttcaaaattctaacttttccgtcaaatcaaatgtttcgacacatgcatagagcattaaatgtggacgaaaaaaaccaattgcacagtttgtatgtaaatcgtgagacgaatcttttgagcctaattatgccatgattttataatgtggtgctacagtaaacatttgctaatgatggattaattaggcttaatatattcgtcgcacagtttataggcggaatctgtaatttgttttgttattagtctacgtttaatgcttcaaatatgtgtccgtatactttaaaaaaaattagcacacgaactaaacacagcctcagacgtctgatgaatttgtaatgcttgcatttgcttgtttgggggcatgcgcatcgcgcaacaaaggccaaaattaaaactattagtatagctaccttttttttttttttgaaacggcatagctaccatttttatgtgttagaggtgaaattctttttattgctgtagcatacaagttaaaagggtccttttattctcttgcgtaataagcctgatgatttcttgaatacccggcactagttttattggaagagaacgtgatccgaccagatgcatttgtgatgccctgaccacctaaacttataggccaaaagacaaggtaatcatgtctggaaagcggggggtcaacatggatagccaatgaccaaaataaataaatatttttttataagacgtgcatgtacaacattcacataagtttctcacttttacatctttctacgtagtagttgttaatatcatactccactataaagggaaaccaatggtaaaattgtagtaattcagaagacctggtgcttacacagttacaagtagtatgaactgaacagaaagaactctgtgtaacactaacacgtaccgaactagtatatcgcgacaatatcttcagcaaagggaacacatcacatagcagatcttcaaaatgtcataacggattaaccgacagtgatcaagtcagctgagcaacacaagcaaacccaacaccaccttgtattccccctctttcaccaagaaaaggagcttacaataacagagacctcacgtattctccatcgcgcattattcatatatgcatgccaatgtgaagatgatcaatagcaacatggacggtgtaccatgtaaatctcacctgacagggtaacagggttcagaacgtccatcaaatagtaaggattcaaatggcgtcaattgtcgaaaatcatacctaattacacaatagcaactgcccatcagaataatcactgcaaatgactatagtaaggatataaacaccttcaactgtcaaacctgaaaaggagcagcaccaactttgtcaaatcaaagcatatcctacgattctaaaatgctcatggggacatgtaggagcacaatatacatgacaactgcctatccaaggttgaggtacaagagcaatacaaacatctagccatttaaagtgtcttgctgaaatatcttttctcgtggaaaaatggccagtcactcatcaaccaaatgcagttagaagagaggagacatgtattcgtttatgagttgtgacgaaggaaatggagaaaaggacagattcagggtataccacaatttggacttagcatgccaaattaagaaacggacacactatacttccaaaagcaattgcaagttgttaagctagttttagctacgattcaattacctcctttaattagaaaatatcaatctcatatttattcactaaaatactagatatctatggaaacactgcagaaattcttagtagctcactaagtgataataaacttggataatcaatagaataagactctgaactagcttcagaagccttaacaaatgaaaacatgttccatacttggttgccactgtgaatctaccataaaagaattatgaagtgaatgccagaaaataaatttccttattatacatagtaagtgaaagatatatatgaatagaaagacaacagacatctaatgtctactgctaaaggattttccttatgttaccctcaagggatcaaggtttgggtgaaagggcaagaccacagaacaacaccagtctaacacaatgaaagaacaacagaagtcatgcgtacctggcattcattctggatacagcccaaagtgctacagatcagacactgaagtgttgcaaggacccagaaaggccttgagatagaagtcttgcacagacccaaatctaacagatgaagtcctcattaacaccatcgtcactatgttcatttgccaaagttcatttccgaatatctgtaacaagacacaacatggtattaacacatagtattagaacagaaagcatacagcaaacagaacacataaactttaacatacctccgaggtttatgttggcgttgactaagttcatcatttaaagcctctgcaaaagaggaaaaggcctcggtacatttatgtggcaaaaataggagaagataccccaaaataaataccaattgagaagacaaaataaatggaaagggatggaagatgcctttaccagttatttcttgtgacttcaactgagaagaggcactgggttctctgtaaaagaaacagaaagaatcattactatcgaaagcactaggatgattgaagcactaggatcctttgtattctcattaacatttttctgtttgtgcatgttgtgttggtggttggtgatgaaggctgggacagaaatcaatgacgatcatttgttcaattagactacgtataataggaaaatgctaggtgcatgcataatgattgtatccccatgccattcaaattgcccccttgcagttgcacaagacaacaaaacagaaaaatcgcagcaaaacaattattattcaacctaaataaagtaatcatcaacctctccagatcaggagagtagtgttactccaattatctaccaaaacctattctgatgatacggctggtcaaccagtacggcagtacccacaggaagacagctaaagcaagcacattggtagagggaaatcatagaatataagtcctcagattagggctatgtaagggcattaactactactccctccgggttgatattacttgtcgttttagacaagggtgagatcaaactttagaatatttgattatgaatcatttttaaaatatttgtctttcaaatatggtgactacatgtatagattagtcttaaaaagtactttaataaaatcatatattttttcacacttttatacatattataatggaaaataatggttaaagtttttttttggagaccgtgcccttgtccaaaacgacaagtattatcaacccggagggagtagttcatagcatattatttattgtcgtcaacatgttggtaataggtgatcatacctcagaaccagaatttaacaaaaggatgaatcatcattaaattaacattatctcaattctcaacagtatatatgccttgtgtgcgaaatccaaattcttgcaacatgaatcatattagagtattagactaacatacctcaaagaaactgatgaagatgcatgttcagaagttcggggataatagctgccatctacagtaatataaggtgaaccatacgttgctcccaaagctccagaagcaccagccaatatcggtagcctagtttcattcagatacaacccacaaaaaaattaggcctgagcaaacagcagtgtgctaacatctaaatgaagtacaatgtgataaccacatcataccaattggaggtagagaaaaataaagcaaacaactattctaagagttcaaagagtcattaccaagtcatttcagaattgctcagaccaagttgttgttgagacacaaatcctggtagagccatgccaattgagggaacgccagtcccacctggatgctggcctccaaactgcataactgtatgggaaaaaaaaaagctaaaggcatattgcagaatggttttggaaacaaaaacttggttcagttcactccaatggggtggcagtctactgaaaataacactacttttcagaaatcaaaccagaagttcaaagtagattataaatccactaacatcactgtaaacattttcactcaaggcacatagcatgcaccctctaatcaatggaggaataagcctttagaaattggattatttcttttcccctcacccatgtaatcgtttactcatttaacactctggttactatattgccgtgtgaatagtaaaaatacgaacctggaaatagtgcaggggttccatggaaattttggtcaccaagtgatcctgtagtcccaagaacttgagctccaccatacataaaagaagcatgttcttctccctggtcactatgttgtccctttgccatcaatctagtattagatttgttggaaccatgaggtgaagaaatttcagtgccttcagtcaaaattgttgatgtagattgcatggaagatggcaatttatcactgctagcaaattgcgcagcaaacatctgaccaggcatctttggtgtggattgattaaatgattgaaccaacctttgttggacaattgggtgtggggacttagccgaatttccagtgacctgattagtagctataggaaattgactagttgatgatgatgtagatgaatgaaatgaaggatgatccatgccctttataggaacttcagcatgcaacttgccatgcccagcagacggtacaaaggctttccctcttaagagagggccatactgtggggttggagagacatgctccataccaatgggggatgagaagtgtctagtagtggtactgggttgtccatcccccctctgactcactgggagttcctgatgagatggcctagaagggtaaaagggaggtgaagctgaattcaaatttgatgcaaagctctgcttcatcggaaatcctcgttctggttgagaatttgaagcttgatgttggtgttttcccaagtttgcatttgaagaagtgttttcaagattttgtgatctgaagtatgagcaacaaaaacaaaaagtaccacagtaagttctatattaacaaaacaaagacacagatagcacataagaagaaaccttccactcacttattattatgctctgaagatatctcagcggtactcctccaatgtggttggtaacgtttagagcctcttcctcgaactactctcggtgcactcttattacttttggcattgccataaagagggcgagactcttttcgaacaaaatcgaaattgttggcatcgccatcacgaggattaggtggtttgatggttctattcttgccattatcattcagaacctgttgaaccttcttggtgttatcatggtaactatgaggttctttcggaacgtatatgtagttcttagcaccatcacgatagtatgtctaaaacctgttgcctctgaaattatcacggctaccaccacgaactttaccaacaggtgcaccaccacgtcctctaaatcgacctctgggccttcttcttgtctatagtacaatcaataaaagaagcatcttggtaagaaagatgaatcaatagttcaacacacagaaaaagacaatatgatactcacgtagtcattatggaaatcatgtaaattcatttcatcaaatctgtcatggacccacgcttgatcctctttagcattccacagccgtctatcacccaccattctcctgaaatgacaacatgggtagcagaaattaaaatatagatcatggatgtccagagaatgaaacagagtatcatattggattccttaaaattgagataaagcattcaacataatcaaacttgtctagcttagttgggttcagcatccagtttgtacactggaacactagcacaccagtcaaacaactacttttaaaagggaaaaaaacagtaaatacaacctattattcagttcgttgagacaaattttccagtatttgttcaatacacttcaattcattctaccacactatcaacaatttttaccacaaatcataattattgtgtataattatagaatgatgtacagtatggaatggtcaatggagtgtttactggtttagtatctgatgggcttacttctcttttttctgttggttgacattgatctaagcaatgcccaacttggtaagattcatgcttaccaaactaggggagcatgcaaaagaaaaggtaaaattttggatttggttcaatccaagctatttgcgattggccctcctcaaaacagatgatttcaactatgcttgaattcaactgtgatgcattcgttcatctgatgcactaaaactgattaatcatttcaggtatgaggtaactagcattaaaaaaatgtagtataagatccataagttaaacttaagaaaatgataaatctaaaattttttagacatgactacgtaaaaacgatcaacaacctacatgataatagtgtatttttagaagatctacaatattatatttttttaaagttcttgcaaactatatctaacctgaaaagatcttctagagtacttgtgggtgtagagctcgccattatacacaacttttctttttaaaatagtaaagagataatgtatcatggtattggcatagccatgccataccttaccagtctcatctatattgtagtagtgtatcctagtagaccatgtttcagatcatgtaggtattgttctagtagaaacacttgaacaagatcagacttcaaagttaaacgcttctactttttaataagtgtgtccaatttgcattaatactaaatcaatttcacatgaaacaccagatttaaaaacttgtaggcaaagtttcatttttgtttcatgtttgcgacttggcatataacaatcaactctgtaaagtaatgcctgtgaatacatgacttcgtgttgttattttagctcatgttttgcgtgctttacgagttatagttcaatgttataaacccatgtattatcatatgctggggaattactcaataagctactcacagaccttggttatcctgtaaaggaaacttaggcaggacatcataacgaagagatgcaacaacgagcaaccgtaccaaatctagagaaccaaaatagaccaattgcgaaaataaatacatttaagccgttttatgacttgtatctatcaaatactacactactactgcacatataaatatcaaactttagcctcttctaacaattccacaggactagttagcatgacacactcgtgttatcaacttagatgatattaattgaactattgaacacgcaatgcacttaagcagtggtttcagagaacactaatggttaccaaactagtgaaggttgaaactaggctaccaagttctctagatcatatcatcataccctagatatataaggaaacaacagcaaatcaagcagcaattgaaggttgaaaggccggaacctttggcgcccatggccacgggcctcctggaagcggtcgtcgtgcatgtagaaggcgccagccgtcgggacggcatagggctcgctccccttcttcccctcctctccctccgccgctgccgccgacgcctcaccttccgcttcccccttcatacccatccccgcctcctcccccgctgcggccaccgccccggtggccactccgcccgcaacgcctcgcccttgctcgaactcctcgtacacctccccgtattcctcgtacccttcgtcatcttcgtacgcgtcgtcgtcgtcgtacacctcggcggcgccttgcccgtcggattccgcgtcggatccggccttcgtaggcggagagggcctggccccttcctcctcctgctcctcctcctcctcgtagtcgtcgctcgccgcgtcccggcgccgcaccgccgggaggggcgcgtcgtcgaggtcgctctcgtactcctcctccgtctcctccgccttctccctgtcggccattggcaggaaccgggaggtcgcgggacgaaccgcgcgagagaattagggctccgggggggggggggaggaatctggtggaatcgggattctggaagcttcgagaggcttctcgtgttcttccgtttgttctacgatatccacggtctacgggagggagaggactggaggagagaagttggatacgattaaaaaaatatttaaaaccattagattgtccaaatccacgaggtaaagacatcctttttgtgaggctgacaggtatggcccacatactgcgcgtgggggcctaatggcaatgttcccttttcgtaaagaaaggtgattttgcaaaaagaggcaggtgattttgctaaaggctaaagaggctctctctctctctctcttttgtacgatactccttttgttgaagatacgattcctaggaatgcccttcttttgaagaaattgttgggggtttgaatttgaattcttatctatttcgaattttcaaacttttttacataaagtctaggcacctctttatatgcttgggccttacttaggaggcccgcaatcccagtccttctatatgggggacttgactggattgcaaaccagcccaaaaaagaaggttttatgtgctttgcctccttcaaagttgaatgaatattatagtactctgtcagtccgaattagaattttaaagttagacacggttattaagaaaagtagataaaattaaataggaatgggttatgattggttgagaagtggaggtaggtggaaaaagtgaacggtgaagggttatgattgattgggaagagaatattggtggagaatttgttattattttgggacaaatcttaagtgcctaaggatcatttagccctagactaaaaatagtctctggactaaaaactttggtcccctactgtttagatccaaagactagaagggactaaaagcacatggaccgagggagagagaagagagaggttgtcactttagtccctataagtaccttcaagagggcctaatgtattttaggccctgtttgtttcagcttaagattattgtaatctagattattaaatcagattaatgtaagctggattataataagctggcataaaataagctacaagttgtttgtttctctggattattagaggcatctaagagtagtgggtctttagacactcaataatctggaaaaagctcctctagaggagattattggattatagtaatttggcttatagattataataatttagcataataatctacttgtttgtttcagcttactcctaataatccagattataataatcataagctgaatcaaacaggtccttagtcctcatatacacttttagttccttttagttatccctgtttggattattaggaactaaaatggaggaactaatggattactcccataaaccaaacattgcctaaaagttgttatattttgggacggagggagtataaaacaataattcccttgtaattagtattatataaaaaagtagtattattcatcaaagaaagtgtggttactaatctgccaagaaaaagatattcatgtcatccgtgtagtgggtgcttcctctgtcaaaaaaaaaaatcatatgatccaaacggggccatacttttgtgtagaatttgcaaaactagttgcatgctctgttcgttcctttttactgctttttaaggataagttggcgcatacctgtgatttgtgaattgttaatataacaatataattattttcttgtgataaacaatacatgtattctcatataaacaatggtggtaattttgttaacagtggacaacatgtaaaaagaaggcagttgtacgttgctttcctgaaccacatgaaaataattagtaatatagtacaaggtcaaattagttttctagaacaaaatgtcggtatcagagaagaaaaacatccccatttgccagccattacagctattaaccaaccattccagaactaactaatcattttcctcgtattgaccgtgcgtttttccaatgttgatttcgccttctaacagcggacgcgtaccgaacacgacgccgcctcctcttctctcgactgaattggtcgtcaattcctctccaatctctgaatctgacggcttgttcccattattttccttcaaaaatttatatctagaagaaccaaatcgtgtttttcttatcaggcaatctccaattctctgaattccgaacccgttcgagagtgtcatgcgtgatgcatgcgtgcccatttggaacagaaatgtaccgataatgccctcgggagtggatgttcaggcaatcagacttcagaattcttttctttatcagatttcagagctctgctttggttgtcttctttatctagaaggctttgattgctcctcttttcagtttttaatctactcaaaagtagctcaactaagtgatcactggagattatgtcactttaactaactttagttagtgagctaaccactttatccatttttgtgtaataactcttgaatcatactgtactgaatgctcatttcatgggtaccggaacacttgtcacatcattaaggttgatggttagcccgagctaatcctaccaaaatcagcatacccttttaagaataacaacaacaattttaaccactgatctgtctggaattaaaatgacagataattttatagccttatcgattggcatacgcttatcaaagaaaaaaatatagataaaacctttttatatatgttcttagagatttttaaattaatgcttaaaaaagtaaactacgatcatcagcttcaaaattaagttttagtagaaattaaagataaacgatgagggctgttaatcaccatagggaaacgggtaatctactgtgatccactaatcaggttctttaatcagagaagggcattgtggtaattagccggagcacgccacatgtcagcacccacgaccacggccacgcgaccagccaacgaggcgaggcgaaggtgaccgagcccttcaaagcctccacgccgacgctgacctccccttctcttcccacctcctccactcctccgcctcaaagccgccaagaacagcaagaaaagttgccaaactccatcgagaaatcttcgaagcatctcgctcttggaagtcggagcaccaccgccggttcgttgttgctgcggatcgaatcgcggagcagagcagggggtggatggggagcagggtgaaggaggaggagaggaacgagagggccatccgggccctgctcaagctgcccggcaaccgccgctgcatcaactgcaacagcctggtgagctcgatttttctctgagaaaagttttgagaattttgatcttttgggtggacacaaaaaatggtgtgttaggaaggaaggtaaaggtactgtagcttgctcatcttgtgaggagggctaaggttctgagctgctctgtctctgtatgtcttcaggctttgctcggcttatttccttctgaattgttgctgaaactctgaaatcatatgggttaggaatttttaggatggtgaaactgtcattacggaaatgaattattaatggtggttaatctgattcttatttcctcagttgtatatgggttaggaattttgaggatggtgaaactgtcattagggaaatgaattattaattactagtttctgtttagtaactagtacctggtcatatggatttacacgttattaatactaataacacattaccaccattaccatatgcgggaatgtgcgaaataacgaaatttcattttggctccaagagatcataacacaagtgcctgcgatgtttgatattattacagatctcgtgctctaaattcataatagatgcctttcccagtgtatggattcatataccaaattgaccacatcaacattgagttagtaacaaggtagtaacaaacaaaatgagctctgggtgaacttttgtagagtgcacaggattgcaaaatggttgccgattagtaataggtacttgtggtttggatcaataacaataaactagataattatgacagtgatactgcctaatgtttttcactagctttagatatctgctgcagcaaaatatgcccacttggccactttataaataatacttagttgtcttcttgatgaactgaggaggttgaactgcctatcaaacattggctcacctcataagcattttgaatattatctcattatcagtatgtataattttgtctggaaaattatatgatttaaccatgtttcttttctagaataaatgatctggtgagtagttgagtgaatgcaacaatgcattgtttctttagcaatgaaatgatatattgttaagtggtagtaatacgatgacagatgaaaaatgtataatattccttcatgacataaataaccaaacaatattcttcatcatcagggaccacaatacgtatgcacaagcttctcaactttcgtctgtgttagttgcagcggaatacagtaagtggtgaaaatatccttctagtgtttcctctgtttcttactttaaaaatgcaattccacaactacttgtgattgactatgacaattatgaatttatgtgcagaagtaataaactcctgataaatgttgtctaattactgaactttaattattcttcagtcgggagttcactcatcgtgtaaaatcaatatcaatggctaaatttacttctcaagaagtttctgctcttcaagaagggggaaacgaggttggcttaataccattatttataatttaaatcctgatatgcttggtgtctgcttttaagtcttacaacatatatttttgatagttcagcgtggtaaggaaatatatttgaaacattgggacttccaaggacagcctcttcctgacattaggtctgccactaaaccagatgattatcatagactcttaatgtatgatgtgaatctgctgttgatgtttgagtactgtcatatagtgatgtagataggctcagaaacttcatcaagattgtatatgttgaccgaaggttcacagcagaaagaattggtaaccatcaaccacaagcgaaggtatttgtcattggcttgcgctagccataactgttaaacacatagcattagtctctcccctctttttgtaacacacgaaacatctgaatgaaaactcagggtagtcgggatgacacttacagaaacaacaatatagattcatccaggggagttcaaagaggcccatatggtggaacttctgaagataatcacggtccacagcatagcacagcaagcacctcagaagaccaaaacaatctcaataagcatccagtacctgctaaagtggatcaaaagaatagaaccactacagaaagggaaaatgccaacactgggaaacatcaatacctggatggacttcaaaagacaggtggaagctcagaaaataatcttaaggatacgaccaaatcagtatcttctgtggttgaaccttccaaagaaactaatagaaaagttctgcctataaggcttcctgaccctcctagatctcataaagccacaacatctaccactcctgctgaaatacaggtaatccaattcctgctgatcttacttttgctgtttgcatgctttgcccatagtttctcttcttgtttcctcttacataaggtcctattcttgatttcaacttttaccaacaatatgtcatattgtaagctagctcacaggttttgccatgctcttcttatctggtttgtggaaacattattttaggtagctagggagggatttccatatttatattcccaagtcctaacagtggtcttgcctcttgagaatacttgtcctatttcagaagtcagacgaattctatgtcacaaaaaacaaagtaaaaatggaatgatatctttaacttaaaatatttatgtggaagtcctattttgcagaaagtagtgccaccgagggctgctgatcccagttcaaaaactacaacagatgttaaattagaaatatcgaaaagtttgattgactttgattcagatttcgagcctcatcaaggttttggtcaaactgaagtgcagaagagctcacctttacctgatgttggttgggctacttttgatgacactactcctaaaaacgctacagccacttcaatttccagtaccaattctttgaacggtccgctggttcagatcctaaattctgtctcagcacctcaaattagttttccaaccaggcaaagtaccaagtccttgtctttttcccaagcaaataacggcagtcagcagaaccagttctttttccgccccacagataatatccagtcttacagttctccactaaacagagctaatagtgctccggttaatagccaggttagctctctgcttgtatattgtgtaagaagaactatttccattgagcaattgtattagacctttgttttgctgcatgattattttcagttgtggggagccgcatcgcaagcatcaatacaagggagccatgctcttccttcaaatcatggctcaaatatattggcaggaacactagcatcacagagacctgctgtggacaccacatctagtagaggaaaggcacttccagaggtaatagatgctcaaaataacttactgtgctccatatttgttttctctaaaacgagaacaatttgtaggatatttttaccatgagttaccacccatatgctgcaaactgggattggagagcaaatcctcagttaaatatgggatatggacaatacaacatgcaatatcctgtaggagctgccaatgtaagttctatgatgtcatactcataccagttcacagattcaattacttgtttcttttctttttctaaaaaaaaaacttgttccttttttcatcttgttgattaggccctttcaagacattcattttttcatccaaagttcattgaatttggctaacatgccaaaggttccttgctagctcatcttctcatgcatcgacagtatgacagagttttacctcttgtttgagtagtaaagaattagataagatctgggtggtccggatgcactggggccatacaatatgttgactcatttgccacataggttctgcgtattgttgacatcatttttcctttgatgtgggaattcccagctctttgatcaagaattgttctaaacaggcccagcgagaaagaatgaatctgaatgcactgttgacttgctttatggtccttaaccttgtatctccttcctgaatgtggttgcatttcttctggtgaggtttatattgtattggtacacatctacttgtgtcactttcttgaaatttactgatcatggtagcacatgatggaatcacaatgtctaagttatcaagaaggatacccatttttactgttttctattaggtaaatgaagatcttttttttttccatctatgtacagttcccttctttgtcttccatgcgaggagcattaccgcatacgggtagtacttcaatgctgccgcgtgctccattcacaggatttgttaattctgatctgataactccacaaattctgccaccaatgacgacgaacaaccgtaattttttttactttgtttcgccatcttctgaattcaatttaactccatcgtgatttccctctaaaccttattatatcatgtcatgctacaataactattttgcagatcagttcatagtccaacaacatgatgttaaggttacacatcagatgcagaatgccagtttccccatcaaccaaagtcatttgccccaagttggtggaaacccctttttttaacacttttctgatgcctcctgtgtttagctgcgtattttaagcaatcttatgtcaagtgtaagtgttatggaaatagtaaacaatggaagagtgaagcatattgccctgcatttctaataccgaaatggcaagaaatagccaatcgagttcttgtgtgacatccaaaatgtaaaacccagatagtactgtaaattgaattcagttttagtctctccctaggggatgtggttgtatattgtatcagcactccaaatgttcagtaaaacaagttttggtcattttaatgttcatttttccgtgtgccatattctttgaggaacttatcctattttttgcgcaaccatagcagttgtgccatccaagtgcaaccacaaattaggaggacacaaattaggaggactgaaatatagttagaatcaaccacaagtgcaaccccgatcctttctcaaggccggaggggcggggcttggatcagattttaagacggaggacagtagatgatactacctccgtcctaaaataagtgcagccatgaatttccatgcctaattttgatcatccgtcttatttgaattttttttataattagcattttgttgtcatgagatgattaaaacatgaatactactttactactcgtgacttatgtttttattttttttcaaaaaaattttaaataagacgaacggttaaagttgggcgtggaaaaccatggctgcacttattttgggacggaggaagtacacaatctataactagacaagtaaacagtgatccttctgaagcattttcatcagaaacaataagaaaacaaggctcaaacttttaccatggctgaggatttgctgtgtacacagcgcaagaggcggcttctacggtcttggatttgccgcggtggccgattccgccgccagcgctgatactgacgcagccgccgctccttctgcatggacagtagccgcttcagcgtcgggaaccccatctccgtctcggttaatttgctggattaaatctcgatttttgattaagaggctactagaaccggactccgtacggtttgggggaagaagatgatgacgtcacgagccagggcatctaaagaatccctaccgtccaaacgtgatcgaacggtcacggagagattttagttggcggtttacgaaattacgcgagcgcaaggcaagaggcgtagagcgttcagcgaatctggggacttttgggagtggtgtctctgacgaaggtgggcccacatctctaggctccaaacccctctcgccgccggcgactatgcccgtggcgatcccgtcctcctccaccgccgccgccgccgctgtcgcccatctccggcgacgcatccaccgcctctcttatgtcccggtctctccctctgctactcctccattccgcgctcgtctccaagcccgcaccatctaggctcctctcttcctcctcctcctccgccgccgccgccgccatcgccgcggcctcttctggtgcccgagtcggcggggggcatgggatcgtctccgcggtgctggagatcgtgggccccatcgagctcctcttcccgtcctccgaggcgcgcctctacgtgcgcctcctgcggcgctgcgcgcgcgacgctctcgccgcgggcgcgggcgccgtccacgggcacgtcctcaagcgcggcttcgcatccgtgtcgctcgtgtccaacgtcctgatggacacttatgccaaaggcggtctcatggctgcctgtcgccacctgttcgacgaaatgccgaacaaggacatcgtgtcatggtgtaccgtcatcgcggcgcacgccagccgcgggcactgcttcgaggccattgggctgttcaaggaactcctgtcttctgaggtgaagccaaatcggttcgtcatctcatcggtgctgaacgcctgtgctcggtctggtgtcatagaacaggggctcatggttcatggaatggtggtcaagtctggattgggtgctgataggtttgtggaggttggattcgttgatatgtatgcgaaatgtggcaatgttggctattcattcaggatgttcaatggaattccggtgaagagctcagttgcttggaatgcaatgatttcaggttttgttgagaataactgtttcatggatgccgtggagctttgtcaggatatgcatcgagttggcatggcaatggatgtggtgacattgagggtagttgctagcgtcgctgctattctgggagcatttgagctttctaggaacattcatgtttatgcacttaaagcggggttgggaagagactgttttgttgtgtctgaactgatcaagtcagctgggaaggcaggtgagactcagtacatcaaaaagcttgttcctgcagttagaaggcatgatgcgtctttgtattctttggcaatctcaggttatcactcaaatggttgtcagggtgaagctgtgaaactcgcagaggttcttctttattcgggtctcaatttaagggaaggggatttggttactgtgataaatatctgtcagaccaaagaggaagttcaacagatgcatgcttatactttcagaactggggatttatcttatactaatgtttgcaattctcttatatcgatatactctgaaattggatcgttgattcacgcggaatcaatctttaaaactatgcaatcccgagatgtcatatcatggactgcagtcatggcaggctgtgtcaagaacctacaatatgaaagagcatttggttattttttagagttaagaaactctggagaaccattagatcagcactgtgttgctaatctaataaatgcctgtacaggacttgaagacatgtacaagggaaagcagattcactctttagctcttaaacttgggctacttgttgatttcatcagtgcatccctagtaaacatgtatgcaaaatgccatcacattgagtgggcttctcagttattctctagcacattatttccacgaaatctagtgataatcaatgccatgatctctggatattgctggaattcactgccacagaaagctcttctactcttctgcagagaatatcgttctggtctgcgtcctgatcatttcaccttctcaactgttcttggggcatgtgctgatataggagcaaaggaggctggtgagcaaatccatggccatcttgtgaagattggttctgaatacttggatgttgttgttggaaactctatcataaacttttatgtcaagtgtgggtgcattgctaatgcttgtaggtttttccatagcatgaggagtcgaaacatcaattcatatgcaatgttgatgttgggttatattcaaaatagatgcagtgatgaagctcttcaatttttctccatgatgcaacagagtgggttgcgtgcaaaccgtgttacctttgcaagaatcttgagggggtgtgctgatctttgtgctattcatttgggaaggcaactgcatgcttccattataaaaatgggcctgatttctgatgtatatgtggcaaatgcacttgtaggaatgtataaaaaatctgaaggttgggtggaatcaaaaagaaattctaaagaaactttggctccagaacaggatgccgaagataattgctattcagaacaaagagatataagaagcacacttgaagaaattggattattcacattggaagaagagaaagacaaagaaacttttgctgatgagcggaaggtctacactagtgctgcttctgtgtttggacgtgatcttaggaccgattctatcattgggaattggaagaatggcaggtgcaatgaaagcgggcatttgctaaattacaagagtgcagaatatcaggaaattggaggtgaaccttttaagttgtttgcattgttacaggaggatagcagaagatctgacaaatttgtcctgctggtcatcactgataatagtcacttaaagacgaagggtgcaggttttattaatgcagaactagcgagacgacctggttttgcaccagcacttgactttcctccttgacaaactatagtgcagtatgagaactaccggatccatattatgcagcaaatctgaattgtcatgtttacatattggaaacacatgcaagaaaacaaactatgagtttgcctcatagttgcatcagtaatccccccaaatcaatcattgaatctatgaatttcacacggtgcacttcctgggaccatccaactcagtctctctctgcatttacataaatgatgtttacagcatctttaagcaaaccaaattctgctatgaagttttttcaaatgttggatggcctaggtgcatgcaggatagatcaaggatgttaaccaggttagaataaaattctagtatattttattttagtggtacttgattccagttttttagtattgtgaacaagccattcaggcagtttctttcatgcagggatgcctactcttcaaatattccaaagagaggggaagtagtctgggaaaaatcagcttaagttttgatcactgatgtgagttaatgaacttgagctttagacctttgacagtgcttgaacagcttttaccaataccttgtatagtgtaaaaaatactttacctggttgtcataacttcaatgtgtgaaaatagaaattagtttttcggacagttattttggatgatttcatgcacttcattggtataattatggagctaacaaagctgaaaagcaaaccaaccaattatttcccacaagagtgcacacttatttgactcttgaatctctttctgtttcccatttttcaaaatcaaggctatgttttacatgctcagacctatctagacttgcccttggtcagtctctaccatgttcctggtgtccatacctagatatatttttcctttttaatgaaatgataagatactggtttgatatagctatctgtcactgacattgttgaagaccatacgtttgacgctaccacctagtagttgcaggttcagggtgtgttcggccggccaactacagcggctgtgcagcactgctgctgcagtgactacagtagaaattgtatattgctaccgtagctgctggctgccatctagtcacaccgaacagggccctcaatctcaggcaaactggaataacaaaggctttatgtagactaaatattctaaattaattctgttaatatttgtgctattacataaaaatataaatgattgctattttgaggcttgcaaggctatcacatctaacggaatgctttatttctagcttagctcatttatgtttccttctgacaggtactaattacacttgaatgaaatgagtgctacagagggtgtgtttagttcacgctaaaattgaaagtttggttgaaattggaacgatttgacggaaaagttggacgtttgtgtgtgtaggaaagttttgatgtgatggaaaaggttggaagtttgaagaaaaagtttggaactaaacaagggcagagtacagaagaaattccaaggatatgtattcttttttttcgtgattctgcccatcgtctgaaggtgagattgtaagtgttgtgctgctgttggcctttttccagtagtatctcctctgtagactcccctatagcagtatctcctctgtaaattctctcttgttgaaaagtttatatccttgctaatgacactgccagcatttgcattgccagattgttttgctatatagtattagatgtgttctatagtggcttctgatctgcagatccaaaaaccttttatttacaagttttgcagcttaaagtaacattcgttgaattatggtgatgtgacacttttcatttgtaaaccaatctcagtgttatttagtgggacaaacaaccagttgagcatctttttaaataaacaaaaaaaaatcatatgctgatactttttttttccttgatcatcagggtctgacgaagatacaagctaaagcagcgccatccagtgaaacaacaccgtttccttttctgtatgtctggagcaagaagtatcaaactgttttcctttcatataatctttactcctgcgcaccttattttttggctggtgcgacatgaaatatactgatactaacttgatactaacttgaagccattagttgtccataactccatatagaacctgagctagaggctaaagcctagaggtttagtgacttctgtacgaggtaccatacggtatatcctggattcattccatgttcagctgtaggatatccttcagaaattagttcgaccaataatgctgggatctcccatttatcagtcaccaatcctgctaacccaggttagtcttctttctcatcagaacttggtacacgtctaactgattttttctgcaatattcgtttctcttaatcttttcctgatgccaataaatctctagcagaaattccttcggctgctactttcatcatccatcgacattagaaaaaggcagatccatcaggacgtgcatttgacaatttggccctgcttcaggctgaaactgattggtcccatcaacttgatgaggttatgaaatttcaagatgtgatcctgaacaagattgggacatcaaacttctgtagcattacatccaacaggagctatcaactaccaagtgacttttttttttttttgccaccatcagttcagtggagtagaggagtccgcctcatgcagatgttatcttactgtagttatactgattttaagttgccaattttgccacatcttaactaccatgctgtagactactatgaagtctggacaccccggcaacttcaattttgctgtaatgacaagaggagccctgcgtttcatgtgaatttgatgatttgatcaatgtttttacctgtgactactgcaaatgaatggaacaagaaacgcacgtcttcaaattttttcaggaagcaactggttctcctttccttcgtttcttcaatcctgtgttttgtcagaacaaactaccatgagagctaaaaccctatcgttctacttataatcgtaagataaaacttttatacatgtgtcattagcgcatgattaattcagtattaactattttaaatttcaaaaatgattcatatgattttttaaaacaactttcctatagaaacttttttttaaaaaatacattgttcagtagttcgggaagcgtgcgcgtggataacgagacaaatctcctctcaagctcccactgacgtaattgagttcagtagttcggaaagcgtgcgcgcagagaactagacaaatctcctctcaatctcccactgccgaatgcaataattgaaaagtaaatgttgcattgcacccacagtgcatcagtttggtaggtgagtgcaatttggtgtaataacttgagaaataagcattctagtgcaacaacttgacaggtatgtgcaatttagtataagaactttataagtgatcgtacaaatacaacaacttgcaaggtaggtacgattttgatacaataaattaagaagtaatgcgacaacttaattataaggagcatttttatataaatccaatttttaagtacttattttgacaatatactagcatggatttgtgtaagcatatttatattttatcctattaactaataactgaaagtctatttaattggatgtagaaattattatttttctgttgatatttgagaaggagaaaaaaacaaaaaaaaattcttaaaggtatttggatgtaaattgtatgttcaatataattcttaaagattaaattcaatattataaggtaatatccgtaggattactatgtaatgacatattggcatcgtgaaaagaactcacctagcatatgcttagccaagttgatgcaccaaaatactaaattattaagtttctgtactagaacgcacccacttgtcaagttgttgcactcaaacgttcaattctcaagttcttacactatatcgcacccacctgacaagttgttttaccatggctgcaattactccaaaataaactactatgtcctttgcgatctcacgggctctcggcttgtcatgccaagacggcccattagtaggcttaaaactataagcgcattttggcccagccagatccttggatcggatccatttctcgttgggaaaaagtccacattgactcccttaaaattacgtcgaatctaattcataccccttaaccagaaaactgggtaggatgactcctccaactattaaaaccggtacaatttgactccctcagaggttttagagatggtttcactgacatggcgctttgactcggtccaactggctgactcagcacgtgggacctacatgtcatgtcacattttctttctcactttcttttctctttttttcccctctttttctccaaggccgaaaatttcccctctgcctccgaacgccaccacaaaccgccgccgttcaggggggggggctaatgggcgatcggtcccgccccccctggctcccttctcccccttcctcctccccttctttccctattacagtacaccacaaaaaaatttaaaaaaacaaaaagttagaaaaatttatgtataaaaaatttgaattcaaattcaaatttgaatcgggtatataaacttttgacttataaactttggatctataaactttagatgtatagaaatactatatatagaaaatatttgaattatttgaattcaaatttgaatcggatataattaaaattcaaatttaaatcgggtatataaactttaggtctataaactttaggtgtataaactttaaatgtatagaaatactatatatgaaaaatatttgaattcaaattcaaatttgaatcggatatataaactttaggtgtataaactttagatgtatagaaatactatatataaaaaatatttgaattcaaattcaaatttgaatcggatatataaacttttgtctgctactattcaaattcaaatagagagagatagcatcgcattgatcgatctgtttcttttgtctgctactctgctttcctcctttcctcacttgttattttgcttgcttgctttctctgcaacgaacgcagactagcagtatccaagcaagcatcttcgttcttcatcagtcagtaaattgcaacaaacaacaagaagaagaaattggagaagatgaggtgatgtagttgcaggcattagttggattggagtggatgatggaggatgagtccttgttcgtgctggtgtgcgccctccacccaagcgtcgcagtcacggggttctgcgcagccgcggggactgcccaggcggagccgcggctgggcgaccccgcgacgcgcggcggcggaccggcctccagcggagcggcggcgacctggccatgaggcggagcgacgggacggtggcgtggtctcggggtggagtgggggctggagctccggcccgtacgcggggagcgggggccggatcggcggcggagagcggatgcgctgcttcccggcgaggagcggcctccggcctgtggggtgcgctcgggcaggcgtcgagcgtggcgcagctggtcggcgtgaacgcgttgtggctggtatcaacggtcgtgcaggcggcgttggcggtgcgatgttcacggacacgccgtcccgtgtggcggagcccggcgtactccgccaatggccgcgacacgggcgcagagaagacgtctaagccgataccggccgctggctagccaccgcccactcctaccgtcctggagaaaaaaaaagggaagggggggggggggggggaagagaaatgaaagagatttgaggaaaaacgtgacattgacgtgtgggtcccacatgctgagtcagctggtcaaaccgcgtcaaaacgtcacatcagcaaaaccatcttataaaactgctgagggagttcaattaaaccaactttaatagttaggggagtcgttttacctggttttctggttgaggggacgaattagatttggcatagttttaaggcagtcaaagtagactttttcctttctagttggctaaatggaggcccaacattgttcggttgctcgatttcattcgctatcgcctatgtagcggtcattcttttaacccttcggatcgctatcaattttacatttgtagccctgtatctcgggtaatttttacagtttgacgttatatcgggctctctagaagttaaatcttttcgggtcggtgggtgtaagctgtagctcaaccgtccggtggtctagcacgtcaacacttcaacggtttgtccactcggaaataatcgccgctgattctttgtcgctcaggtttatccgcgtgtatacatgaacctcacatttgtcaatttttccttgctgttcagtaccatagtatacatgggatgagtctcctcggacgtaaagtccccctgtcactgacatgtgggacccacaaaggttgggcccccacgtcagtgacccacgtctctctgactttacgtcagaggagcgcgatccatatacatgaagtaaatctgacagttccagtaactaaatactgcttccagtgattctcaatgccgaattgccaatggtggcctctagccctctaccttggttctccagtagcttaggatttgcatcgaaaggaaatttctgccaactaattttaagcagagaaactcaaatagacaaccattatccatggtgctttcaacagagaaagaaaaattaacatccagggacgaaacaaaatttgcaattcaagagcagctaaaattgcagagcgttcattcacatatgactctgtaccgccaatacattggtttacagccttacagttacaggtaggtagcatcagtatttggaaggcatgctgctgtaaaataccagcattcagcttgacaattgaactgcaaggtcgtttagaaaataaaaaaaaatgaactgcaagatcgcaagctgaaaacagaggtataaagaagggctagtctatcctgtctcatatttctcatccatgcaaattaccgctggcacggtggtgaaggcatacagctctgtttccaccttgttttgcctatcaaaatacgaggggaaaaatgctttacaaacctatgttactgcagcttcaactcttcaacaacccaaggtatcagttcctatgttctttactgtgtcatgctccaacaaccccaaggtatcagcacttaccggtcctccattgtctctgactctatgtaagaatggacacaaccattaggagaatcaagaaggatgtaggcaaaaatctcagtggcacaaccctttctgaagcacttagaatctgcactggaaataaacatcctccctgcgatgcgtttatcgttgtgatctttgcgaggccttcaaaagagcatgccctaacatcctggtccattgtttggaaatagatgttgaatgcatatgatatgttgccgtcatggctaagattattgcaggaggatccatagcccagtggtgtacaatctgcatttgagcatgcgtagtttacagcggctggcaagtctttgaacttatcctttgcatccttgttgaaaacacaccactgtgctggcaaatattccacttcaactccaaccagattgtctaggccatctccactgagatccatagagaactttggttttccatcatatgtgagtagtccccagtgacgttcaaagcgcccaggcagtacactcttctggttctcatcaatcagtgcaaataggtaaacttccatccaaccaggtctgagaggtgtcccaatgtttctgaccatcttcttcagaaaaccatcatagaacttctgtgcatatctcacatttgcgtgtttatcaccatcagttggccaaccaacctcaccaacaatgattttcatgtcaggcacaccagccttccttagtgaccaaacaagggtgtcaaagttggcatcaaacacattggtgtagaccacacctttgtcataaactggcttgctaccaccatcaaagaaggaaaaattgagtgggaagtttggattctggtataggctgagaaatgggtagatgttaacaacaaagggtgcattattcatattgaggaaattgacaatgtcaaccatgagggcattgatatccttgcggaagctcccagctgatggcactggtttattctcaggggagttgtagacatcagcattgagtgggacaactgcctttacatgatcacctaaaccaagtttgtctagagctctttgcatgttcttgagcgcaggaaaggttacattgattaggctgccattgtagctctttagaaaaggctcattgccaacagccacatacctgagcaattaacataaccagtgaatataacaggagagtatcaccaaagacaatgtgaatattcagaaataagtaactaggcaagtacatacattttatatgcaacacaccatcgcccatcggattcatagagatatgctcagtttggcacatcatgcatgataaacttaagtagcacagtaattacaaaaggaattgctagaaagtggagtcactgaaatccagtaggaattaagtcaatgaaatccactgaattcctactgttcttcaccaataaaaacacacctaaatttccacagtaaattcagcacaattaaggattaaaatgctctaaatatcataaatacaagttcattctggcttccgttggcatctacaattagaagcctagaaatggtaatccaattgtcggctcattcctgcgtttacttgctccacattttgaataggtttcctcaatgaactagttcagtcaacatccatggaagcatataaacaccatcaacagagggaacatgatctaaacacactgtattccataaaccaatcaaagcatgtttctccaacatttacaacgttaactctcgaccntgaggtatcatacacaaaacagatttgaggggctgtttggttggttgccacactttgccacgccacactttagccatgccacagttttttaggcatgtgtttggttcgctgccgcaattgtgttatgccacactttcttaactttgggacccacatgtcatgctctcaaatttagagctaagcatgccacacttgtggccaactatttctaagccacatttatgccaccatgccacaactagcctaaacttagttatggcaaggttaggcatcaaccaaacatcccctgatcagtacggctactgctacacacccatatgcaatatatgcatgaagtatgaaactaattgcatgatgcaggatacattactgtatttatctaagtgacacgattgtaagtgatgtctaattaacactcatgtctttcaggcgacaggggaactttaacccagccaccaaggaagcactgcaacaacagaaaactatccattctgcatgaaccacaaatgcaagcatgcatgtgcatctcacactcacagcaccacccgatcagacagacaggcactacacgatcaatcgatcacggacatcacggttacacgaaactgcatgtccaacggtggcattccgtcgaacactttcgacgcgcccgaacagacattccataccctcacttagctcgcacgcccgcgctcagagtaagagccgcgtcgtctcgccgcacgcaacaccgaacacttggcatgcagccgcaaactagaagcacacgcgacaccgcgccggcggccgaggcaaaccatagcacaccacccgtagagcgagcgagagcagcagtgggggcgcgtacgtacctgacgtcgacgccggcctcgaggtaggcggagacgttctgctcggcccagcggtaggcgcggcgcgggtcgccggcgaggcgcgcgagctggtcgttggggacggcgagcatgacctggatgccggtgtgggcgagcggcgcggccgtccaggggtcggcgtcgaacatcttcacccgggcgacgccgttggccgccagcatccgcaccacctcgcacgggagtatggggtgggacgtcatcgtgccccagttgacccccacggccgctcggcccagcccgtcgccgtacgccgacgcggcgagcggcagcaacaacagcaaggcgacgacgccgaccgccgccgcggcggccgccatgggaggacggaggaggtggtgggggatcgatcggtcggagagggtttggagagggtgttgggattgcgggggtttatggaagaagcgcgtttggcatgcttgccttggggttggagccttgtaggatgagagcgtgtcaggagaaacgagggaggagaggagggagaagctctgtctgtacgcaatctggctggctgacaggtggacccagatgtaagctgctgagtttcatggatgataaagagaaaagagtgaagatttctctcgttatatatagtgtttagataaaaaatgttgtatcaaatatttggacacatgcataaagcattaaatatggataagaaaacccgatttacacagtttacatgtaaattgcgagacgaattctttgagcctaattgcgttatgatttgacaatgtgatgctaagtaaacatttgctagcgacggatttattaggcttaataaatttacctcgcagtttacaggcggaatatatagtttgttttattattagtctacatttaatacttcaaatgtgtgtccgtatacttaaaaaaaaattagccaaataactaaacacggcctatcttcttaatcttcttatttctccttctctcaaatactccttaaactctccttttctaacttctatccacttatttttcgtgcacacgcttccctaacttctaaatagtgtggttttttttcaaaaatttctataacaaagttgctttaaaaaaaattatattaatccattttaaaattttattttaattattacttaattaatcatgaactaactattattccgtttttcgtactaggaatgaagatttataaccctcacccccgaactcagtcataagcatgttacttgctccttatgtccttcatctcaaaataagtttatttttatgtattttttctttccgttacaagatttagcgtgaatatacatatttttttctcaactatatagtgtcatgccgatattatttttctcatcttgaatcaaccaaaataaagccactgttaattaaactctgtaagataaacgtaacaactcattttctagccaccccaatatctaagaacgagactcgtgactaccaaagtccaacaacatgatactgtgagtgaggattccataatcatttttatcgtgcctgtccgatatgagtgacgaccatattttcgcagtagtgtcatattgtggggtttgcgttcacgagaatgattgagtaacggcagttgggaaagtatcaaaacaaaataaattaggagggatgtaattgaaaaaaaaaggtcttatatgggtaatatcaaattccgggtgatgtttggggtgctttttgtagtttttcctgtatgtattttaagtaaagaaagaagtgtgcgtggaaagcactcagccttctatgttagactattccttcatcactaatctacaattaagggcttgttcagattgatgacattttcaaccataccatatttggtaaaattgacaagtatgtggctactttagtttgttaccaaatattagcaatgcgtatagaattttggcaacattattaaaccaatcctaccaaaattttagcaatgttactaattttaccaaaattttaacattgctaaattttggtaaggttcattttggcatcaatctaaaccgccctaagagtagcatttcaattgtgggtcatacagcctaagcacacctattaagcctacaaggccttctcagatgggcctcattctcggcccacggcgtggacaagactgttttgtccctaattttccgccatattttttggttggtcggcacctccacggactccggagtccgctcggttcccctcctcaagctcgccttctcctcccctcgcgccgtcgcgcgttgctgctgactccggagcaaaatcgagcgagcgcggcggatcaggtggtgctcttcctgcgccgccgcgcgcgcgccctgttggttttggaacgagcgggcagggcagggcggagccgggagatcggagaggagcagagaagaagctggccatggggtcggtggagcggatcacgtccatgcctcggcggcaggtccaagcccgtggtaagccgcttctttgctccgtgcttccatggccctcttcgttgcactgtattgtgtacattgtcctgacatatagcttgttcagttaaatcagtaatcaggatactgctatcctctttttttttctttttttttgaggaagatatcttttattcttttgagatgaagtatactgcattattcctattgttccgagagactgagacagaagaaaaagtttggtttttcctgactgagacagtagtagctaagtgattcgattagattagctagcttaaaatctgagtacctcggaacgaatgttgctttcttttttctgattgcgcacttcaatttgcactctaccacagaagaataacttgggagggttcttgcccaaaatttgcataagagaaacaaattttatgtgtgcattgtactctcaattttacgctccattatcatcggtacctgccataaccatgatcacatgatgtattgcagatgggtcggttgcttcattggctaaacgaacgggctcaccctgccaacaggaagatgattatgaaggtgccaaaactatgacaaatccatggaccttccttccagaggtataaattttgcatgcatcattgttcacttacctttacaaatgcgatgttgaactgttctctgactcttgtgttttcaggacatctggtatcatatacactccttattgccactaaaagatgccgctcgtactgcatgcgtgtctcacacatttctacgttcatggagataccgccccaaccttgtctttagtgatgcaaaactggggctgagtggcttgtcggaaagtgatgaagtaaccaaggaactcaacgaaaaagttgacctcattatgaaaaaccactcaggcattggcttgaggacattcgggctcgaatattataatttggtcgatgcctcttatcttgaccgttggctccagattgctgttacaccagcaatagaagaactcatccttatgttttttccagagatcaaggcaaagtactacgacttcccattctcacttttatttgataggggtggaaactcgattaagcatcttcgcctcagctactgtgccttccgtcctaccactagtcttaatttcttgcaaagactgcatctgtttgaagtgcgtattactggggatgaattggggtgccttctttccaactcttttgctttagagcagttgaaactcacacattgtaaagagctcaattacctcaagataccttgcgtgctacagaggctcagcaagctgacagtgtttggatgcacaacattgcaagtgattgaaattaaagctccaaacctttcaacctttgattatgatggtaatttagcaggactatcagatggaggtttgctgccagtgaagaacctacacttatcttccttttatcagcatcatactattcaatacacatgtgccaagcttccatctgttgcgccgactatcgaaactctcaccatattttcagaaagcgaggtatgttatgaaacttaagattatatcattagataccagcattatgcacatagcaagagttttttttttttttggctgggccgtgcacatagcaagagttctgattaatatggaattctgaatattattgcagaggttcaatacacaaatttcaccattcagattccttcatctcaagtgcttgacgatttctcttagcatataccgtgggggcttttccccatcaaatgattatctttctctagcttattttcttgatgcgtctcctgtcttggagattttcactttgaccgtaagcatttcttttttcatgttttttctcctgtttgatacaattaaattttgatgtggcaaaaaatacctattaatccgttgtctataatggaatcatttgtaagtattgtttgcttgttcctatgcaggtatcacagactcgtatgaagcatcacgtgatttctgaagattcctcatatctgaggcagatgccaggacaccgccatgtcaacctcaagaatgtgaagatcattgggttttgctctgcaaagagcatggtagagctgacttgccatattattgagaatgcaacatcactagaatcccttactctagacacaatatgtgatgattatgaaaatcctgataggctatctgttcacgaaattggtgagtgcagccccatatgtaggcaaatgatcatggaggccaaaaacgcgctcttggctatcgaaagatacattgtggggaaagtcccctctacagtcaggttagatgttctgaagccctgcagctggtgccatgcctttgaagtttaggtgttaaattgtggcgatgttgaattatgtggtgttgcttaagctaggtgtggcttgtttctttagctataggatgtacctgctgttttaggtcctgtggtattattgcatgggttgtgctttgtcagtgttctaatgtcatgttacatgttcagttatattataatcaagaagcattctttcttctggctatctctgctttatcaattgaaatccacctgaagctgggatgctccatatgatctacgattgtattcatgcgacatgtacatgttctgttcgctcttgtaatttcattgatatttctgttacatgacagcccaataatatcctaatattacttcctgcaaaaagtatatcatgtttaatagtttactgcaaacacagtacaaacgctcgtataaacacctgcatacaaacccataagcatctctgaagactggactaatatatattgagattcacgaagtctacctcattatcgacgggcgtgtcatttaccactaatagaatatttagctatcaatgggtatgacctatttttcatgatgggttatgaatgcattgcaacttttttttggacgaaatgcattgtatcttacactcgcacaaagtgtattattttgaaactgcttctctctctagagatcaacgctattatgttttgcttatattttggtttggcattttcatatttgatcatcagtgtcctagtggaagtccacgagacaatttccctggaaaagataatagctaatgctcaccagagttgaacaagaagagaagcaatcattcattctgacgcacgtgtttgggcaacaaaattgtctgcttttccgaattatttgtcacctaaactaccacaatcaagaagcatttcaaacaacataatccgtacaaattatccttcagcccaagcacaccagtgaaggccttccttgccctgcaggtgatgccatgctgcaggtgttaaaagaccattactgttcgactttatagtgatttaatgttccttaagtgaactttatagtgaattaatgttccaatgttccttaagtgaggtgttggcttgttttaaatcttgtttaacctgggatggagatttgtctctgaagttgtcagtgttgtgtcatgttctcagttggagtatactataaccaataccattcttaaattgtccagctgaagctgtggcttgtcttgtcttgctttctttaaaaacaaggtcattatgcaatataatgatctttcatccaaaaaaagttagatattggtttgatttttcatgtacctgatcatgtcttggttgaagacagtaagtcaatttttttttggggaaaaaaataacatagtatggctcaatggagtcgaagaacatgacaattttaactgatttgccaaatatccattcgcctaaattatagttagacctatttaaaatggactatctaaaaatatgccataagtttttgagtgaaaaaaattagatgtaactacagtgtaattagaatataattactcagtaaaatactataaccatagtttctttcacaaccctaactactccctctgttccacaatgtaagactttctagcattgtctatattcgtaaagatgtgaatgaatctaaatatttacatgtgtctagattcattaacatccatatggatataggcaatgctagaaagtcttacattgtgaaacggaggaagtagttgtcaaatatttataggttaaaaatgtttaaaaattcaacccactctattttaaacctaaaaaattgggcccattactacccctaggtacatcccaaacatacctacaaaagcccattaaggcctcgtttggtgggcttcaaatatcggcccacagcatggaccagcaggttttcgtttcctaattttctgccgtatttttggccgtcacctctgcggattccactcccctcccctcctctcctcgcgcagccgcgccacgccgcgccttgccgctgacaccggagcaagatcgagagagagcgcggcgtatcggggtgatctggtctccccgcgcgcgcgcgccgccctgctggtttcggaatcgaagaggagcagagagggcggcggggaagaagaggggaggtgaagcggcggcggcggctcatgtcgatgcagcaggagcagacgcggccacgtcggctggtccaatcctgtagtgagctcgtctctttgatccatcgccccatcggcctcttcgtcgcattgcatcgtgtttagtgtttctgtgttaatgccctggcgtccatagcttgtttagtataccgctattcttttttagagtatactccattcggttcatattataggtttaggtcgtttcgactaaattttagaaaaatacagcaatgtttccaacacaaaataaacatattatgaaaatatattaaaattttagttttaatgaaacggagtattatactgctgcaccgagacaaaaagaggagggtgtattatactgctgctttgggactgaactggaggttctttactactgttagtggctaagtttgattcgtttaggttaaatagcttaaaatctttctttggttctctggaagaaaaaaaagcttggatagtagatataagactgttgctttctttttctgattgagtatttcaatttgcagtctttaacagaagaatatgcgttcgtgcccaaaagttgcataacagaaacaaattagatgtatgcatgttttatactccattatcatcggtacctattgtcaccatgatgtgttgcagatgagtcggttgcttcactggctaaacgaaatggctcaccctgtcaacaaggcgatgattaccaaggtgtcaaaacaatgagaaatccatgggccttccttcctgaggtataaaattccgatacatcctggttcacttacctttacaagcacaatgttgaacttctctcccactatggtgtttttaggacatctggtatcatatacactccttattgccactacaagatgctgcacgtaccgcatgcgtgtctcagatatttctacgttcttggagatgccgtcccaatctcatcttcagtgcgaaaacattgggattgaatgacaattggttggaaaggaataaagtaataggagaactcaatggaaaagttgaccacattatgaaaaccactccggtgttggcttgaagacttttgggcttagatcctataatttggtcgacgcctgttatcttgattgttggctccagatagctgttacaccggcaattgaagaactcatccttttgctgtttccagaggacaaggcaaactactacgacttcccattctcacttttattcaatagaggtggaagctcgattaagcatctttatctcagctattgtgtcttccgtcctactggtggacttaattgcttgcgaagtctgtttctgtatgaggtgcgcattactgggcacgaattagggtgccttttttccaattcctttgtgttagagcagttggaactcacagattgcaaagagcttagttacctcaagataccttgcctgcttcaacggctcagcaagctggcaatgtatggatgggaagcatcacaagtgatggaaattaaagctccaaatcttttaaacttccattatgagggtaatctagcacgactatcagatggaggtctaccgtatgtgaagaacctaaccatagcttccattcgttggcataatgctatttattatgcctgtgcaaatcttccatccattgtgcccactattgaaactctcactgtattttcagttagcgaggtacattacgcaacttaagattatatcattagattccagcattatgcatatagcaatagtcataccttgaaatgtgattaatctcgacaatttatgcagattatcaatacgccgatcgcacctttaagatttctccacctcaagcaccttactgtttttcttcacacagtccctagggtcgtttccccaacatatgattatctttctttagcttattttcttgatgcatctcctgccttggagactttcactttgaaggtaagtaaagttttcacgtgtaagtaaattttaatatgcggaaatatatatctatcatatatagtggaactatttgttgaaatattctctgctggttcatatgcaggtatcacagactcgcatggagcatgacgtgatttctgaagattcatcacatctaaggcagatgccaggacaccatcatgacaccatcaagaatgtgaagatcatggtcgagctaacttgtcatattcttgagaatgcaacatcacttgaaggtcttacactagacacaatatttgatggaaataataatcctgcagataggctatctgttcacgaagttggtcgttgtggccgcatacatagccctatggtcatggaagccaaaaacgcgctcttggctatcgagagatacatcgtcgggaaagtcccctctacagtgaagctggatgttctaaaaccctgcagctggtgccatacaaattcaagtgttgagtgatacggattgtccaatatttaatcgtgagctgttgcttaggtgtggctttttcttgagctactgaatctacccgttgttttgagttttgtattatttttcatgggtattgtgctttgtttcttaagttgtcacaagtgtcattgttctgtgattgtcattacatgggctggttcaattatactattatcaaaaccattctttcatttgtccagatttacaagttccgcagttggcttgcttgtcatgggtaactggatttacaactgaatttaacatcctctatcctctcttcaattccattgatcgaggcaggagattcttttattttaaatatccactattcgtctttggaggtgtttgtaggggtaggtgtgtgtgtccgcgtatatagatgtgattgcgcgccgtgcgcgcatttatatgagctataatatgcttaaaaaagagtaaatttcattaaaccccacctattatgatccaatttgcataaaactacatgttttgacatgtgccacataacatgtattatggttttaaaatttcacaaaaccacaccattaaccattttgacatactcctatatcaaaatagagaaagtgaatgtaacatttgtatgatggataaaatgctcgtgattgttgaattcaaaattgtgatagcgcaaaatgattagtaatgtggttttgtaaaacgttgaaaccataatatctaggattatgtgtcacgtgacaaagttattgtgtttttatgaaactaaaacaaacaggtggggttttttaaatctactttaaaaggatactccctcccttaaaactataagtcatttgacttttatattgttcaaattttcttttaagtttgatcaagtttataaaaaaatatagtactaccttcgtcccataaaacctgacgtttaaaggttataccagtgtcccacaaaacatgtcgtttgagcaatttaatggccatctgttttgaatttttgaatatgctcatgattgctttgccacgtgtattttttgtggccatagcttcagtgtgcagagatatataagggcatctacaatcaaggatactacatgggcgccttcactaactgaagacactgtgtgggaaacacctcttacaatggagaataccctggtgacccaatgagtatccctaacccaaaaagcctacgtagttattttactgtacaatcctctcttctcccatactccctctctcttccccatatttactccatctaccggagacgacccggcgaaggaagttggttgttgtttgcgaggctacgggctggagacacgcattggtgatggcctaagtattcctattgaatgccttgcactcaatgaaatggcatccgattattattaagtgagggcaacttggtcattttcccttccgctaatttgcttttgaaaccttaaagcgtcatgctttgtgggacagaggaagtagtattttcaatacaaaacaaacatattatcaaaatatattcaatattatatttaataaaactaatttaatattttagatgttgctaaaatttttttataaacttgataaaacttaagtttgacttaaaaaaaagtcaaacaacttatcctatgataaacagggagtagtaaagtacctcctaccgaataatcccaacttcaagggtgaatctacaaaaagcgccccaagcaaatataaaccgccataaaccgaactcttggatccccgaagaagaaacaaaccatttctgggtcgcgctcccacgcccagatccccctcccatttccggaaaaggaaggaagattccgaggcggcggagcggaagggatggtggcgagcgagacgaaccagaaggcggcggcggcggggagcagcatcccggagggggcgcggcagctgctgcacgagctggcggcggggtggggcgacgtggcggactgccgggcgctggaggtggtgccgctcaggggggccatgaccaacgaggtctaccaggcgcggtggccgccggcggcggaggcggaggcggcggggaggagggtgctggtgagggtgtacggcgagggcgtggagttgttcttcgaccgggaggccgaggtgcgcacgttcgagtccatgtcgcggcacggccacggcccgcgcctcctcggtcgcttccccaacggccgcgtcgaggagttcatccacgccagggtgagcatttttttttggccttctctgtttttttttcttcttcttctttcttgtctgcttgcgacaaaatttcttgctgctcttgatttcgtacttggaaggtagtgttcttcagttattcgtattgagtttggaactttggatgggtgactggggaatctgacgcataaattttgtttgcgaattcagagcttttttatttttcggcgagaaattcagagttgtttcactgtttgcaatcgttttcagcctgcatcgtgggaatcgtgtagtaggtagcgtcatatgaatattaatcagttgcctttctttgaaaatttcctcttgatgatgtagtagatgtactctgcagttgtactgtcgaaatttcaacattgaccttcagaaacttatccgggatgttcattcaaatccgtactcaatgaagtcatcacccaattttaattgtggcagccattgtttttgttctcttgttgactacactgtgcctgcctaatattatatctaaaaattaaaacaaaaaacttttcttaatagcttccgagagactgagatactctatccgtctcaaaatataaatgattttgaatggattggacacattatagtattacgaatcagaccagagagcctgatgagtattacttttggcagaaagcatataaattacttgtcctagtaacttgtaagcatgggagggtgttgtcattagttgacatttctgtttcttgggccctgaaaagaaagacatttctgcttcttggagatgactaatagctgtactattttgttttgttaggacatatgaaactgttctcttgctgaataaattgtacaacatgaatcattttctttttccttcataacttcttgacggctttagtgatagcttctgagcctggcagaatgctgtcgttagttagcaattatgcttgctgaagatgtcatacagttcagctactatgtttaatgatggttgtctatgaaattgttttatggtttatcatatttaattgcttatagttcaacgatccaaatatccacatgaaagaacaagtgtgtgtattgtataacgtatctaccgttctacctgcttactgaaacgaatctacctcgctgaacacagccgtgaataaaaaaaagagaagacatagttaattttggtgagcacagccataaggaatcaatttggtgtctgaacacctcaatgagcactggtttaatcatgcaagaaatcttttgattagtaagactgatgaccgagttgctaaaggtcacagaacacggcgtctgagcttcagaataaggcatcagcccgattactttattaatataatatatagggggaaaatatggcatggacaaaacaaagtaggatgggaatgttaatcttttttctcaatttgtttcttcactttcaaaagaaagcatcatgttctgtttgtgttgctgggaagaaccgaagaaggacgattcaaaaacacaaagcattacgatatgatgactataaatatgtttatataggatggtgggtccattaatgttcaaaagaacaaaaggactgatgcaaatattcctttcagacactctcagctgttgatctgcgtgatccagagatttcagccattatagcctcaaagctgagggaattccacaaccttgatatgcctggtccaaaatctgtactcatttgggacagactaaggtattacttaatttgtgtttacactgttttttagcattgcatacttgtaaaatgaaacacatcatcgaagtaaaacactaagttactaactgacaatgcctatgcacatcttcatcaggaactggctcaaaactgccaagaatttgtgcccctctgacgaagccaaagagttctgcttggatagcatggagaacgagatcactgcgttggaaaatgagctttcagaggattaccagtgcgtaggattttgccacaacgatctccagtatggaaacatcatgattgatgaagagaccaaattgctgaccatcattgtaagttcttgctccattgtgtatgtttgattcatctgttccattactattttttgggggaacgagcaagagacttggacatctttatattaagaagaaagctcaatttcgtctagagacatcagaccgaccac

SEQ ID NO: 28276 - DNA, 1925 bp, Oryza sativa
catcatgattgatgaagagaccaaattgctgaccatcattgcaagctcttgctccattgtgtatgtttgattcatctgttccattactattttttgggggaacgagcaagagacttggacatctttatattaagaagaaagctcaatttcgtctagagacatcagaccgaccacaaggaaaaaggagagttaaaccatctgctttgttatttcacatcacacacattgatgcgtcttggtactccgtataaccttatcatacattgagttgtatgttactatctccaggaataaagatttcacttctgaaacgacatactttatgaaagattatgcatattttccttattagccttcatgtatgtcatgtctgtttatgaacctgaagttttatatgtagccaggcgaaattaacaaacatatcgtcttgatcttactggttcctcatcatgcctacacaggactatgagtatgcaagttttggtccagttgcttatgacattgcaaaccatttctgcgagatggctgcagactaccattcagaaaagcctcacatactggactacactaaatatccaggtatttcatattagctgtcaaagttattaatttgtacattattgttctcccttttatccattttggtcaccctatattttctctgttcgttcttgcttatctgcaacagatactgatgagcagaagcaatttgtgcagagctacctgagctcttcaggtaagcatgaagtttgtcattaacatctcattctcccttctctattccataaaaacaataaccgaatatccataataggcgaggaacctgacgcagagaaggtcaataatctgataaaaagtatcgagaagtacaccttggcaagccatctcatttgggccctctggggaataatttcggtttggtttctcctcagtttcacttgcctccaactgtgtaagactgaacaccatgtaaacatccaatttacatcttttgcaggagcatgtcaacgatattgacttcgactacatggggtatgcgaggcagaggttcgagcagtactggctcaagaagcctgcaatcctaacatgtcaggtcgttgaataagcacctgcataacatcaccaggttctaccttgatggatatcccccggccgctgcacatagcttgtttatacataggggatgtgaaaggcttaaccagagatcagtgagatccaggcttctgttgtccttgtatagctgttgggttgttcatagtctggatgggagacaaattaataaatcttactacaaactctcaagggatgtatcctccttgtttgtatgtcatttaaatgattataaagaatattaaaaaaagatcaataagatagattaatatgtgatagatcacttcagaaatatgttctacatggtataacgaaaaaaacaaactaactagttgcagtttaatttttttattgtaatttgtaaaagttgaattttaacttgtatgtttgtaaaataatatatcacatattaatttatcttcttattatttttttaaatttcttttctaactattaagattacatgtaaataacgagaggatgttctctcaagccatattaaagttgctgctatattgatattgctgatgttctgatatgtcaacttacctatcatatatcctatgcgccgctgcctcctctcccgccggccgccgcgcgcgtcagtggcatcaatgtcggcgaaggtgatgagcgtggccacaatgccatggtggtcgacgagccaccgccacaccctttcccggacggtcgctgtcgccgaggtgcgcgcgtatggaaagggaggaggagaaaagcaagagggagaggagggaggaggaagtgggcccactgacatgtgggccccactatcttttattttattgtttgactga

SEQ ID NO: 28277 - DNA, 2352 bp, Oryza sativa
tttttctcctaaactatgtatccgatctacgatccgatcacaccgttgtattcattgtaattaaatctttacaacaagatatcatatgattatattatgataaaataaaaacatgtgtttcaaactattaaaactcaatgtttcatacgtgatagtgatatgattcaatgtgtgtcttcagtatgtttcacaaaaatcatggaactacccgccactactctctctcctctctcccctccatccatctatgtatacatacatttttatgatcttcaaaatatttttttcctaaactacttatccaatctatgactatatcacaccgttgtattcattgtaattaaatatttacaacaagatatcgcatgattatattttgatgaaagaaaaacatatgtttcaatcagttaacatttgttgtttcatatgtgatagcgacatgtttcaacgtgtatcttcaccgtatttcaccgtaatatgacactgagtttgttaagttctacagtatgtcattgtattttgcttaaattctataatataccatcgtcgtccatttagattccgttagtactgtataattttgtcctaatgattgaaatatccctaggacaaaaatttctaaaatttggccgaaaattccgaaatatcatattataaactaggcagagaagttgcccatctcaaactctttaagttttacaatctgtatgataaaattgtacaatgctaacggaggctaactagacgatggtatattatagaagttaagcaaaatgcgatgccatattagaacttgacaagcccaatgacatattgtagagcagggattatattagtgacacacaatggattgtctctgttttttatggttgttcagttaactacctatctactatgatgcggcatttttagaaaaagttaaatcttatactataagtccaaatcttacacattaaattacatacacttataatataatttttcaaatataaaatgccctattctcattttataggagaaatatagaaaaatgatgtattatctatttaattatgagaaatatattagtccaaattaacatatatgtagaaaataaaaaataatatgaaagaattacggaaatacgtactaacgtagtcatcatatataatacaatgagaaaaaaagaccataaccgaatgctttattattgagcaaaagtgatggtattatttttatcatcttttagcggaatctatctaaccatagttaatcagcccgtgttagtagaagtctgtatcgtcatgcatcaacatatcatgagattattagttatagctaggtacaccggcataatcatacttagcatatcacgagactatcgggttatggacaattatctttagttgtgctagagaaaaaaaaagtactcccttcgtcccataaaaaaccaacctaggactggatgtgacacatcctagtaaaacgaatctagacatgcatatgttcatatttgttgtactagaatgtgccacaccagttctacattcgttttttatgggacaaagggagtaaattacaatccatactatgtattcttaaaaattcttaaaagttttcatataatattatactttaaccattttcatttacacaatagctaactttacatttttatttggactaccatattctatccatctccaagtccagtgactcagtaatcatttcgcacattaactctctctctctctctccattttctttttccatccgacagttggataaccgatggatctagcaagaaagagcctagatatagcgccttcgctcttcgtcgggtcagctcctgccttccaaagtccttgcaagctcgacatctccgaccttaatagcaaccataacaatagtgcgcatcacgataggggaggagaaaaagacatatcgattactagaggttaaggctgcgcatgtaaaggcaaagaggaggaacgatggtggctcatggagaaagagcgttacgtagagtggcagttagcggttgctggtggtatgaggaatttgttgtcgacacaatcgtttaattttttcctaagtattgatgatacgtgggtcaccagttatataaagaaatagcactagctagttttaaaatactaccttgtcccaaaataagtgtaactgggaaaatccgtgtcgaatttttgaccgtccgtctttaaaaagtttatgaaaaattaaaataaattagtcacacgtaaaatattattcattgtttatcatctaataacaataaaaatactaaaggacggagggagtggtaaataaaaatattgaaataggggggagtagtcttttttttttttgagaacc

SEQ ID NO: 28278 - DNA, 7499 bp, Oryza sativa
ttttctttgtgatgatcggtttatatgagaagcaggccacagtgtgtgtggatactagacaggggaaatcactgttgctaacaatttggaatagttgatctgtgtttgtcctgtccactaatttcagcattctctttgttagattctccaagatacatacctttgagaaaccaaatgatgagcgtgctttaagattgatgaacgcctgtgccacttctatgctcgaaaagttcccagacatagtcttcgcatatggcgtcagtgatgagtacaggtacaacatcttctcttggaattttcagtttgaatttttccagagtccttagtttgttctttctccaaaggtaaatgagaaacactacacttgattgccatggttaatgttatcattatgtaagagctgtgctgttatattacatgtgcaaaatgcctcttaagtaggtgatcaaagacgtgaactgtagatactccctgttgacatagaatgcattgtcttcagtataattataagttatttgcatctcatgtttgtgttgcagttttgtttttagagaggaaactgaattctatcaaagacgagaaaggtaccatttaatatgtacaccattttcactgagtatcttgaatgtgcttatgtgcaatgttttatgacattggcttttctactaataacttgcatgcagtaaaattctatctttatgtgtttcctacttcacttctgtgtacgtgatgaagtggaaagatttctttcctaataaggagttgaaggagcctccatattttgatggtcgagttgtatgctatccaaacttgaagactatccgtgattacctggcctggagacaagtggattgtaagatattctctccaccaactttttcttgtatagcaaaacagattcaatattcatatttttgcattgtgcaatgatgttctgtacaatgaaaccgttttgtatatcatctttacctaatacggaatcagcttagcaccactaaatatttgtctatgtgttaggagatttgtacaacttatttcttcattaaacagatcgactcagaacaaattcctttgttgtgttttttaggtcatataaacaatcaatataacacctgcttctggtcgttagtgaagtctgggaaaactgaaaaagaagctcaacaagcattgaaggtaatcaaaatgttttagagagtttatatatgcttccaattgcattttaataaatgattgttttctttttgtttcctcttctttctaggggacattttcaaaggacaagaatgagttactttcacaacagttccaaatcaattatgatgatgaaccggctatattccgaaaagggtcttgcgtttaccgagacaaggtaatgctgccaagaaagcaaaacggcatcattattaatagctttgataatactcaacaaagtatttacatagtctctactctctagtaatgcccatggtagtttttttccatacttgccatcagagatatttcaaagaagatttgggaccttgtagtgagacttatttgctagttctcttggtaggaacttggcgagatttgcagttttcagttgtttggtcatgcgtaattatatggaagtggaatggcaaaaaaaaaaaaaagagggggggacagattaaaacttgtctggattttgtaaaaaaggtacttgtcttatagtgataatcagagcaccctttatgcaatccggtgccagttctttttaagttattgatcaaagattatgattcttataacatgattgtaaactgcatactacctttcttttatgggtttgattgtggaacaatcgtagttcttggaaaattttatcttcatcctttttcctttttgtgaactattattctcatccctttgctgagattgactaaccaggaatgaaataacatgctttctgaaatgttaatagttgttaaatgcacttttgtatgctaagagcttttgtatcactgtaggtagaaacaatggtgaagactgatcgttgtggaaaccccataaaaaggacacgcttagttattacaaatgcaaatgtcgatatcataggacccgagttttgggaaaatcatccatatattcttcgagaaggtgagttgagttaactcctgttctctatatgctttcagcaattcagctgcagtcagaactctgaaaatgtacagcatcaatctaactggagtctttggttaaagaaaaatgtaggtatgagaatgttaagaagtttgacatcaaccataggcttccaccttgtaattggactgtcgttcgcatcgacatttgtaaatttgagcagttaggaccctcttgtttcttctttatttgaaagcatgatgcaatctcttttgtgtcttgttgagaactcaaattttctttgttagattctcgttgatccattcatttgacaagccaaatgatgaggcagctctaaggttgatgaatgcttctgcttctttgatgatggagtcattccctgacattgtctttggctatggttttagcaatgagtacaggtaagatatacctccttatgaccttatccactgtcttagagcaaaaacaattgaaagaaagaaaaacctttgcttgtacagaaaaaaaagtcctggatgtcatgaactgaattgattttgttttaatttagtcttcgcaagataaaaatattatgactaataatccatacattaaattgtatagcaaaggtttcatcttagacaaatatttttatatttgatggacagaaaattcatcttttgcaaatgttctttcttattttcttcttgttgtcgcagttttgtgttccaggataagactgaactataccagcgtcaggaaaggtaattactgattttatgcatttctattatgcctgtcctttcaagaggtgccattgacaaaatgattgcaccttcttttgcagcttaatcctttcatcatgtacctcacgtttcaccttgttttacatgatgaagtggaaagattttttccccaacaaggacttagtggagccaccgcactttgaggcagaacttctatgttacccaaaacaaaagatactttgtgattatttgtcatcgagacaagcagaatgtaagttattcctcctaaaaggcatatattctgacactgttaaatgattctcttcagtgaacttcagtatgtattcgtttgttcatcttcagtgaactcacgtgctacgtactatttcgcaggccacaccaccaaccaatacagcacatgcttttggatgctagtgaaatctggcaaaagtgaaaacgaagctcgtgagatattaaaggtcttctttcatcatttcggtttaaatatttcccccctcttgatcttgtttgatgctttggttatctgtagccataactctcttactgctctctgcagggaacattatcaaaggacaagaacgagttgcttttccagcaatttcatttgaattacaacaatgaaccagctgtgtttcggaagggttcatgtacttaccggcaaaaggtaatctttgttgttcccaagaagcattttgcctgacttcttgtattatttccgctgcctgctttgttttccacaagaatcttaactcgtacgtttcaaatggctgcaggtggaagaatctgcagacgcagagggtagagaaaataccacaagagaacggtgggatgtgattgtggcacacgcagacatggggacggaattttggagaaagcatccttatattttaagaaaattggatttactaggctgataaaattttctcatcaaccttttccacattatcttttcgttgttgtagtgttgtatatgcattgtccacactagtagaaaaatggctggcctctcttcattggccattcatctcgttcatttcgttcatgtgcaaaacttgtgcccctaagatgcagtttcagctgacagaattgagaatcgtgatgatatatctgtatcttgctgaatggaaaattaggctcaaacagagaaggggtacacccgtgtggtaatcatttacagttttcaaaagaaacaagaacgctatacacttatgatcaaaaaaaaaaaacgctatacacttttcagaagaaaacctatagctatagtaaatcatccagctatgcatttacctagtactaactccttttttttttacaattgtgaacagcaaaatcaggcaggttattcagcgaccttcagctgaagaacttgcctgcacaatcaaatatatatattttcactcaagttctatcttcttccgttaccagatgatactcaacctctgcatccgtaaatgttaatgctttctgcaactttctgtggcagagaacctcaacatctgccatgaagactgcagtcacagggcggtgatcagaaagcttaagctctcctctcctgtaggaaattaacctgattccctttcctcgtgaaagaatcctatcacacctgaacaggcaacagatatgatttctaagcatgaacttgagttaatcttttaaggttaattatgcaaaaaaaaagaaggcagtgctatgaaaaactaacataccatgctggtgttctccttccagattttggctcatcacttacatacttttctgagtcaaactcgtatttatatgttggggggaagctgatatctccttcgatccaaccatcaaaagtgtgtcctttactcaattctctttttagctgttacaaagggaggaaaagcatgattcagaaatctataatggtaatgaatgtatcacaccatcaaattacctgatcattctcaaacaatccatcccaatcttgcttggagataagttcatgtgctctttcatatgataagttgattcggtagttgagatctccaaaccatatgatccttctgaaaatgatgacatggataaccataagaaatcaagggaaaagatggttatatcgtaagcaaggcattatcatgagtagtgtccagcgacaaacagtagatgaaaccatagaagaataaattctggttgggtgcaagcctctcgaggatagtaaaaggttttcataagacacaagtttgtgaacttgtaatggaaatgggggcgctcagcccttggtcaaaaaaaataaaaacaagtttgtgaacttactcatgacccaatattcccttaggcgtgctaagtccaggaagtgggttaaatactgttcttcggaggatttcttcaacatctgcatttcttttcagttcatcgccatccttttctccagaagttaggtggcaacatacaaagcaaaaatgtgtctgatgtatagacatgctgactgatattgacccctggaacattcaagaagcacatgtgcacggtgcaccaattattttctaaattttgaaaaaagaaaaggtgcagcatgaagaagcatcgtcaagccaatgatttgtagaataacaaagtagatgaaactaaatttttatgctaacatatagagcagatagaaggaagtacaaaccaacaccaaactgattaacctatgggacttcttgactaaatgatttgcgaatgttttgagtgctgttgaattgaataataagagcagtggattaaagttgatacttgccttgttgcccatataacccattgcacctacaccgacagttgatactctcaaattctgaatgtgcttccgcaagtctctccgaacccatattgaaagatatattcccaccatttgcttgcttactattcgcagaaagcatggccttttacttttaatcactccattgtcactgttaacttgatgggataaatcatcatttggaaaattcactgttgatttcaaagatgctggagttgctagagccttcagtgaagtgctagcccgaagacactgagccatcatatccaatggctgttcaggccaaatcattccaagcctttctggatgatagagtaatttggttgtctcttccagttttgatctgtctttttcataacttaagttgggggactgatcagaagtctttactgaatccatcctgctgaaatctttgccttgatgaactcttccgttggaagcagcactgaagttttcatatgttttatcatgaactacatcattgtcaatagctatatcatcattttgtttaatcaatggatgaagctcaccataattgtcactgtcagactcgctaagcaattcatctttcatcaccataacataatctgatggattaaaccttgatggtgaaggaggatcactgtgacatttatactgcggcttatctggacaaatcttattcaaagtttcacgaataatatgctcccatactgcaattggactgttatcctcagaaccaaatatgtttccagcatttaatggaacaatttcttgaaatctgaaagataaacataaatttatgacaatggattttttatatacttcagttgtagtgctgacaacagaacaaccaaccaacatcatgacatacacgaatacaaatagaaccaccaccataccatagctaaataataaaataatgtctgtctcttttgaagaaactgtgatgccaaaataatttcaaatcatgatccagaaacatttttttagttttcaaagataagaagtggagtgcttcatgcgaatctgcggcacaaatcttttaccttacaaaatagggggaaaaaaattgtgaatagtgatttacccaagaacataaatatcagcctgctcctccttatccaaccagtcttgaatgtccagatcactgggtggaaacttgcctgcaagattccatgtccctacacaaatcctgcatatagaaaacagtttgaaacatatacaaaagtatcatattttatttatttcagccggtaacaagtgggttcaattgtagcattaacctgaaatgatttgtgtgataggaatacggtgaaatgagtggctgacatcacattaattaattacatagtgacataagatgataggaacaatactcactgtaactggaagaacataactaggaccaggaaaaaaaaatgcaaagatggagaaaattctatacggctatacctgagttctctgatgtcaatatactgagcgcgaagggtctctgatttgcgtcttctaagcctgtaaggcatagatttaatttcatcccctacattgtgtagttgattgcattagcatataaggcaaacctgccatgtcagttttatcaaacaagtgcttgtgctgcacataaggcaaccaatcagccctgccttttcaaataggcacttaatgtactaaacatggacttcagagtaacttgaaaaaatattgaaagctgaatgcttgctaattatattcaattctgtttcatccattgtgataacatcaaatgtttattaataaaaacaagaaaagcatgatgtactattttgtagaacagtttaaggataaaccgatctagaggcatcatcaccccagggaaactgaaattcgaggctacagtctctcgtatg

SEQ ID NO: 28279 - DNA, 598 bp, Oryza sativa
  unsure (1)..(598): unsure at all n locations
accctgtatgtacttgcctagttacttatttctgaatattcacattgtctttggtgatactctcctgttatattcactggttatgttaattgctcaggtatgtggctgttggcaatgagccttttctaaagagctacaatggcagcctaatcaatgtaacctttcctgcgctcaagaacatgcaaagagctctagacaaacttggtttaggtgatcatgtaaaggcagttgtcccactcaatgctgatgtctacaactcccctgagaataaaccagtgccatcagctgggagcttccgcaaggatatcaatgccctcatggttgacattgtcaatttcctcaatatgaataatgcaccctttgttgttaacatctacccatttctcagcctataccagaatccaaacttcccactcaatttttccttctttgatggtggtagcaagccagtttatgacaaaggtgtggtctacaccaatgtgtttgatgccaactttgacacccttgtttggtcactaaggaaggctggtgtgcctgacatgaaaatcattgttggtnnnnnnnnnnnnnnnnnnnnnnnnnnnnnnnnnnnnnnnnn

SEQ ID NO: 28280 - DNA, 2686 bp, Oryza sativa
  unsure (1)..(2686): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctataccaattcataaatatatccagttttactccctttctttccttttctttcttttttaaaaagaaaaatagaatggagcaagtacaagcatgcacctatcgatatgtatataacttgcttcctgttcagtatcatatcgatcagctagttttatactatctcacactcactcacagtactataattcatcgagtcatacttatttaaaattagttcttaatattttagtcagaacaaattaattagagggcactgtatgattaagtaaagcaaacatagggcatcaacaaaggctaatcttacgctatttggtccattcatatgattgcaaacggcgcgaataaaaattattccctgatgcgaacaataattattgacaaatatagtggaactgaagaataaaacgatcgatcagctagggtagtgttcgtctcctccggaataaattaatacctcgtttccatttttttttttaaaaaaatatcacttaaatcacagcccgttctttctgatagctcattagattatcgagacggattatttattcgttttatgatttttaaaaattattaattttctacaaaaatattttacttattttgttaagaaattccttattttttatttattaaaatatttaatttatctttataacaaatagataatgtaggataaaagtctaaatcaatcggcgtgcaaaattgcataatgtattttcctttcagaaaagaattaaaaaaatgcatagagcttctggagcaagctagctagtagtattctcttcgtctcaaattatataacatcattatctaggaatatcaaacttgatatttttttattaatgatcatactaattatatctatgctaaatattatacatgttatatcactaaattcatattttaaagtattttaatgtaatgctaatttcataggaatatgaaataaattattgatcaaagcatatcattaaaatctttttaaaaatatagaatttataatttaggatggaaggagtagtaagcattcatttttgttagaattgacctgcattcaatagtagtagtatggtactcactccgtcccaaaataaatgcagttttgcactattcacgttcaacgtttaaccgttcgtcttatttgaaaattttttatgattagtatttttattgctattagatgataaaacatgaatagtattttatatgtaactaaatatttttaattttttcacaaatttttcaaataagacggatggtcaaacgttgggcacggatatctacggctgtatttattttgggacggaggtagtagctgtaatacgcgggagatatattcaggtaaatcccatacgattaggacagtgaccgacgtaatcaattctgtcgttcgatcgcgataacgcacgtattttgagggacgagaccgccatgcttgacctgaatcggttcgagtccgacccgtcgtacatgttcggatcgcgctgacgaactggtctccatcgtttcccggatgtgaatgcaggtcgccatcaatcaatctgtttctataatctgcattcagtttcggccggccgctccgggagtgactacaacgacgcttaaattggtgaggttttctccaaattcagtctcaaaatcatagtcccaaaaagatacacatattattaatggcaaatccaaaaagaaaaactataagtcattttgacttattttcttgtttgatcaacttcatagaaaaatatagcaatatttagaacaccaaactagtttcattgaatatattttaatagtttgtttgttttgtgttaaaaatgctacttaagcttggttaaacttaaataaatttgattagaaaaaaagtcaaaataacttaaaatatgaatcgtatgaagtatgaaatatttgctcgcaatgaaaaacattttaaatccattgcacatttacacttcagaccgacgagccagggcactggatggtggatcctcccctacatattttgcatcgctgaattctaatatccgagcacaaaggccggaatgtttattctattattaaaaaaagataatgctgagttcataataattaattttaaagatgattcataataattagtagatgacacaaatgaataaagtattaattgttttaaaagttaaaaagaatgataacaaaatactttaagaaacaccgatgataatttcttataaaaaaaaccccaccatttcagcttgcaaaaacgtgccatgataatccgaaccaatgatctacaagtatagagaaaaaggttgatgatgaattgatgatcttggcatgggctgcatcgatctgcacaatctgccgctctgaactttctgaagccgacgaacgcacgcaacaaatctgaactctgaatcttttcttacgataataatgtctgaaactctgaattagccggcgacgtaatggacggcccatttcgccgtggacagatcgatggatgctgggtgatgtggagtggagatcctatgctgtaatgcacatgcggtgggtgt

SEQ ID NO: 28281 - DNA, 2466 bp, Oryza sativa
acacctactagaggtgcagtacagcagacgatttgccctgggtgatgtgaggtcactcgccatttcgccatggtgattggtagtagatcggtgcatgctgcatgggcatcatggccgacgaggcaggaagcatctagaacacctgctgctccgctaagggcacccacaatggttatctataggctctctataagagatccatgtcagcatattttcctacttagaagagattaaatgaagagagagagcaaagctatctactaacctggagatagtctatagagaaaaacgagacaatgtattagagagctatagatacccatgtagacatactattgagatggtttactattattctagtctattgctgagatgtacatgttttatagataggaccttactttaccattgcgggtgctctaataagatcaagtataatagtaggttataagccggctaaatgctaagttggaggaaagaagagaggagagagaggagaagcgggctataaacttatagccggcttggacacaagaaccaagaaactctatgagagagacaagtgggccctgtattaattgtgaagagctaactattatataggtaggctgagagaagactataaagaaccttatagccagcaggtcggctgtattattagccttgctctaacctacagagattagcttgctgcaaaccaacaaatcgctagctgctgcttcgcttttcccgaaaaggcaaaagcggaggaaactctactctgtccaccacccacatatcctactaatatctcatcatgcatctcatgtctggataagtcattgctaatttgatactgtactagtaaatccaaggaaatttgttcatcagttcatgtgatggttgagcaggtaaatcgtaatttattcacttattaatgtgatatagtcctaacggttaggttaaagacaggccaggtgtattgcgtttcatcattttctgtttctaactgctctgcctgttcacttgtgtcctggaataattaactttggccattgaccaacgaccctcatattagcattggatcgttaggttgatctggatcgaccggtacggtgatccaagaataggtgttgtttaattggagaagttgacttttctgacagcccttgtgtgtacactacatcctcccatacttcctgtagtcaaatcggggaactcaagcttctgcaatttagttgattgatcgaattaatcagatcgatgaactttcaagaaaaaattaatgagatcgattgttcgttgcaatgtcagcaggtaacaacagtgccagtgccgacagctggttaatctgtcttgcaaattactactacctccgtcccaaaataattgcatttctatgatttaaaatttattctaaaataattgtaattctagagtactaattgccccatcaatcatatctcattcaaatttctccctattttaccctcaactatcttcccactctcacataaacaacatttaatgagagacaccatagtcttttttctcaaaccttaatatatgctaaataacataaaattgtaattattttgggacggaggtagtactaattggcaatttaaatggttgcaagatgcacatgattatcttaagaaacaaatttgatttgatttaggtccaacaatggatgcaatcaccactgcccccatacatgatccatcactttccttcacttcattatcacaaggggaccctcaccctaccaaagaatcaccattaatacagtagtaatagtatcctgttatttaaaaaaaatgattgaaatcggggcgcaaattattgcgattattattggtttcgaattaaaatccccccgaattttgaattccaacttggcaatggcaaccactctccccccaataaatagccgcgcacccgctccccctcacccgctcgctgcccatcacttcgccatcctcgccgacgccgacgccgacgagaccaaccaccatgtcgtacagctacgcctcgcggcgacgtggcgggggcggcggtggagggatggccgcgacggtgcttgcggctaaggtggcgttcgcggcggcggcggtcgccggggctggctccttcgcgcgcctcgccgtgccgcagctcgtgtccgtggccggcgccgtgttcccgcgggtgtgggcggcggcgagggtgtggctcgtgccgccgtacctgttcgtcaccgtgcacctcatcatcctcgtcatctggaagctctccgaccacaagcacttccaggcgcagcagcagcagctcaaggatccatggccgcacccgcatccggctgttccagtggccgcggcagaggatgcgccatcgcttgttgtcaagcccaaggaggagttcaacgccgcggcggccgtgtacggcggcggctgctgctgctgcatgccggagcactaatcctccccggagatctccccggactcc

SEQ ID NO: 28282 - DNA, 7952 bp, Oryza sativa
ctgccgccgatgacgacgacgacgacgacctggacgccacgtggaacgccatcatgcagaagacgcgcccggccaccgcgccggcaatggcggcccctccggcgcagaaggcgcctcccgcagggccgccgccgccgcgagcgcgcgacccgtcgatcggagcggaggagatgaaccggcgattcgacgatttcatcaagaagaatcgccactccttcggccggcaataagctccctccgatccactcccctccgccgtacaatacatatagaaattttcatcatctttggtttttcattgttcgccgaagagatcgccggagcggaggaagccgggctaatcgtatcatcatcttcaggtaacttacattaaaaataataaataaataaatctttcattcaatctagtaacttaccattaatataatcaaaaaaatattaattaccatttgtagctgttcgcaattatattaattacaatctcttctaatatatagacgtgcaatctttacgtatttgcgaaaaaccatttgttgttgtttttggtaaaaacacaattattttagaagcttaaaactcaaattaaacagtaatgatcagttaatccatgattaattcgttgatgcttacccggcatgacctgtcgtgtgcgcgtgctcggtcggttgccgcttaagctgttggcgttgtaactttaagtaagaaagaaaaggaaatggtcggcttcggcactcgcagtccggcccacttctttccctttcggtgccattaggatctaactcgtggatcatcacatctaaagtttgattatttccacgttgatctgacctttagttttgactgtgggtaaattttgtttctgaatttctggatcttcagtagttcactgaatacagggtaatggcaccctttatgttgaaaaagaagaactaaagaagcaccttgagttacaagcatcttccttttttttataggttctttgcttcgaataggaactgtacagatcagaaagcacatgcagttaccaatggttggatgtagactaataactccttttgattgtgtttgaaccagcataattttcagtcacttgggagttctgaaatttcaaattcgactgtttttccatgaaaacaagattcctattgtgacatgtgtcattgacaagtgggcaggaccatcaaattgacgattttgtttccatccatcttggaatttgcaggatgtggaggttccagaatgaatggatggatggtggatggtggtgctatggaagctgctagacagatgaccttaatgtgctgaagtgatggtttttgaattggtactttgttgttaggctctcctttatcagctgtggtggcctggcattttgttcttagctttctctttctcctcctttccttttcctacagctcttttactgattataacagtgctaattgtccaaagttcctatggagttaattctggtgggtagtgggtgtgcttgtgattatatctatactgtttggatgccacattgtggctgtgttgtttaaatgtcagccacaggtcaatgaccatgccaccaaattggtccactgttctaatgttgctatctatttgctcactgtttgaaatggataaccaacaactcatttgagtaacaaatcttagatgcatagggtgctaataatgaggagaaaaaaaccccacatatataatggtccatgtttgcatatatacaactcataatggtcaggaaagaattgatttttttgatgtgaacctttctcacaaactattccttgattccttcagtccttcaatatgcagcgacgaagaaatcctaagtggtgaaaaatcattgaactgcagaggaccaaagactttcttgaaatgtaaaggctgcaactctctgagatgacaccaatggaacatttctgtcgatcttgacatatgatgcccggagagcatttttttcagagtaatgtcgagattttctgttgctatcagtacctgtacttgtatatgcgtactttgctctgaaaaccgtgcagtattgctttcagtatgacataagcagaatcaattcctgatctgttgaagtagtagtaatactagtaatactggtcagtagtttaagtcatcatcttcctggagtactgattattattacctgatacctcataaagtgcatcaatgatgttaacttgacaaaatatattttgaagattataggagtatatgtatttgtatatgatgcttctcatcagctgatatatgctctctatgttagtattattgtttaaccacttctgtccacattcaatccagttacttctgaaatgaggctgatatgagtatttgttcataatggctactgaaagtggcatctgaaccacttcatcggcatggcatggttcctcgcatcgcactgccgaaagggccatgaaactgaaccatccttgctacaagaacaactgaatgattgtgatttggtaaggcagaacattgtatatattgcgttgcgtgaaaggcagctacaagttccaaattaatctgctttttactgtctcatcacattttttctttgtcacagtcatctacaatcggctagcttacacaccagatttccaggcctgaattcattctcatgaattatcctatcactcctggctagtcctcacaaactccattatccaacatgactggaacttgcacttaaatctgtaaaggctactactaatcctactacccctataccacaagatgccacacaaatcctaattgttattgcaacttcagacaccctgatcatccctggtagtaacacctgtgccatggacaagtctttgcttaaggtcagtaggcacacttagctgctgccctaggcttcaattatgatcactaaactatgcaagagcagggctttgcacttgacaaacatcagaggagcactgttatggcgaccacacaaccaccatctgataattttcagaaatttcttttacatatctttctgcatgaacagagcctagagctgagctaccagtggtcctcatgccagcactcaccaccacaactgtatacaatgtaaaatatgcagaatgcagtgtcatctgcagttcttgttgtgttcttgcgttaacctatcatgctgaaagcgacgggaggagtggaagtgcagtgaaccagcagaggcagcagatcacgaggcatttgcagggataagcagagccagtgcaggaaatgtggtagtgtgaagttgctgccgagaagcatcagctaaagcgtcgccgtcgtccccaccaccgccggcctagctagggcttgtcgccgtcgccgggaatttttagggtgatctgtagccgtcgaggcctctggtgcgttcggcagagctcctcgtgagcctgtgttgtagtgtcactcacggctcaaggtgaaattataaatggtgactcaaaaaactcatcgtatcatccatatatatcagatatgcagatgccaatctgaaaactgttcaaaaattgatgtgctaatcttcagactaaagtggacgttacactggacggtaccacaaatggcaccctgtttatcgaaactataattcggcaatatgaaaagggtaacgcacaagaaaaaagtggatgggttatgagactaagagtttagataggttcagacctaccctactcctgtttggagattgaatccgccgattgtagtattaatctgatgatcttcagtgtggttatgccctaaagggacaccctgccttccttatatagtcagaggaggcaagtttacaagataatttacatttctataactactttacaatcgtaccaaactaagaacatgtttccttgatacacaaataaatataacacccaagtcctaatcctatacatattctattcatatgatctatcccatatagtcagtcggatagtgcagccatgtgggtatatgatacccataatctctacactgttctttatagatatttttctcagggttttcttttttttgctatggattatctgctccactcttggaaaaatacgatttctcaaataactttttctactgcattgattagaccatccattcgagagtttatcgcgttggtcaaataaacaatccgcactaataatcaggagaaaaagctatctcaaaccagggtttgcaaaaccgccggtaactgtgcggttatcgcggggtacggtaaaaggaaaaccgcgataacctccttaaattcaaataaattaaagaaataatttaaaattttgataaattttacatggtttcgtacggtttgctacggttaccgcggtgcttaccgccagggagcgataaccccggacccggtggtttgggaaacactgtctcaaacaggggcctagtgatctatactgttgttagtacgcaccatagatggagtgagtgattttggatgcgtaaagacagctatacttatctgaagttctgaaactgttcgctgttgtacatgagaaagtttgggtgagttatcactgaaaaagaaatctttaggcgattttggaggaagccatgcacaggaagatactcccaccctcttaaaatataagagattttaaatagataggacactttctagcactacgaatctggactaaatctcttatattttatattttgagaggaaggaggaagtagttgcggttggagagtgagagtgtcatacattcgatcggcatagtcgttgtcaggccaggtttgtgtggctaataggccatatgattgcatactttgccatgctgatcaaacgaatcggatcactcagatggttgatttggatggccatgcactagatttttttttcctccttcagctcttgaaacagctggtgaggcgccatggtccaaaaacaaagtcatgtcagaatagtcctgcatatccaaacaaccgtttaggtgcgaacctgtataatcagatgttaatcccaacgtttttacttttacttctaaaatttattgttaattacttggaaaaaaaaagaaatgtaacataggatttggttttcatgacaacttcactcattatcgttttcacatccaactacctatacagatgatttttttatatatacggcttctatacctataagtgggaatacgcagttagaagttataggaatacttagactccatgtctcataactaaggaacaacacaataaaataacaataaaaacaaggctagaagataaaacctcaaatattcttcggtcattgctttacctagggttgccgccgctccgcctagccatctcagtgacaagtgtcatagcacggtggactctatggctgcacatcgctggaacacgcccctccaaaacgcctggctaacttgcaaccgcctccactatcaactcccttagccaccaccatatttattacaagccttgtaggaagataatttttttaggcgaattttgactgagacttgatgtccatctagtgttgatcctaggactctagccttgggctttgtttcttctagaggattaccattttgccaaagctaatcatgaaactccatccagctttggtgttttcaggtgtttagtggagctttagggtatgagattgaggtgtttgtacgatggtgttttcggtttgaacctttctagggtcgatgtgtatctcttctttatcaatgaaatagactgcacgtagcgcagatgccatggtgcagccgttgtgctctccgcgacctgcgtttgactctggccggactcgctcatccccttttttaataaattcgacattggtacttccccagtgtctagcctttttttttaaataaggcagtgcctctgtcattgtttctaaaaaacaaaaaaaaaaccttcacttcagctcttctcattgtcaatctagcttagcttttttttaaaaaaataaataaataaataaataaggcagtgcctctgtcattgttaaaaaaaaaaaccctccacttcagctcttctcattgtcaatctagctttttccctagggaaagtctatgtagcacattactaaatcaggaagagcagtatactctttaaaaaagagacagtgaaaagaaatgtatatgatatggttcacatagggatcttacagaaaccgaagcaaacttcttcttgtaaaggtgacaagcaaattgtaaccagtcataggctctatgatgatagatgtttaaacactgaagctctatgtttcactatgttgtcttcacacgatacttttgatcctatgctttagtttgtgcctatgaagctcaagttaaaatagggtgcacttaggtcgtcacaccaacactccctaaaatcacaatccatcctgttgaatcgaaaggatctagcagacgacagccaagtccaatcacaacattagctgtctaaaatagtgatcaccttctctgattacaattgttcttacctagttacctccatggctccatgttaccaaagcaaattttcatctttctccagaaacttcagcaacttcagaagtaataatcccacagcacaacagcaatataaacgaaaccatcggttgctctgcaacaaactgttaaaggtacaacacaagctactaccgatggcgatggctttaagactttcagctatgagttaaaggtagtttctatctatttcgctgttgcaatctctgatgtggactattatttggaaaaaaaaagagttactaaataataatccatagtcttgtacttttatctatgaagttaaaagtgtggggcaacacattctccaataacaaaaatgcattgccttgtaatgaggctttcagatgatggtctcaagacatgaagctgccattccacatcaggttttcttagtcagcaggctgatagcgaacccgcattcttcgctgttgttgagatcatttttgcagctgcagtccacaataggcatgatgacattcggcttaatggccttctccccacgaacaaccttcaaaagagccagcacagtagaggcataaggcaacatatatggaaatatcagcaatacaacttcaggaaaatatctatacatttcttggattttctcataaagattagccatatgtagaaaccagaaatccaatagattatgggggtgacaaaaggaattcgggttacgatcgacgtactaatttctcagactccgagcttttgtagatgatgaatatgtcccctgtctggagaccatgctgcttcacaaagccacctaaagagagcaattcatcagctccagtacaaactaagaaaaatccaaaagtatatgtttcaatgtttaaacgtacccgtgctttccaagacatacattctgctcttgttgttgggccagaacctgaaaggtatctcctatgagtaatatgtagcggattacaagccatatatgtttgtgtttctcgcatgtgacccaaataattacgaaaaattttgaaaaaaaaaagtgacaacgcagatgattgtatcacctattgcttgtttgtaaaggtcaaatttttatctacagagagagaaacagattaacaaagtcaactaaaaatgtgattgcactttccatagtctgatttgctgtactgtttctctatgcgtagatcaaattgcatatctgtgcaccgatagacaacaccattatatattctattctatgtttaagattatttataactatttggattgcatgctgaaatgaggccacatgcacttgataatgtaaaatactttctcaagataggattgaattagataatactacctccgttttttaatagatgacgccgttgactttttctcacatgtttgaccattcatcttattcgaaaaatttacgtaattataatttattttgttatgcgttcctttatcactcatagtactttaagtgtgatttatatcttatacatttgcataaaatttttgaataag

SEQ ID NO: 28283 - DNA, 344 bp, Oryza sativa
cagaacatcagaaacctgccagtttgctgcagcctttgaagattcctgaatggaagcgggaagaaatcggtatggattttatcactggtttacctagaacgtcatcgggtcatgactctatttgggtgatagtcgacagacttaccaaagtggctcatttcattccggtaaagacaacctattccgggagtcggttagcagaattgtatatggcaagaattgtgtgtttgcatggcattcctaaaaagatagtgtctgatcgaggcagtcagtttacttcaaatttttggaagaaacttcaggaagagatgggttctaagctgaactttagtactgcttatcat

SEQ ID NO: 28284 - DNA, 58007 bp, Oryza sativa
  unsure (1)..(58007): unsure at all n locations
agagatcagtcacctggtaatgaagaaccgacaacaagcaattcttcttcgatggctcctacaggccgattatattcatctgtatgtgtgacacaaaccaataagattttatctacttttgattttctgttcttccttgtcaattcattatccacaatgtttcttttctatatggaattcaccattttaccttgattgtatcatctctaaccagtatggaattaaaatatagtataaatgaataaaggaaaacgatgtcgtaagaattcaacatgtattccctccgtttcaaattacttatcgtttttgtttgtcctaagtaacattcctaactttgactatcagtttctagaaattcatatagttcaacaacatgtaaactatatattatgaaagcatttctcatggtgaatctaaaaacataaatcttatcatgttggactatataaatttttaaaaattaatagtcaaagttagtaatgtttgacttaggacaaaagctaaaacgacgagtaatttgaaacggagggagtgcttgttttatttaagagcagcaaatgttgcttaatgggttatgtctttatctcatggatggatggatctgttttttgccccttagtttctagttgttgaattagcacatactgacttctgttacccagcttgtgtatgtgaatatcatggaccaaagatagggcttaacaaatccattctataccttgaatattcaaccaaagataaatcaacagatcatgaatcttactgtaatgaagagctgtaaaccaactttgttttggcagctctagcttatacctggaaggttttgccgaattcacctattttcatgtttgatcttctcttgtacatggagagtcactttctgtatcttatattttgcagagaggaagcagtcaagctgctgaaactccaacgatagcaagtgatgaggatgttctatctgttctaatggagcagcatgagctatttctaagctcaactcgatctcggttgacaaaattgcaggtcagtatggtactttgcattttctttaagatccccccccccccacttctagtatctttattctcaaacttctcaatggtatttgagttgattaataagatatagagatatggagaaaaaagaggtaggcatacgttgtgtcctattttgcagtgttctagtgtacgacaggctgttgatacttgtatactttatactgaaatatgacctgttgaattagctaaattgctctgttgcattctcagaattttcaatactaaaatctgtaggctttcaaaatgcaattgctcgaatgctgtatctgactattttaagtgacttgcagattgttcatcaaatgtggcaaagaaatgatatacggggcattattgcagcaatggagaagatgtctgatcatgccgtcagtactttgaacatttctcttccgtgtgcagtgcactaaacaacatagttataacaacctgatttctggcaagtgcaggtatctgctgatgttgcaagtgttctgatggagaaaagtgaaacaatcacactagatttatgtactgttattctgcccgtccttactgaccttctggagagtaaaactgacaggtaacttaccgctgcttttgttattattatgatcctgttgtgggagtatatagaaatggttagagacaatttattcatatgtatgtaccgtactgcactgattgccttaacatcttatatgccatgcatttatttattttaaattgcaattaaaagtatttcttacaaaagctaaatctacacaggcacttaggtgtttcactggaattgttggtgaagcttgtcaggacgtttggatcagtaatacattcaacagtatcagctggtccctcttctgttggtgtagatctgcaagcagagcaaaggtattatttcagtcagactgtcctagtatgctacagtatattgctagaactgtcctcctattatgttatattgctagagtattactaactcattgatagattcagtaatgtggtttcttaactgttttttcatcttaggcgggagcgttgcaacctatgctttattgaattggagaaggtcaaaaataagcttccatttctttccaggtatgggatgcaatacatatgatactttactgaaattgtactttttacctgaatgaattatgtaagtgcctatgagttatctggctgaaacggcacctgcatttactgcttgagaataaagtttgagtgccagttgctgagttaaaataaccacgcaaaacaatgcacaacccacagatcagatctcgtgaattgctttctctggctgctagaattggcactttccagtggatcttacgttttcctgaattaaatgcatagctccctgtcacttgccgtttggttcatggtcactctttgccacacctcaacttaggtagctttggccgagatagttcattgtcacgcttgtggcaagatttttttttaagcaccttggtcccacatggcattgttcaccatattgtggtgccaaatttgttcgtctaaccttagacaagcttggcaagaaaactatggcaaccctaggcaatgttataatacaaaccaaacaacgaatgtcaggctatcatgattctgtggtatgtatttttgtaatctttacatgttttcccttgtttttttcaacagaagaaaaggggcagtcgcaaacacggcacaggagctcagtcttgtcttccaggaagttatgtagttgactgaccacacactgtcatacatacacaactgaatgggaaatgcattcccgctgatggcaccaatgttgggcatcagttgccatggagagctgttcgttcgtgcccagtcaccgagctccaaggcacagcagcagtggataacattttgttgccactgtttgttcctcttgtacacacactaaccaacagtgctcgagatccttgtctgttgtcacttttgaagggaagctgccatgagcggtgacatctgccggcagcgttcttcgcgtttgtctcattggtttctgaagataccagtttgcccttgatagatgtggatgaccgtgagatggagcgaatgtcagcgattgtaatgccttgctggctgtagcctcttctctcgtgtcttgtgttagcgggttgcatttgatagtttattgtttggttgtgatgtctggtcgattcaatgacaagattgatgaagagtgattgagctccttgtacacctgtacatcagttttcttttgaatagtatttgagatctatactcttgatcgacacctttgttactcgttggcttgtcacgtccctacaacagctaatgtctgagttttgatgaaacatttctttgcttgtaagtgagatatgccctttggagtattatctggagggtcatgaacatttcattgttaagcttcatcttctgggtaaaaacacaactgtaccttcaattttttttcagggtacagaacagtaaactcctgaataattctgctcacattcacaaaatcaaacaaaccaacatacaatctcattaaactcgtaaccacatttcacacgacaaaggacctaccatgcaacatcaaaaacaccatataattaagaagactagaacaacaacaaacattgggcctaaacaaattaattcgacgacatatatgagatgagaggcactcatgcaagtgcagcatgcccctgcttattcccttctttaccaagcaggcaaaacaagctaattaccatgatcaaggctactacgaaaccgaaggattcgatggatgaatcgaatcgcggcaagaacgagctagccgcaggtggggatgcaggacttggagcacttggcggagcacttggtgtgcgccgacatggtgcaggtcttgccgcacatgagcctcttcttgtggcactcctccttggtcacgcagctcttcgacttctccgcctccttgccgccgccgccgcctccctccttgccgtgctcgttgccgccgccgccgccgctcttgtcgtccccctgcgtcgcgatgaggcggcccgccgtcttcgtcttcgcctcctgccgctccagcgccaccggcatcgccgcggcgcccgcgtcgccgccgccgtccttcttctgatcctcggccgccgacgccaccctcacgccggccgcggcagcttggcccgccgcgatggtggtggcggcggccaactcctcctccacattgtgcagcagctggtgggcgtcggtgtcggtgtcggcgtcggagtctgccaggaggatccgctcgttgtgcgtcgcctcctcgtgcgcgggctcctccgccgccgtggtggcggcgctggccgtgacgacggcgagcatgaggaggagcactgacactaccgcgaagctggagctgcaggagcgagacgacgacatggctgcctttattgactacgtttccttcttcgcgccttgggtggtgtggctgcgagaagctggggttgctgctcctatccgtgtttatagctagagctcagcatgctgcgttgctcgataaatagcgatgagatcgatagctagcttagctgcatgagcgtgcatggcgtggcgcaactaaccgagaatacttcggtgaggagcgggagatgcatgccgctagatgggaatggtggcaattggcgattttgaaatacaccgttgcctcatctttttttcatcattacactcctttttcacactgtaaaaaaaaatcggtgttgtggtgttaaggccactccccgcgactttggtacattttcataaatccttcgaaaaacagtaatccattcatttcacaatgtaagtcattttagcgttttccacatttatatttatgttaatgaatctagacatacatcaatatgaatgtgggaaatgatagaatgaattacattgtgaaattgtgaaacagaggaagtatatacatttaaaaaaatatgaaaggaacaatatagttttaaaatttaatctagcaactgctaagcaagaaaattcccatgaaaaactgcatgggctttactggcagctgctactgttaatctgaataagttactcacaatatactgcatctatctatctactcaaacgagatcaaccaaaggataacattattggtgccttttcagttaacatggactcacctaaatatttgcggtgttaatagagttgccaactaacttaatctagaaaagctcgtgacgaagatgggtttagaaaaaaaatcaaaaccgattaggcggagccaatttaaagaacaaaccagtcttaagaccgatttaaaatcaatttagagataactacatgttttatgggctaatcaaaaagtttacgggacaaccctagaaaaatatcacactcttgcagcaatgacattcttgtcccatcaaccaaaaggagtctgtcagcgcgattgtctttggacaacaattgtctaccctcatttgttatgtttttttttttcttttcgctgtctctttataagttatatcaagacatttgagtatgtaactaaatctcttctttttataaagttaatgtccactaaacacttaatgtccatcattagcaaatatttactgtggcaccacattgtcatatcatgacgcaattaggtttaaaagattcgtctcgcaatttacacgtaaactatgtaatttatttttttcgtatatatttaatactccgtacatgtgtttaaacgttcgatgtgacgggaaaaaaaaatttgccggtggatttaaacacccccttaatgtcgatgcaacagtactcgagtccttggcgggggttatattttcttggctactccaattagcttgcagatctggttggatttttttttattgtgagctagcttaatttagtcggtattgcgagggtaatgttgaatgtttttttttcttaagggacacatcatgtctgatattgcggttaggggtaaattttagacttgacgataaattaagggatctaaaatgagcttattcctctctaaaaagcccatccacttaagaggggaaaagtatagcccattactactttgcgcggctgatggcggatggagggagccgcaactgaccgtggtcaaactgtccaaggcacctttggctttttctttagctttaggaattcacccagcttagcttgctttaatgttgtagtataagctatgcatgcgatttgctagtttagattaaatccactatcacaacgagaaaatcaaatactcctttagttttggcttcaataaacatgccacgggtattgacctggcctaacctaccatgtaaagaactccctccgtcccaaaaaaaagtcaaaccctaagtttccgtgtccaattttgactgtccgtcttatataatttttttttataattcgtatttttattattgttagatgataaaatataattaatattttatacgtgacttgtctttttaattttttttataatttttttaaataaaacagacggtcaaacgttgggcacggaaaccagagtttgtctttttttttttggacggagggagtatgtactacctgcttctgttttgctgtaaaattattttattttcttcgatgttgttgtcaaggtcgacggtgactgttccaattctagaaccatgcctacgaaacaaaaatgatcgtcaaacggattgagaaattccaaactcaacagaaccttctcctcttgtaacaaaggactaaagaagtttcttctctggtaataaaagactaaagaagaagaaaagaggacaaaagaaagttccattcttgattctttcatgcgcttattttctcatcaattaagcaagccaattgtgaactgtctcgcggaagaaaccatttgttatacaaaatttacatattttttcttttttattaaagaggtttctgataagttgacttcggtgcaggatgatcaatggacgcaaccacgtctgcccatcgcgtgtacgtacactgttggtcaatcgtcacaagagaattcgaactgcagattctttctaaattttttttggcaaaacaaaacaaattaatgttttggccgtgtttagttgttttggaaaaaaaattatcatatacatacacacatttgaagtattaaacgtagactaataacaaaactaattacagaatccgtcagtaaatcgcgagacgaatttattaagtctaattaatctgttattaaaaaatgtttactgtaacatcacattatcaaatcatggcgtaattaggctcaaaagattcatctcgtaatttacatgtaaattgttttttcgtccacatttaatacttatacatgtgtgcaaatgatgtgaaggaaaaattaaaagtttaaagggaactaaacacagcaaaaataacaaaatgatggaggaatagaagcagagttgtggagatgtagagagaaaggaaaacggaagaggagaaagaccaggcagccagctagcagatggatcgctggaccgacgaatgggaaacagagggtgaggtcgcggtttttgacgcggacgtcgctggttttgccggatgctggcgccgccctgattgcccaccgccccatcgccgttcgctggtatatgccgttgtcttggaatcatctcctcgagatgtcaaactcaccccaagattagcacgcccacacactttacccaaccaactccattcagtgcgattttggccagtaattagccacactgcatattagccacgacaccacaagtttcaaattataaaccttaaagttgtgttaagttcatgttaaaattaaaaatttaattgaaattaaaatgatacgacagaaaagttaaaagtttatgtacgtaggaaagttttgatgtgataaaaaaatttagaaatttgaaaaaaaaattgagaactaaaccagtcccaaatcaaacagtcctactagttgcattttgtaacttcttccccaagaagatcagtggggatgatttccatgtggagaaatggagacagtgaggcaggcactgaatcgcctcacctcgaccctctgcccctcaactcggtggtgaccacgcgtccacatctctcatctttctttctccgctattctcctccagtcctcttctcttcttcctccctcccttcgcccactgaatcgccaaaaaaattcccctcctccactccatctctataaaaatcctcccccaaatctcgcctcgtttagccagcacaactcacacaactctctctctctctctctctctctctctctcgtcgtctgcaagcttccgcctcccggatcgcggcgaccaccggaggaggagggagcagccatggcgaacatcgacatggggaagatcctggcggggctggagaacgacgacgcgcgggtgcccaagaccaagctggtctgcacgctcggcccggcctcccgctccgtccccatgctcgagaagctgctccgcgccgggatgaacgtcgcgcgcttcaacttctcccacggcacccacgagtaccaccaggagaccctcgacaacctccgccaggccatgcacaacaccggcgtcctctgcgccgtcatgctcgataccaaggttaccccctcactgctttgcttgtcgatctctacatgcttgtatgctgctgggttgttcggatcggaccagtcggggtagcttgcgtttgatacagagcggatttcgatttggatctgctcgtcttttttatcgggagaagctgggtttgatttggaggcagcatggtaggattatgagttgagtttacagcggtttgactttggaggactcgacaaaatggtatccggggttagatttgcctgcgcttgcgcttttgccttgtcgcagatggctggatcttggattgggggctcaggcttgcgtctccatgtgggtagttagttttggagtcttatggattctgagcaagtgtaagtgtgtaactggttcgtagtgtgatccgtttgcggtgttggtgagattgatgagctgcgtgcatcttgtttgtcatatttagctttacagttcgtctctatgctttttcaagttaatttattcatttgtagagttggattggaaggatggttaacagatcttgggatcggtggctttggagtatggagtgttcaaatcctagtgttctgattttgttgcttttgtaggaggatatgattaacacgtaaaagaaggctttattagtgtagtcatttcttctattatgccttgatgtttctgtcatgcacgtaactattggtgcttatctttttacactctcacacttcatggtttgctttgtagttcaaataagttacttacagaattgtactgcacacagtttatcttttttatcacttcttgtactgcaattagttccattatttttacctgtttagtagcatatttaaggcgattctgtggtgactgttctgaacatttcattcattgcttcagggtcctgagattcgtactggatttttgaaggatggcaagccaatcaagctaacaaagggtcaagaactcactgttaccaccgattatgagatcaagggtgatgagaacatgattaccatgagttacaagaaactgccagttgatgtgaagcctggaaatgtcattctctgcgccgatggtacaatctctttgactgttttgtcctgtgatccaaaggctggaactgtgaggtgtaggtgtgagaacacagcaatgcttggcgagagaaagaattgcaatctgccaggaattgttgtggaccttcctacactgactgagaaggataaagaagacattttgggatggggtgtgccaaatgacatagacatgattgctctgtcgtttgtccgtaaaggatcagatttggttaccgtcagacaacttcttggacagcatgcaaagcgcatcaagctgatgtcaaaggtttgtaatcattatcactattttttgggtcctgttaggttttcagttccacagtttgcttaagtatttaattaccaggacggttgagtgacaatacttctcagttagatgctttaattaatgttttgttgtccctttctggtatatactggagccagaattgtttggtctctgcctttgtacattgaccatttgacccctttttgtgctatattaggtaataaaatgcaattttgttccttttctatgtgcttgaacaactagtttcagaataaccttttttcacgtttgcttgttcaaatagcagctacttattttctcatgcactttcactgatagggtttagcttgttgcctgatatgcattaaaatgaggaattcaggttattgcatttctttgctgctaactgaaattttggatctagatggttcaccgtgttataaatgaccctgtcttactgccatgatgataaaatatattcgtgatgatgataatacatatgaggtgcctggtaatttaccatgctggttatgttgctgtgcgtctaatttctttcttaactttttccttgtttttaggttgaaaaccaagagggtgttgtaaacttcgatgagatcttgagggaaacggatgcatttatggttgctagaggtgatcttggaatggagattccagttgagaagatattccttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgtcatgcttagtggagagagtgctgctggagcataccctgaagtagctgtgaagatcatggcacgtatatgtgttgaggcagagtcttcccttgacaacgaagctgtcttcaaggagatgatcaggtctgcgccccttccgatgagcccattggagtctctcgcatcctctgctgtacgcacagccaacaaggccaaggcagccctgattgttgtcttgactcgtggtggtaccacggcaaagctggttgccaagtatcgtcccagggttccaatcctctctgtggttgtccccgtgttgacaaccgattcattcgactggacaatcagctcggagggcccagcaaggcacagcctaatctacagaggtcttgttcctctcctggctgagggttctgccaaagccaccgattcggagtcgacagaggtcatccttgatgctgctctcaagtcagctgtacagaagcagttgtgcaagcctggtgatgctgttgttgctctgcaccgtattggcgtcgcatccgtgatcaagatctgcatcgtgaagtaatcgctacacggtgtcttcttagcgccattttgctgggttaagtggcaaaacaaaaactgctatgcttgtttttactcccatagtccatctttgggagacaatttaattaccgtatcagcccctgcagttcgcagggtgcctttcgttacatagatttgctggtaaaatgaggagagatagaactccattatgtagagctctatttatcgtcgatgccatgtagtatggcaggtggtttctattccatgcctgcacaattttctggtagctactgtgttgtttgattactgttttttcaggtgatgtcgatggagttgataataatattggcatcattgtcgttgtatacgagttaaaaaagaatgtcccaggattcatcaggaatctggtgtgcccatatggccatatggatttttgtcttgtttaagattccggtgaccggggtacgaaatcttggttggtaatcggcggcctgagccgtttaacggtatactaattgcatgaactatgtattctgcaacgttatttgtggtaatacattattatgttccatttgctgtatctataaaacaatggttgatcagaacaaccaaaagctcgaatttacttttaagtaccatatacaactagttttttaattcaaactaataataacgtttacaatccgataattcgagagggcaaacagcacagggaggagtggctgggtggacggccgagtccgtcggagacgaaggaaagaaggaaaaaaaaacccgcgcgcgcctaactgtccgcgaaaagggcaaggcggaacgcatgcatcgcattgcgtcgcagagcatccgtcaaaagcacggcacgtctccaacaaatctcgcttgccttaaacgggcggcgtgacggggacacactgccgacgatcgaacgaacgaacgaacgatgcgtccctcctggtgctccgtcgtcgccaccccagatgggtctccttgaggacctcctcctcgccccgcgcgtcgacggcggtggcggcggcgacggcgaggccatggcggcgcccgactacgccatccctcccctctccccaaccgccgcctccgtcgtccaccgatgcgcccggtatgatctccctcatctcctcctcgtcgtatggattaatgtccaatttgatttaattgatcgattcctgatcgatcgcggcgagaaacgtcaacctgggttcgaaacctcacctcttctgattatttgatattaggtcgttatttcttaatattcgtgtatttttttatcgatcgtggctgcaggatcgccggcgtggaggtggagcagctgctgcggcggttcgagccggagaagggggaccagccgctggcgtacgccaggagcgtcgtggagtactgctcctacattgccctgcgcgtcgagaccaagcgccatgactacctcagcgacagcgagttccactcgctcacctacgacatgatgatcgcctgggaagcccccgacgacgagacggacgccgcgttgcaggtgatgacaccccggttttctttttttttttcacccccaattcaacatcaccatcttgtttgttgttcatacgcaactctgatcagaaaccgatacgctataacagaaaatgtcatttagcttcgttgacggcaaggatgacgacgattgtgggtccatgttctgtttgagccccacacaaatggccattcaggttatatatatatctctgtcaatttgacatattttgtggtttctcaagtatcaatccaaacatttgatgaaatatttaggttgatgggaggagaacggtcagtcctgaagcatttgccaagattattcctgcgtgtcctgcaatggcacacgcgatcactgttcgcaacttatttgatgcgctcacaaactctacgggaggccgcctgcattttctcatctaccataagtacctcaaatgtttagacaagtatgcattggcaccagcttctcttgtttctcttcattgttacagttattgtcattctctgaaacctgaacaatgagcattactgaatattcaggcactcggttactttcactgcatgattgccttactatggcgcctctggtttctgatgttagggtgctgagatttgcgaaacgtatatcaggtggacacaaagctccagctcttcaactttctgatggagaagtgatccttgatatctatggtgccgcgacaaccaagccgattcttcaacacattgggacgtccacttggcctggttaagaatcctccctatggtaattttgatcagtgttggtgaattgtttccttcactatggccttaaggtgtataaggtgcatattttgcagggaggctcacactgacaacccatgctttgtactttgagccagtcagtgttgatttctcatacaacgaggctgtggtgtatgatctgtcaagggacttgaagcagtctataaaacgtgaatcaactggcccatggggtgctcagctatttgacaaagctgtcatgtacaaatctagctctacgtgagtaattactactgtagaataaaattttttttaagtttctgctcatcttgtagctttgctcatacaattttactttgacagaagagagccggtgttcttcgaatttcctcaattcaaaggtcacactcgtcgagactactggtttgcaatcatcaaagaggtgttgcacgctcacaagttcattaggaagtacaggatgatcaatttacataaggccgaggcgctttctgttgcgacactaggaattctcagataccgcacggtgaaggagggattccacatactgcctgcacatttcaagactacccttgccttcaatttggcagagaaattgcccaagggggacaagatactggaagcattgtatggtcagatgaaagattattcctcaaggttcagagtagatgaagattctgttcaaagcagttcagatgatctgacgcttgctgatcctttcccactttctgcatatactttggtgaacatgggtttgttgacactcaaagaggaggacaatcccgaggaatgggatctcactgtccgagatgtgcagacgggaggaactagctcagtgcaaatggctctagagagatctgtaggttactctggcagagtggaggctgcgagggcgacccttgatcaggtcaaagtggaagacatcgacactaatgtggctgtcctgaaggtactaaatgtcattttctcataatcttctaaactaagatatgaattcagataggaaaagtcttgagttctggaacaaccactgagctctgagtgacctgtacaggcatacctaagcctgaatttccattcatagttttagattgctcaataattgtagactgatagttgcttccaatgtcatcaagattgatcacaattcaagccattattaagtgtattaatgtttgttgatttactgttaatatgcaggaactgctatttccgttaattgaaataggcaaaaggcttctctttttggctgagtgggaagatccacttaaatcatacgtcttcttgttctgtttcctcttcatagtttacaggtaatatctgaaatcacctctcttttttttttggctaaaacgaactgaaatacttctaccagtagttaaaaaattttgtttcacggagcaatgttaatacctattccatactaaaccctgcagaggctggatttggtacattttccctgtctttctgcttggttctaccatcttcatgctatggcaaaggcataccgggaacgggcagatgataggcgcatttgaagtcacaactccacctaggagacgaactgtagaacagctactggcgctgcaacaagctatctcgcaattagaggcacaagtgcaagccggaaacatttttcttctcaagctccgatccctcctgcttgcagcgttccctcaagtacgttacttcttctcacattatcactcacaactacgaattactttgtaaaccatcacatcaaaactctaaatcttgcaacattctgcaattactatataacaattgttattgtctggtcagagcacgaacaaagtagcagctacaatgctcgtggcatctgcgatattcgcgtacctgcccttgagaagcatacttgtactgattgtgctggaagcatacacgaggcatatgccggcgaggaagaagagcagcgagaagttggtgaggagactgagagagtggtggctgcgaatcccagctgctcctgtacagctcttgaggcctcaggataccaggagatggacatcgaggttgagatcgagatgacccacatcggaaatgtcggtactttacacatgtattatatgtacctgtaaattcatcatgttgttagaaatgttgatatatacgatcagatttttgtgttgaaatggaaagtacatattgtgcaaaatggaattgtgggtggatcgtattttgtattgtgaatttttgttgaaagctgcactgaaggaatttggctgtctatcctatgcagtagctactatgcatttatttgaaaatcaaactgatcattagctggtatctgactgaagtcagagtgagaggccacaaaccaagacttgccttgttgaattcacacttctgtctgggctgctaatggattaaattttagtcgctgtcatatcggatgtttgacactaattagaagtattaaacgcagataaataataaaactaattgcataaatgagagctaattcgcgagataaattttttaaacctaattaatccataataaaacatccgatctgacagggactaattagtctctagattcaaacactacctaagcgccccgtttgagttaactttaagatagagaagtacgggtatgtaaaacgacaaagatattagtaacggtttgagctattcacatgccatctaattagataaggtgtcccagatttttctaatgtatttgcattccaccaggaaatggaatgacattttagtgtatgacggcaaagcgggcaatatgcattgtttggctatccatggactgccataaaatatattcttgttagctataaagtacttaatcacatccactcacgcaatttggtgtatccatgatgcaatttatctactccctccatcctaaaatgtttgacgccgttaacttttttaaaaatgtttgaccgttcgtcttattcaaaaaatttaagcaattattaattctttttctatcatttgatttattgttaaatatacttttatgtatacatatagttttacacatttcacaaaagtttttgaataagacgaacggtcaaatatgtttaaaaaagtcaacagtgtcaaacatttagtaaaggagggaatattatgtattgaactagttatatttatagtttgactaattgtttattaaaaatcataacaaagatccggttttaaaaaacaaaacatcctataaaaatcatcagaggaaggaccatgtagcttgcaagcttcagtagcagcaacacatatgtttttggttccattaaaaaaaaaacacatatgtttttggagaggcttgagttacataggttaggtagtagctagcgtgtcacaccaatttgtttttatatatatgctactagatgtgcacacgttgatattccatttgagttttgttaacacggagtttgttgggcttgtcgtgtaaatacaaaatacggaaggaccgtcggcaaccgttgatcacgtcatgcctgaagatccccaaattgatgcagtagcctctctgaattttcaacacgacaagcagccgtccggtcagctgcagcgtggttaattattcagagattagagaggcgtcttccaggcaattattcaacctatttctcctgacgaacttgctctttgctaacctgaagcttcgtgatcgacggcagctacgcatgacatgatgtcattatggttgtgagcaaatgttttttcaagagtttttcatgtgatctcgtcagtaattccgtccctcggttaacaacaaccattcaacacgatgtacggaccgtgacatcagattcagcgtacatgggtagcactcgggcgcagctcatacttcatcattttcaaaatatttgacactgttgactttttagtacatatttaaccatttgtcttattaaaaaaatttgtgaaatatgtaaaactatatgtgtacatgaaagtatatttaacaatgaatcaaatgatataaaaataataaataattacttaaacttttaaataagacgaatggtcaaacatgtactaaaaagtcaacggtgtcaaacattttgaaacggagggatacatttctgcaagtcgcttaattcgtatcgaaacgcaacacggcgataacctgagcgatcacatgacggtaattaatcaataactaatccagctgctactgtaaatgattataaatgtaacgcgtcgtacaaagagtagtcaaaatctgaacacacagaaagttaaaaggaaagggacatgaccattcctgcgagaatcagcatagatttcttgtgttctccaattaatttcaagaagaaaaaaataatactacctccgacctaaaataagtacaaataatactacctccgacctaaaataagtacagctgtagctatctgtgcacaacgtttgacggttcgtcttatttaaaaagatataaaaaattaaaaattagtcacacataaagtacgattcatattttatcatttaataacaataaaaataataatcataaaattatttaaataagataaaatggtcaaatattagattggacggtataaaattacactttttttttgagactgaggagtaatcagcaaccttgaagtcaatcacacatgcggcagccatggcaaccaagtcaagagctgaacatgataaactaataaatccatcacgtctagaagccaaattaaccaaaccaaaaacgaaaacgtgtcacgaatcgtcacgtataaattgcactgtgtacttagacatccataacgttttcaccaaatcaactctgccatttcgtcgattgtcctcctcttcccttgacggtgcaaagcagcatcttcatcgcaatggattaccaccgaatccacccggtgggcgtcggctcgccggcgccggcgccggacagccagcagcaggtcggcaaggggaggtcgacggcgagctacggtgagaaggagcagctgccgatcaccgcgccacggccgtacgcgccggcaccgctgccgccgccgccgccgcggcgcaggagccgcgggcggcggtgctgccggtgcgtgtgctggacgctgctcgccgtactcgtcctcgccgtggcgctgggcgccacggcgggcatcctgtacgcggtgttcaagcccaagataccggacttccacgtggaccggctcaccgtgacgcggttcgacgtgaacgcgacggcggcgacggtgagcgacgcgttcgaggtggaggtgacgtcgacgaacccgaaccggcggatcgggatctactacgacggcggcgaggtgacggcgtcgttcaacggcacggagctgtgccgcggcgggttcccggcgctgtaccagggccaccggagcacggtgcgccccgtcatcctgctcgccggcgagacgcggctggacagcgccgtggcgctgcagctggcgcggcagcagcaggccgggttcgtgccgctcacggtgtgggcgcgcgtgccgatccgcatcaagttcggcgccatcaagctgtggaagatgaccgggaaggcgacctgcaacctcgtcgtcgacaacctcgtcgccggcaggcagatccgcatccgctccaacagctgcagcttcaagctcaaggtctgatcgagctttgtagaggcgttgatccatctccatttctgtgaatccatccgttgagttgagattagcaggtggtagaggcgtgtatttttacatttttaccaatactagtttctgtgaatccatccgtttttggaagctctgctactcagattaggtttaatgtatgagcaccgatgtatatatgaaaatgcatacgcgatgaatttctttgaaaatggcaataaagatggcgaatttgttcgtctggcatgccccaactgaagcaatttcagtataaactcactcccaaaaagaacacctttagccgccccgttggtatgggtctatccaagtaaggtcttaatgggccggtctacaaattaaaagtctatgctgcctacctcaactatggcacacctggtttcaggtctttctcctttgatcaatatatataggtagttccttgataaaacattaaaactcaattagatacgtatgacagaaacgaaattagtacgcagctacagtgcccaataccgacttccacgtcatcattttacagtgcgaccacaacatttatcatcctcctctaccctaaactagatttgtgtaacttcccgatttacaaagtatatgatcaggagatattacaaatcagacaatgcactactactctatttctctaaacctcgtaaaacatctcacacaaagtagtcttgtgctgtaccgatcgaaatgcaccatatatgtcacccatggcgaagcagcaatcactgccacgcacggcggcgccggtcaaatctgcctgcacggcggcagcggcttgccgcagaggcacaggttgccggcgtacgcggcggcggggagcaggttgaacggcctggcctgcggtatcttgccgcacagcttgttgccccggaagctcgcgtgccggagcctcgccatccgggcgaagctgtccggtatcctcccgacgagcgcgttgccggagatgtccagccaccggaggctcgccatcgacgccacggatgccgggatggtgcccctgatcttgttccgggagatgtccagcctctggagcccgaccagcctccacaccgagcttggtatctggccgccgatggcattgcccgacacgtccagccacctcaagctcgcgccggcgccgaactccggcaaggctccggtgatactgttcttggacaggtccaggtgttgtagttgccgaggaagaaagatcactgacatgtctgagcttgcattcttggtcagcctccttgctggtgatatgcttctgaagaagtgatcaatgccgccgacgagatggttgtgagagaggtccatggacacgagagacggcaatccatggcggattccgggaggaagtgaacctgacaacccgtttcttgacaggttcaggttccacagcttctgcagaccaaacagtgactctgggatcgagcctacgagcagattgctgtcaatggagagagaattcagagaagaaatgctgccgatctgagaagggatcacgccggtgagcttgttatggcgcagggagagatcagtgaggttgcgtaggccgcacagcgacgccggaatctcgccggagaagccgttgttgctgaggtcaagcatggccaggctcttgagctgctgcccaaagaacgccggaattgcaccggagaggaggttgttgctcaggtcgagatacgccaacctggagagattcttgtagctcggcggcacctcgccggagagccgattcccggcgaggttgatctgcaccagccccgggagtgacccgagctccggcggcagcttcccctcgaaccggtttccggcgagcgacaggtactggagggaggccatgccgctgaggacgctgccggggacgccgccggcgagcatgctgccctcgaggtagagctgcttgaggcgcgacagccgcgacaggctcgccgggatggcgccgccgatccgcgccatgtcgcggatcaccagcgtctccaggaactcgagcccgccgagcgaggcggacagggcgccctccatgtagctccgccgcggcggcggcagcggcggcgcctccagctgcagcgcgacgaccctccccgtggcggcgtcgcacgacacgccctcccacgcgccgcagcagtcgttcccgccgtcccacgtcgcgaggatccccgtcgtgtcgacggtgaccccggccttgaaaccgagcagcgcggcgcggtcggccggcgagcacggcgtcggaggcggttcgtcgtcgccgccggcgccatcgtgccccgcttctgcgcgcggcggcggcagcagagcggccaccacaagaaggagaagcagagcgctcggcgcagccaaacgcgacttcttcgaaacctgcattgccattgccactctctgatcagaattcagaaactgcaaggctttatcttgttttttttttcgtgtggatttcttggagaagcgagtgcgatctgtgaggagtatttatagcgggaagaggagcctcgcgttcgcgtcgcgagcatttagtgtgttcatgtgtttgcgccatgggagggagcctgaaacaacctcggagcgttctctgaaaatattttgattttttaccgttcgtagcagacgcgggacatgttggatcgcatgacatgtgtgggcgcaacgcaaaaatggcttttgatgttggctacgagctgtggtggttgcactcgatgaataatcggttattcagttagcagttgctagttgctaccagcgtatgtacgaagagtagtactacatgtacgaaaaatctatctatctatctatctatctattatattattaaaacagctttgaaagaaggctccacgttcgctgtagtggctagaaattcccacattaatcggaaaaaaaaagaaaaatattagccattggattaaaatagatctagattaatggttgtgatttaatatgagtctacatattttatggaaacagtgtcaataaaccaaacaggaaccaaccagactccagtctgatttttggaagcttggaagctcaggaaccaagccggaatagaactctaacatagaagactactacatgctactaggcacttaggcagcagtgcaaacgtgaaatcgtatcatgacagtattttttgaagcagtagtagcgtaactctaattttaaaaaagtaaaacataataccgatactgattccaagttaaaatcaacggaaccaaccagactccatgatttttggaagcttggaagctcaggaaccaagccggaatataaaatccaaaattagcaaaaaaaaaagaagagttcaagtaggaatacaatttaaaattagctgaaattcggaattaaaaataaacactgttgaaagaaaaatccatataagaacccaatatgagattaattaaaatttagaataaaaaaataaaataatatccaaaattagaaaaaataaaagagagttcaagtaggaatacaattttgaaacaactgaaattgaaaataaaaaaataaaaatattaaaagaacacgatacatattatttatttttttaaaaaataaattctaaaattagaaaaagaagaaaaacaagatttcaattaggaatacaatttataaataactaaaaatgtgataaaaataaagactattgaaagaaaagaccatctaaaacacatgacgagataaattaagtaacaagcctataaaggagtagagtggtggcggttgatatgacatataaaaactgttaataaaacaccaaatagaatcctaatgacgattaaaaggaagaacgacaggcaggctgtgaagcaaacgagcaaggcgattgtcgggacttctagaaagcaaaaaagataaaccccattgataatcatattcgatttttaaaatatcaatgacaataaaaaggagaagcagcgggcggggtgtataggagtataattgcagagccgctgacggttgacaggacttctagaaaataaaaaatggattccaacgatagttatgttcgacttttagaattacaatgacaataaagagtaggcggcggatgggccgtagaggagcatagtggcatcgtttaacgagacttctagaaattataaaaaataaaacccaacaagacaataactctaaaaactacaaggttcagtttttaaaggttcggaacttccaaaaagtaaaaaaaatgataatcatgttcgattttaaaatatcaatgataataaagaagggagtcagcgggcgagccgtagagaagtacaaggcaaagccgctgacggtttggcgggacttatagaaagtaaaaatgaacccaaacggtaattatgttcgatttttaaaatctcaatgacaataaagagaagagacagtggacgggccatagagaagtataatagcaacgtttgacgggacgtctagaaattataaaaatgaacccaacgtgataataaactctaaaaactacaagatccaatttctaaaggttccaatgagaatgaatagaaatagtgataaatcgagcaagcaaataaagaaggagatgacataggggtagcaactggtgtgacttttaaaaaactatataattagaaacacgtagatgataaggtttggtatttcaaactcttaagacaatgagatagctatttaataaaatttaagtaaaatcatataaaaaatatatgattttatttaagtgctagccgcgcaattgcgtgggccacccagctagtttcttgcaaacaaaaatttcaaccgtttgattgaatcaactgaaagattcaacacacatcagtgtttatagaaagtttgtaaaagtaatttgagtaaatttcataaaactacatatactttacacaatctatcataaaactacatatttaagaacttatttcacaaaactacagattcaatgtcttcgtttatcacaaaactacaggtactttgcacaatatatatcataaaactacatatttaagaatttatttcacaaaactacatatttaatatcttcatttatcacaaaactacaggtttagtgtcttcattatcacaaaactatatgttttagcattgttaaatttgtagttttatgataatggagacactaaatttgtagttttgtgataaatgaaaacactaaatgtgtagttctttgataaacgaatacactaaatctatagttttgtcaacaagttcttaaatctgtagttttgtgatagattgtacaaagtacttgtagttttgtgataaacggaaatactaaatctgtaattttgtgaaacaaacttttaatttatgataaattgtgcaaaatacctgtagttttgtgaaatttcctcaaaaaatttagtactcatttcgtttcccatgtatgaatcgtgtcttcagttttttctgtcacgtttcgttacagattagctaagcgtacagtttgtgtcggtaagtactagtattggatacgtaatttctgcatctaccattgtacatcgaacaagattcttagcctcacatctgaactctgaacaagtactcaagcattgccttgaaactcacttatgctgcattcggaataaaaccttttttctgtaaattatatatttccgtcgtggcttgactaacggaggttctctttgagttagaaaatgattaatcaaagctgggaggagaatcgctttatctgaaactctgaaatgaatgtgacagaggaagaggttagtatcactgtacaaggctgtgctgtggtgtgtgtagctttgcgagaacaaacagagctggcccagagagagactgaagcagcatcgatggtggatatactccctccatccaagaatatagcaacctaagactaatgagacatcacatgtaataatgtgtcgagatatatctcatatctaaatacattatactagatgatgtcatatctaattctaggttactatgttgtggtacggaggaagtatgtatacggagataggggacccggatggggagagctttggccgccgatcctgtggcttttgcgtccatgcaagccgaaaaagggagcactgaaatcgtggcctttgatcggcttttgcaaacaacaccagctgtactgtagggctctctgctttagtacatgacgatgatgattgatcagatgatgcgctaatctatctatcacctgacgtcaaactttgctttctgaggctgctctgctttggtgcggggacgagccgacggggatttctcgaggcaacgctgcatcggcgcagatgtaggttggatggatcgatgcgttggccggccctgttcggaaacaagttgaagaagtagcaacctgttgccttttgggctttgcaggctacttgttgatgctgctgctgctgcaggccgaggcccagtacgcacccgtatcccgcggaaggtggagccgaagttctcggcaggccgcgcgtgcaggttgtcccataaactttccaacctacccaggccgagccgtgggtcgacatgggtagatcacgcctggcgaaaagtccgcaaaagttgagcccaaatctgcggcgcggccagctccagccgctcgcgcgcacgggcagcccaattagctcttctcgagcccatgcccatttccgccccccaggagtgggcctatccgcgacctgccaacgctacgaagtgaagtgcccacgtcgcgaatcgcttcagtgattcgttgtagccgccactaccgctcggaagcagaggactctcacaaatgctaagcggaacataatcatgtgttcgcttagcggtaattagtttgggtctcggctcatctgttaatagttttagaatgtaaaattttcttgtaacatttttttatcttaataatatttgaatgatcttctttcctctggtcatcccgatgagaagaaaagaaacatgcgtcaaactgtctactaccaaactactcataacacacgccgccatggtgcatatgggaggaccgttcatgtatgatcaccagcaagagcacatcatttggattttggaaccatcgaaaaaaattttcttatgctttcgcgaaacaaaaattatcttatcaacactaacatgctcgttatttttctccacttttccccctttgttgttgatttggtccgattgccttcctccaataattcgacaggtgtactagatgagtgcctcccaccgctgaggcgctaacgtagttaaccaaaaaacctcgattaattcattagttaatcctttctctcatgctctttcactagctacctgttgctgctgctgctggtaacatccccactactacatactaataaaaccaaacctgaattagtttcttgtcgcccacctctattatttcagcactcactcacccattcatgtaagcatgctttgctagctctgaatttcagtttgtttaaccaatcccttccttttcgccaaaccaactgattcattgtgccgtatagcattgtgtgtgtccgtacctggctagcaacttagtgctagctcctaatttggcaggtccacatgtacttgtcatagcttaagctactgttgctattatagtccttcagaactgagcctgtctgttaaactctcaatcaaactgaaacacaatatttacatggaatatatgaggctttacatgagtcaatttggtgttcatttcgtagagggtatatatgcaaatgtctgtagcatttgagaatatttttgctgctcatgtaaagatatgagattaactatacaggttaaggcgtgaatctgtcattttcgatcgtacaagttaacaaaatgagacaccatttttgtcgccggcttttgataaccacgcatgcaaccaacagcgatcacaatgcagagattagagaaagagaatgatagtactagtggcaggagcaaatcatacgctaattaatctttcagcacgcaatggactgccaactttgtgttcaacacttcaactaactcgatcgatctactactacttatttaatggttggtatagtgagcacaccatttcgaaaacgcttggaaagggactgaacaacttgttttcaacgacaaaaagacggccgactcagatgtcatgttttgaacaatgacatgtgtttgcatatatttagatgatgatatgttagtacagtatatgcttacacacaatccctctccacacagcctacaaaagtaaccaaaagaaacctaactttctaactcatcccactcactggcacatcataattagttggaaaaagacaacaatgatagtaactttcttcttgtaatcaagttttgattatcaattgcatgcatgcaaacgttttgtttctagatgcagcatggcatatatactagactctgtttatacttttcatgtttgattgtatagtagactctgttgtatttttatgctgaattttgtatctgtacatgattccctgccttggtgagcatgtgcagaagtatctcagtacctgctaatttgaatatcagctagcagaattttttttgttgttttcagaaccaatcttaaaggctaatccagcatgcaaactggagcttaattttgtgcggtcccttcatgcttttgatcgatacaggctagagggacatctgaaagcaccttctcatcaaaacacaatcagttagtcctcgtcagtcgtcaccatgctgcaatctccaataggcatgattaataaagattattcctttctaccttggcgagtaggttcagttcatgacacttgtgctagtacttgagttccatggctgcatgcctccagaaatctgtcacaattacagcgaaaaatgtggtatcaaagggttaacttgccacattttttcatgaacttgttctgtcagagctggaattagcaagtatatacataccaatattcgtttatgtgctgcatctgccggcgaagaagaaaaagaagcatcaagaaaggcaaaggacgatatcgaatctaaatgcgaaaggcctttttgttcgtgcaaactattaaaggcatcaccttaaaagattcaaaaacccaaaaacggacaaaactgaatcatgttgcctcgctgtcaaactgactgtaatccaactccactaatgctgcacgcacgcacgagttaggctgatgaatgcttttgtcttcaagttttttccattgtgtcaggatgtgatcaccgataaggaaaagtttactaacgtgacaagttaattcctgaagaaatttctgaatgaacccagagaagttgtccaggttctaaacttcaaaccatcggtagcaaaaagtcggtcacttttctgcattttgcaagcaaaaactacatttgcttgagtcttgggctctggactctggttgatcaactccctaactttttttttctcccttaaaacagtggttgatatcatgcatgaagaaatagtttcactcttccaacaaaagaatttcactcatggaagaattgatagcgtcaaagatccgaaaggtgaagacacatctactcccaacaactataccactacatctgtacaagtacatagcactagttgcagaccttgacactttgagacttgcactagtgccacggccaggctcccaggcacagagagataaattcaccagcctcgcccgcgcctcctcacacacttgcaaagcatttcaactacaccaagagggaaaaaacgtgccaagaaaaccatggagttcgtcgccaacggcaaggtcatcctcttcctcctcttcgtctccacatcggtgctcatcgtctcccccgcctcgccgccgcgcttccactacatcaaccctcacaacttcaccacgccggcgtcatcgtcgtcgtcggcgtcggcgtcggccgttcaccgtagccgcaacaacaacaacccttcgctctccttggtgcaccgcgacgcgatctccggcgccacgtacccgtcgcgccggcaccaagtcgtcggcctcgtcgcgcgcgacaatgcccgcgtcgagcacctggagaagcggctggtggcctcgacgtcgccgtacctccccgaggacctggtgtcggaggtggtgcccggcgtcgacgacggcagcggcgagtacttcgtccgcgtcggcgtcggctcgccgcccacggatcagtacctcgtcgtggactccggcagcgacgtcatctgggtgcagtgccgcccctgcgagcagtgctacgcgcagaccgacccgctgttcgacccggccgcctcgtcgtccttctccggcgtgtcgtgcggctccgccatctgccggacgctgtcgggcaccgggtgcggcggcggcggcgacgcggggaagtgcgactactcggtgacgtatggcgacgggtcgtacaccaagggggagctcgcgctcgagacgctcacgttaggcggcacggcggtgcagggcgtcgccatcggctgcggccaccgcaacagcggcctcttcgtcggggcggccgggctgctcggcctcggctggggcgccatgtcgctcgttggccagctcggcggcgcggcgggcggcgtgttcagctactgcctggcgagccgcggcgccggcggcgccgggtcgctcgtcctcggccggaccgaggccgtccccgtgggcgccgtgtgggtgccgctcgtgcgcaacaaccaggcgtcgagcttctactacgtcgggctgacggggatcggcgtcggcggcgagaggctgccgctgcaggacagcctgttccagctcaccgaggacggcgccggcggcgtggtgatggacaccggcacggccgtgacgcgcctcccgcgggaggcgtacgccgcgctgcgcggcgcgttcgacggcgccatgggcgcgctcccgcgctcgccggccgtgtcgctgctcgacacgtgctacgacctgagcgggtacgcgagcgtgcgcgtgccgaccgtgtcgttctacttcgaccagggcgccgtgctgacgctgccggcgaggaacctgctggtggaggtcggcggcgccgtgttctgcctggcgttcgcgccgtcgtcgtcggggatctccatcctggggaacatacagcaggaagggatccagatcaccgtcgactcagccaacggatacgtcggcttcggacccaatacatgctagaagtatatataagcagtacactactcgtactcgctatcaggctaccaagtacctatactttactactccacatgtagcacgtatacccctcgagtggcacacacgtgcttgccaagtatgggcacatacggagtatgaccgtacatattatgtatagatagatactactccctccgtttcacaatgtaagtcattctagcatttcccacattcatattgatattaataaatctagacatatatatctatctagattcattaacattaatatgaatagggaaaatgctagaatcacttacattgtgaaacggaggaagtattgtccagagaaagtgcagctattaggcctttcctgaagttctgaacttgtcaaatggccaagtactgtaatatgtactgcaactgtgcaatgcatgcaagttggaagaatgatgagttaaccatgcatggtgagttggtgacaggttcagttctaccactgtatctgtatgcatgataatacagcccctggtgcagacaaatgtaacaagtttgttagctttgcttgcgttaggggtgatgtcctgggaacaataatgtagcacatcagcttttgcatttcaacctgacctgttgtgggcttgtggcctgtgcagatgtggagacaacgctagcagccatttgctgcgggaaatgatgcacacgtaagatcacgcttaacataatttatctggaaacttcaaacagagcagtgtcagggaaaagattagtaaattaagaccagtgtcagtcgcatccacgtgaacacacgcacgactgcacgctcaaagcacctgactgtcagcactcaccagtcaacaccgggaagtaagaattcaaggggttaaagtttacgatggctacagcagctttaatctacaggcacgttaactatagtttattactgcagcgaaagaagaatatcacgagattcattaagtcaatctatctgacagaaaatcttaagtctacatcctgcttcacgattgggtgaaaccaaaaggtccaattcaaccacattggtcgctttgagctggaacaccaccaacaaaaaaaaagaggctcactttgtgcaggctgacgcaatgactaaagtacaagcgtctcaagaaagtaaaagctcaatgtcacagcaggcaaaggttatgctgtagcctttttggttcaagagaaaaacagctcgtctccatttttcccatcttctcactttacccttatctctcatcctgactgctgacacggagactcggagttaagcacatcaaagtcagacaagataccaacgaaaaagcatccacaaaactaaagcattcgacaaactgaaataatgcaatcctatctcccctgcacttaaaccgaaaatttgcattctcgggtcatctacatcgccagtgaaaactagaaaaaataaacacaaggaaaaactcaaaagaataaaggaaagaaaataagtggaggaattctcgttactgttatcaacatgcatacaacaattcagcatcaattgccaatgacctcagttcatgattgctggaagagaccctcttgcaagttgtaggatcttaccatcagaagtcggggaatccagatcagcaaactaagaacaccattcatcgcatggcataatctttcaccaatgtttggcctcccgtgctgttgtacacaaacatagcgtcagagagggaaagcgagaaattatataactttcattcacaaacaaaacttgtaccaagttagaatatacatacagcaggacagctgcttaaaacaaaacttgcaccaaagctcaaaatgaactaaatcaagctatagtactacacaaatgtaaattcgaacttgctaggaaacagggacttctatatcagaatccaacaaaatgatccgctagaggcacaagcaggcaatgtatgcaatttatcatccttgcaaatttcaatcgcccatatgggcagcataattcacatcctgacaccatggacaaaattcaaaacagagcatgctataaggaattcagagtgcttgtgtagcttggctaaatctgaatccatgtaactacaagattataacatctatcgagcaactgtgttgagccggacgacaaaatagcaatctctagtaagaacttacgtgcaatctagttgaatattcagaaaacgtgggttttcctcactctgagacacttttacagagccttctataatttggtcttgtttcacctctataggatcagggaagtacagaatagtctgcagaacaagaaatgaccatattacacatttacaccaagaagagcaggaatagcgtaatatattgaatagatcaattaaggataacaccattttcagaaatcagaacctgatgccaatgagttggctcatcctctggggctgtggatagcaccactggatcttctgatcctcggcgccttttcttacgaataacatcgagtggattcaaatcggaaggagatttgtctgtgggatttgaagggccattgaactccacttcaaaccataaaccaaagccatgaatgggagcttcacatggaagatattttctatcagcaaattaagataggatatgtatggtgtataaacagaaagatgagcaatcaaagaccgatcagtagtttcagaactgaataaacattgaaaaatgcagctgagcattgatgtttcatatgataaactgtatgtggatgaagattgaagaagattttatagattcgagtcaaatagcagattcggcatcaggaataatattatacaggaaaagagacgattcacctaacatcatggatgaaactttgtatttagttgtgaaagatttgagctcctcggccttaaaagtgtagcaatctatgtgtttgacctgtaagtagacataaagaagttaataagcctcaacaggtaaatatggttatttatttgaaaagtattatccacaacagtcttgtgaagactcaccacaaatggccagctcaaaacattctctccaccgattatttcaatggagggctcctccgatgtaaactttttggcaagtggcacaagtgcagacactgtagcagtacaagcacgaaatcaagttatagtgtgcaaaaatcagcatccaacatgagatggtgaatgtgatgcataatgcggctctaataacaaaacaatagtaacttactatttatgccatagacatcagaccagaaatcaacacttccttcatacctctcagaatttgttatgggtgccatgaagagctatcgaaaagaaggatacatagttaatcaggcttagaactgttctgcaatttgtgccaaggcttagaactgttctgtaatttgtatgcacatgtaagataggtaagatattggttgcaaaagtaggattttttttctctaggtctatcttattttatatgcacatgcatgagaaataaaatgacatgtgataattatataccgtagcatgagatggaaggataagaccaccaggtttaagccatttatcccttgcaaacaggacactaggcagcatactctgcagatcagacgaaaacagaactagagaaatcagaaggagatagaactagggaagataagagaatatcaaattgtgacgcaaaaaacaaccatataaaagaatgaacctcatagagaagcatataacccatccactctgatattatcacatcaaccttatcctcaacttcaacatcctgcactgtcaattcagtgtaagttaaaaaaatgcagataaaaaaagtaaagatgtaaaaatactaatgtaaatatattttcaaacaataatgactcagagattgtatcatgtgaaaatagagaaggaaacacaagctttatgccctgataatccaaactttgtattcaatctagtagaccctacttggcaaatgcagataactcttccagtgaaatacttagggattgagagaatacatataaccaaaaaaaacataaatgcagaatcttacctcaacgcgtccatgaacaacgacgaccttatcatccagattatttgcctttacaatttcacgagcctgcgcaaaaaggagtacatttatttgccgcagcatacccataagagtagttacttttcaaaatagtatgatccgctagattactataaatatgacactaatattcaatatctgcaaagatcaagatcaatacactattttaatatattgttatatactctcttgtgagttgtgactggtagtattaactggtaactggtattttatagaagatgagtaggaagcttcactgtcaatctttgttatggataccactacaaacacctagttcatgaatacacttgagtgctgtcattttgcaaccgtgtattctatgtccttatattgtataactaaaaaaatggtccacacataaacaacaaaagaacaacaaacaagatatggaaagaatacaatttaatattagagtatatatcctaaaaaataatgttacctgagttgccatttcactagcttccactgcatacacctgtaagtccatttgaatacacatggaaaaagttcactgttataaggcagacaaatggaccagtgaaaacagaaaaatacgttaagagtgccatatactacaagacttaacatctagttgaatcagggaaaaacacagctgccatcagttagttagcacacacagatccatgtcacttttgttaggacatagaaatgataaaattaaaagctgtttttctttcacaaacaagaactgagctggtttttccttttgtatagcacaacaaaatgaagcattgaaaaaaatccatcttacaacacttatcgctgctcaatttgcaagcatgcaaaactatactagtacctctgaatcagcacaaaatgtacttctttacactaaagtaggattcactggatgagagagcccggtcaaattagttttgcaagcatgatccaaacattatgctatgcatttaaattggccaatcatctcagcacagggattttgtagcttacacattttgcaccagcgcgagcacagaacaccgagagtattccagttccacaccccacatccatcacaacctgcatagcataaagtttcgaaatcaatcaccgaaatttgtaatccaatcccaacagcacgcaataatcatccacccccaattcggcgagcaaatttaccttcccctcgatgaacttctggtggtgcatgatggcagagcggtaagcatccgtcctaacgcgatcctgcccaacgaaaccgaacacacgtcatccccaccaaatcgcgacttcggactcacaacacgggtcggcccaggggttgtgggggtttagggtttggacggagagggcgactgaatcgggtacggatgtgggcatggcggcttaccttgatcatggcctcgtggattccgatgtgggagtatgactggaagtagatgcggtcgtgctccgccagcggagcgtccgccgccgccgccgccgcatcggaatccccggtggctggcggcgaggcggcggagaggcgagggcagcggcgcgcgaggggggagtggccgttgaggtgcgacggcagcatggtgtcagggaggaagctagggatcgaggggagacgagagagattcaaatggagatttctgaatcaaatgcgttcttctctgctcgctccgacctcccgtcgctttgcgcttttttttttttttggggggggggggtggggtgtggtttgcagttctggattattataatccagattatcatgagtaatctaaaagaaacagataacttattaaattagtttattataatttgaagctcagcttattataatctgataagctcatttaggtgaactttttttttagattattgagtgaaaaattacccaccatgccaccccacttcctctttagacttgcaaacccaataatctagactctaataatctaggaaagaaacaactaaccgcttattctaatacagattataacaatctagcttatagtaatctgactcaataatctagattataataatcacaagctggaagaaacagggccttagcctttttagatgggactaaaacttttactaagtccctctcacatcggatgtttggacactaattataaatattaaacgtagattattaataaaactcatccataatcttggactaatttgcaagacgaatctattgagcctaattaatccatgattagcctatgtgatgctacagtaaacatacactaattatggattaattagacttaaaaaatttgtcacgcgaattagctcttatttatgtaattagttttataagttgcctatgtttaatactccaaattcatccgatatgacagggactaaagtttagtccctggatccaatcaccaccttaggattattataatctagattattaggagtaagttgaaacaaacagatagcttattgtgatagcttattataatctataagccacattactataatatgataatccactctaaaggtgtttttttagattattaggtggctaacagctaacaaacaactaataatccagagaaacaaacaggtaacaatttattctatgtcggcttattataatccagcttatagtaatctggctcaataatctagattacaataatcttaattgaaacaaacacagctttagtatatgcatgtcacaggatgacactgcgtgcatcttggccgtccaaaccgaatcgaacggctgctttacttgggcccgcacgcaggcaaaacaaatgcctaacaggaggccacgcggcctgagacggcctcgcacctcgctccagatcggcgtccgccagcgccgccgccgcgaccgaagaggcgccaggccgccctgccctgccgctgcgaccgggggtgcgtggaggcggccggccggcagggctgatggcgcgctgatgcaggcgggcagggccacatcccgagcccggcgggtggaggaggccgcggtgctccgaccggtcgtcaggaacacactccgcccgcgccgcacctccaatttcggcggcctcgactcgttgatggggttcagcgtacgagcccgcaccggtcagtcacccacttcgtcaccggcgaggggggacgccgtcgcacggcttcgtccagtggagaacgctgcaccgtttcctgtgtccgcgaggtgtttgcgaaaatgcccccaaggctgtgtggttctgtattgtgaaatgcccctgcccctgctctgtggttctgtattgtgtggttctcaggttctgtatcgtggaaattgattatgtaatcttgatttttgtcataaaaaaaggtgaaacattattcagcagttctgatgtgctgaacagggatatatgagaacctggttgcaaatgtctaatttggtatatgagtggttgttgttgcttgctgagcattgagttgcctgaatctgtgaacatttcagtaactgcaaaactgcagattgtatgaccttagaacactgcataataatgcggcaagtttttacttataataggagtatgtgagctcattaatttcagctgaaattgaaataagtataattggagtacgagggcctcctagcacttgtgtcgatttctaagatcggcaataaaatttatagggtgcgctagatgctagaaagaaatggtgacacttatttatacgggttcagtccctcaggataggtaataccctagtccagttgtttggtggattatctgtgtattgagtgttgagtgaagagagtgcctaaccccctaggagtgctgccgatcccctttatttaggggcagggtgatcggcggtaagaaggatgcgatatcccttgtaatccgggtacatgccatccatcaagatacggcggataggtttctaccggacgttgccgtgattcattgactagacaccatcgtcaatcgaggatccgtgtgagcaagctgccatcgttggacagcttgcctccaggttatggaagcctctgccaatattgatactacgtacggttctgtttgatccctggctcactgcgaaagtggggaaaagatggcagagatttagaagcgaccatgattccatgaattagaatatctagcagtcagaaatcaaggattggtaccaacgacagggaagacgatctccttcgatgctactccctccgtcccaaaatgaccgaattcttcggttttcgtgtccaacatttaatcgtctgttttatatgaaatttttttatgattagtattttctttattgttagatgataaaacataaacaatactttatgcatgacttatctttttaattttttcatatttttttcaaataagacgaacagtcaaacgttagacatggaaactcaggaattgagtttttttaggacgggggagtagtgcctagttgtgcccaggtcatgacgccgatcggccgagatggaccaccacgccgtcgtcgctgtaccgccgatggattacctgtagccaccgggcctcgcttcctggccgaatcgccgacggatcgcgctggcatcatggccgaattgccgatggatagcgccatggacgcacgccaccgcgtctgtttcgccagagatgtctcgctttactgagaaataatcagcgatggttagttaaattatcccgggatctctttggctgtgtaggttcgatcggatatgtgatctctgcgttggttgaatggatggacggtcgactgaagcatgtgtacgtactcaccggagtatataattattttcctatattatattactccctccgtcccataatataatagattttgagtttttacttatattgttttaccactcgtcttattcaacaaatttatgcaaatataataaacgaaaagttgtgcttaaagtactttggataataaagtaagtcaaaaaaaataataattccaaaattttttgaataagacgagaggtcaaacaatacaaacaaaaaatcaaaatcccttatattataggacggagggagtatatattattacaatgttaaatgcctatcacttatattatactcccttcatcaacaaaagttacacctattacttcctgttacttttgttaccatgaccaaggagaaattaaatcatcttggatgttacaaaattaaagagtaaatgcaatcatgcaaccaatgagtatttagatgaatccttgagttctaatcaaatatttaatttatctattcatttaagtcttaagtgcataaagactacaaataggaacaatttatttagaaaaactcaaatgtgaaatatgtgtaacttttgtggatggagggagtattcaagtttcaatcagcagttctgtattcctatcaaattacttagctttattaaatacctcatttcttttacagcttctagttctacatttatgcgttggaacaaagcagtttttaactttttatgcttcattctggagaattgaaagataatttgaatggagctaaagtttttttggaggattataattgctgatcatgtgagcaaatgcacaacaaaagggagatgaggaggagcagcagaaaagagggaggcccgtggcgtgtgcaatgcgttcctgttcgtgtgaattgcgagcgcaacactagaacttcctgaagatattcccatgacgaacgggcagacttcttgttcgtgtatggaccaaattgttgtgcatgcactagaaaagttgcgttgtattattttgacgaaatgttaggtacaaaaatcaactatcataataatgaggtttatactctgggtttgaggtctaacgaccaacatagagtttgccaacatgctaaattaacctcttgggaattttgcagttggtttgctcatcagcactaataagatcttagttaaccatcttaatcatgtatcacagaaaataaataaaagataggcatgcaagtgtgaaaagtttttttttttaggggaaatcaggatttccattactatgacaatgctgaatcatcaacaaccaggtacatcatttgtgccggaataggagccaaaacaggggcctccgtcggatcgcagacactacccatagctgccagttcatgagctactctgttacatagccgaggtacatgactaacactccaggaaatgaaattcagacgcagtaagtgtgaaaaggtttctcatgatgtcgtctccatagttcctccttttaccatgaggatgcaattattgcctgaatctattcaccagatgcaaatgttatatgaatttattcaccaaatgaaagccagtatatatgttttagtaattttagcaaaaaaaaaaaagaccaaggcatatcatttttctttcaaagttgcgatgttattttacaaatgaggctacgtaccaaaacttttgttaagcaatttctgtgcacttgcttttcataagcaacatagtgaaagttaaaagaacaaatgccaccgtacgttagtaccggcatattgttagggtctgtttagatcccctcgcaaaatttttcaccctctcacaccgaatatttggacacatgcattgagtattaaatataaacgaaaaaaataactaattacacagattgcgtgtaaattgcgagacgaatcttttaagcataattgctctatgatttaacaatggggtgctacaataaataattacttatgacggattaattaagcttaataaatccgtctcgaatttacatgcggattatgtaatttattttgttattagtctacgtttaatacttcaaatgtgtgtccatatattcgatgtgacacgccaaaactttacaaccatagatctaaacacccccttagttaaacaatataaacaatacaataactctctccagaaatctcaaatctgtcattgtatgcttgcaagccaaaaaataggttattttgctgttgtgttttttttattaacgcaatcactagtatcttaataaatggattctgtagtactccctctgttatcaaatgaaaggaatttacctttacaaatcaaacttttggaagtttgattagatctaaagaaaaaacagtactccctccatttcacaatgtaagtcattctagcatttcatatattcatattgatgttaataaatctagacacatatatctatttagattcattaacatcaatataaatataggaaatgctagaataacttaccttgtgaaacggaggtagtactattttcaacaacaaacaaactattgcaaaagtatattcaaagataattttaattaaattaatttgatgttgctgcatttctatataaacttgagtgttttgtttggttacgtgcacgctgactgccttactagttggaaagggtactaccgtaggtgacagaaaacatcaatatctcaggaataaattaacgaaactaaaataggacataatacacactaccaaaccaaacggaatacccagatgtcttttacagccctagtcccaaaattatttagacatactacatactccctccgtccctaaatatttgacaccgttgactttttttaatatatttaatcgttcgtcttattcaaaaaatttatgaaatatgtaaactatatgtatacataaaagtatatttaacaatgattcaaatgataagaaaagaattaataattacttaaatttttgaataagacgaatggtcaaacatgtttaaaaaagtcaacggcgtcaaatatttagagattgagggagtaatagataagagagttgaacgcaagatccaaattattcagaacactctctcgatctcaccgctgccattaggcacgtgaagtttagactcatacttgatcattcggagatcccccgtgccgccatttgcaatgccactactagtatcatggacacacggcacgacatcgacaccagtcaagacaacaaaacgattatcaactatttgatcataatagtagcccatgagatggcgagtgtagaaaaaccttgcaatgcagaacctgccagagcccagactgacaagatgagagttggataaatcccaccaattcttgggtggggaaagctccatccaagttttcaatagctctggctgctggaagcagtcgtcgtccatggcggagaggtcagtagcagccaagtggttggtcttggcagagaggccaaaccagagcttgagctcgggtacatacttaaccttgccgttgaagggcaagatccactcaccgacatgcctccatgtatgcttcactgtgtccatgcagtaagtgccagccccttcaaccgatatgcacatctcagagccaccactaaccactgcgtacgaggtgatcttggtgcgtatgttggagaatttggggtctcggacgaaagggggtggagggagggattggcaggtggacgaaaggtggcggcgaggggagggcgtgcggtagacaaaggcctcaaactgatcgctgcgcggcccactgcttgtcgacttcggtttaacaacagactccatgatgaagaggctgccgctgtcattatcaactccggtgctggggacaaacaaggagagtgggaatcgcttgggctgacagaggccgggcatggtaacagcgttgcgtgtgtctccgtcgaagagaaaacaacacccattctggtcgatgcagagcacctcgcgacctctaagcgggaagcatccaatctcccagtgatgggccacacttgaagcttggaagttgaagatgggtcttggaagttgaatactatccatgctgcttgcgccggcctcctcctcctccttattattattcttctgcttctggatgcaggcatcagccgcgataactttggactctgatccgttccgattcggtggagtagcgttgaagaaattctagagcgtgaggtcgatgcagcgcagcgatttggatccagggaagccgttgtccacgattagattcagaaacctccgggagagggccattatcggagtgaacttcaaaatcaaaataaacaacacgaaaagcatttgttaccaagaagtaaggatgaaatcatcaaaatcaaaatcaaaataaacaggaaagatttgtttaccaagggaaggggaaaaaacaggcctaccttaggtccaggtacagctgctattgtgagggaatgagtgattccagcaaggaggagagcgtatagttgcagggttggcaagaaggcatcaagtgagcagccttatataatcatcagagagaacaaggaaagagagtggatgtagatctcggggaaagggcatacctcgccaagccggagaagggaaggaggagcacccagcacccccaacagaatggcggcagccggcggggatgggagtagggagatctgctagggataggtctacccgacttgggtaacctaattaaaagattcgtatttttatatcttatattaactaataacctaattaaaagattcgtatttttcctttcgtcacttgtttttcgtccgtgtaagcgctaattgtccgcattgctcacgatcccctccacccctgcgcatcatacccgattactcggatcgaaaagaatccgaaataaataaaacagtcaagaacaaatcccatcgcgcccatcgtcctgaaccccgatcgttgtttgcatcctcagaatcaaagaaaggaaaaccaagttgtattaacaaaatcctcccaaagttggaataattgtcccaaagtttcatagctttaatactaccaccacaaagccaagaacaagaacaaaagcttaaaaaacaaataaaaataccaattaaaaaaactaatatttggtctacctctagccgcttgagggttttcaccctcttcttcaacgactacagcgggcgggttgctggatcaggcgcccccgagctcaccgccgccagatcttatagccacaagatcatgctggatgagagaaagcaggaggaatcggagaggacgacccagatctggacgctttgagcggcggcggctgcggcagcctcatctgcctcctctcctctccgtcttccccgcgcccttccgtccctaatccggttgccggagctgcggagcgatgcatggaagcagcgagcggtgccggtggggatagagacaacgcggtggaggaaaacagcgagcggcgcggatggggtggagccgtggaggcagcgagaggcgcgaccagagacggaggaagcgagaggcgcggtgctggaggggagcagcgatgaattgggagttttaatcccaattttctctgtagggagaaaattgggattatactatcataaaagaatgttttcgctgaaatgctaccgcttcaaagtgattcactggaatgccatcctaaattgaaggtgttcactaaaataccatttttggttatttttgtaaataaaaatgtttttgctcaattttatatttttctggaccaaaatacctctgacgcgagccccacctgtcatagtctcttccctctctcttaccacttttcctctctcgatgacgccgtcggctggtgggggtggcgtgctgcgggcagtggccggcggccgggaggcgggcagtggccggtggatctcgcgaccgacgtagtcctcatcgccgctgaggtagtccacgccatcactgtccgcatctccgaggtcctgctcgacgtcggcttcgccattgacctcgcgcacgcgctcgacgtgggtctcctcgccgcggaacaccgtgcagctccttgtggacgggctcgtcatccaggcgcctgccgccctcggggtaacccatggtcccggaagcccccgccgcgcggcggacatccgcgatggcgctctggtaggcctcggccagcaacagcaactcatcttccccaactctctccactgctactgttgtcgctggctgcccctactcctcaagatgtggcgaccagcagaagcaacaactcagcaagaccagagcagagcatcgccaccgcatattttgagggaggccggggagctgctcgcgtctgggcgtgcggacgtgaactacgccggggtggtgtggctcaaggcgtgcgctcttcctcgccgccggcaacggggacgccgcgctcgtccgggcgctgcttatgagtgcccttcccctgcccgtgcttctcgaaattcgaggtgttccaagccggggatgccgccgtgccaccgaggagcagctcgacgacgtgcattaggccacgctcgccggccaccggcgcccgtcctcgagacaggaagaggggaaagagagggggagagggaatgacaggtggggtctacatcaagggtattttggtctgagaaaatagtaaaattgcaaaaacatttctatttacaaaaataaccgaaaatagtattttggtgaacacgacgtgcaaatcgatgggaccacttgctactggtgggtgctcgtactattcaattagagcaggtacaatagcaggctaatgctattagccagctataaatatattttaatgagatatacaatgagagataagagcagcgggctacagatctgtagccagctacagcacagactttaagacatactgtgtgtatgacaggtgggaccatatattaatagtatagtaaacaactattgtatgaattagctattaaattggctatagatgaattagagctagtagtgggctgtactattagacttgctcttagtagtacgtactcctacttccattcaatagattaactactccctcgattccaaattgatttatatatagtcttttttgaggttattcctaaatgatctacatatttgtgttcattcattaggtctatttgttatttgtacattggagtaaatgaacattgatgcatgcatccatgcacataagcatttataacccacatacaatatcttgatttgctattagccagaaaatagtggggatggtgcatgcattgagtttgttgctagagtaaatatagtataagagagttattaacttttcttggtcttgatgtacctttaaaatatgtagatcaatttcgaatagagggagtataatgtactctgtcagacaaaaagagatatttttctcgtttcggttaatgaaggctgctaactaaaataaattaaatacttacgacggaatttcttagtctcgatattttcagtctccatcatgctctttcagtttggactttttttttcccaccccattgatggatgtatggacggcggatgggggagctcaagcgctgggagtagggatgggatagatgatgggagtgggaaagcacatgatcatctggtatttcggctttttcgggtacctagaccggataaacaaaacaagaatcgatcttcataaaccccagaccgtaccgcagagtagaatccgatgatcgactcaccagcggtcagtttttttcacccctagcaaggccctgcgcttcactaaccttcaacgcatatttcactaaccttcaagataaatacttgatgtattaaaaaaacgaacgaacttagaaaccgactcaaatacggacgacgtactaaattatcggcgaaaacatcattattatttcgggacacattaactacttcaaaaataagtaactttctgatcatcataattttttcgtccgtgagtccgaccgagcgacgccctccgtctccgcacgtgcgtaatcgcgtacaacaaccaaagcaaaagagagagagagatccatacaaaatcctaatcgcgtaaggagtacaaatcataacatcaaagatcgattgaaaaaacaatcgagcaatcatagtcttgcatgcattagaactaaaccagccgataatcctagaaaaaaaagaagaaaaataaaagtcgcacaagttgctagagcagagaaatcaaggaggtgcaacaagttattggcgggaccgcgggacaaatcaatgacggtattgctgctcatagtccatgcctcaccttgagccaccaagcattggccggcgtgatggggcaacgtaaaggaccaggcgaccatcgacagctcggatgaagcccggtgcacatggtctacatcaaactggtacataaggatgttaacatgtgttcaacacttcatttttcaatgacataacaagtatagtccaagccagtcctggcctgctaaccattcttagcgacttgatccaaaaccaaatctcacccaaatgcttattatttaatctgaagttcttattcaataatccaaacgagtagaaatcacttctcatcaaacaaatcccctgctccttgaagaacaaacaaatcttgaagaaacaaatcccctgctgcttgaagaacaaacaaatcttgaaggaggaaaaacaattgaccggccgtcgtcgctgcggcacaaggtgtggccggccaattggaactgcagccctcttccatggcagctcgaagttacctgctcccagtctcccaggccgatggagccagtgatgggtagagagttggaggcagcagcacgggtagcgtagcaggctcgcaccgaacacacgtgggggttggggatggctgctgcggcgtcgtctcgccgaggaagatggatgggcgacgaggaagacgagagtagcaccgccgccgtctcccgtctcggctgcggcggtgtctcgcgtctcccagagacccagtctcgtgccctaatgtggtggcgcccaacgggctatgcgggatgggccaaacaattttgcaaaaccatacgggatggcccgcccgcaaatttacgggcttttttgtggggcgggactacgggccataaaaaaagccagccccacttgcacccctaattttaactccctcccatatactccttccatcccaaaatatttgacaccgttgacttttttaatcatgtttgaccgttcgtcttattcaaaaaaatttaagtattttttaattatttttctatcatttgattcattgttaaatatatttttatgtatacatatagttttatatatttcataaaattttttgaataagacaaacggtcaaaaatgtttaaaaaagtcaacggcatcaaacatttagggatggagggagtaacttcaatctaattcacatccctgaatcacaataccacatatctttacactcaactattagaactggtttaatttaactctatcagtggtttgaagggaggttgcgctgatgtgacgcttcgacttggtctaagctgccgagtcatcttgtggagcccacctgtcaatgactatatctcttctcttcccttcctttccgcttcatcagatcggtgctacctcatcttttgccttccgctccacgtcgggccaccgttggggagaagcgcgaacgtcagggggagtggcgacgagccggcccatggcaacgagctcgccaggtcagcaacgggcaagacgacataccgaagacggttcagcttcgtcctcctcgacatctccatgccctagcttgcgcctgctgcatgtgcttgagtagcgggtatagcggtagggcaccgcgatctcctggctgccgacggcggccgggtcgttcccctcgacgacgacgacgcacacacatgaagccagcgatgcacccggcggtggagaactgcaccgggccgaggaacttcccttcaggcaccaaatggcgtagggacgacgacaacgagatgacagctttctcttttctcttttattttttatatgtctttatctcaagatctgagctaatcaagttgtattttttttccatttaatttttaagtatttatcttagaatttgagctaatcaagttatttgagttagcttgattattttgcttcatggcttttttctgattgtgtgccattctatacgaaacaaattatgccgaacatcctactttcaatggaagtgttatactccctccgtttcataatgtaagtcattctatcattttccatattcatattgatgctaataaatctagacatatatgtttatctagattcattaacatcactatgaatgtgggaaatactaaaatgacttacattataaaacagaggaagtagtaattttatttccttgctttttacttatctgtcatagaaggtagatccgtcatatacgtttggattgatttatttgttagggatgagttgtaactgtgtaatttctctagcaatatcattcttttaaagtgctccaatcttaaaaattaatcatctcgtgaaatttgagtgttgccgatgcaacgcatgggcactttgctagtatatataaatagttggaataagtacaccgaaggtccctcaacttgtcatcaggataaaaaaacgtcctcgaaccgtaaaaccagatatgcggggtctcttaactaaccaaaaccagtcacaatatgtccctcgatggttttccaacccagttttgtctaacttggcggctgagtcagcgtgggacccacgtgtgcccccacatgttagctggccatgtcatcaccctctccctcctctccctttctcctctctctctctctcactcttctcctgtttgggtaggcagctagggaggacgtcggcgggctgttgccttcggcggggcgaggagggagaggacgagggcgttggcggccgacgatggtcgacacgacggcgacgcttggcaactagcgacgcgccgccgccgctgctccgccaccgctctcgcccgccattgcagaggccgcaggcgcagaggcgggccgccatcgagggaggaggtagggcaagcaaggggggtggggaggccagtgggcggcgaccttctcaccggccatgacatcgctcgatctggcggatctcatcgaagaaataggcgtcgtagacaccgcttgcgtgggcgaagtggacgacgctgaagaggcggtgcttctcgacatgggcgagcgcggcgttgcgccgctgccgcaccccgccatccgaccgcgttgtcgtcactactatcagcatccgcctcgacctactccccttctcctcctcgtcgcccatgtccaccaccgcgccgttcctgaccccgaccccggccgcctccgccgccgccgcatccagcaccaagctcacctgctggttcactgcgacgtgagacgcggcaagctagtggtgcggctggaataggagaagaacaactagcgcggagaaggagaacagcgggcagcgtgactccggttttgtccgacatggtagccgactcagcgtgggtcccacgtgtcagcctcttcttcccgagggacctagtttgcactggttttgtacgttgagggatgcgttgtattcggttttacggttcgaggatgattttttaactcgatgacaagttgagggaccttcggtgtactactatactactactacactactgtatacaaactttgtgtacgcgtatacaaactttgtatatatgtaaatacatacatatttgaaaaccgaaaaccaagaaaaaaacaaaaaaaacaccacgtatagaaaaaaaaccagaaaaaaacgaaaagaaaaccgaaagaaaaaaaacgagaaacgccaaatctggaaaaaaacagaaaaaaacgaaaagaaaaaccgaaagaaaaaaaacgaaaaagaaaacgagaaacgcgcgcacggcgctcccgcgccgttccaccgcggccccctctccgcgcgtgccacgtggccgcgccgcgcaggaggggaggcccgcgactgatcgctttttagcgatttcggcagaacctatccctagcagatctccctactcccatccccgccggccgccgccattctgttgggggtgctgggtgctcctccttcccttctccggcttggcgaggtatgccctttctccgagatctacatccactctctttccttgttctctctgatgattataaggctgctcacttgatgccttcttgccaaccctgcagctatacgctctcctccttgctggaatcactcattccctcacaatagcagctgtacctggacctaaggtaggcatgttttttccccttcccttggtaaacaaatctttcctgtttattttgattttgatgatttcatccttcttcttggtaacaaatgcttttcctgtagtttattttttatcttgaagttcactccgataatggccctctctcggaggtttctgaatctgatcatggacagccgcttcccagaatccaaatcgctgcgctgcatcgacctcacgctccacaatttcttcaacgctactccaccgaaccgaaacggaccagagtccaaagttgtcgcggctgatgcctgcatccagaagcagaacaataataaggaggaggccgccaccgccaccgtaagcagcatggataggattcaacttccaagccccatcttcaacttccaagcttcacgttcaggtattgacgactattggaagatagactgcttgccgctttttgatcgcagggtggtgtgtgcagaccagtcgggacgctgctttatctttgaggcggaagaagacgcgtggttatgctgccctgtcttcaccagcccaaggagatacccatctccatcttcgtcccctgcctggaggaagccggtgacttcgacggtggcaacctttacataatggataagaggagtaaaacaggaaagttaggaaacaatcaattcgaggccttcatctactgccactatcgtggaagcagcaccttgaagtcctggacccgccagatcctcctgccaccgccatgtatctatgacagagcatacttgggcaggtacctggagatcagttcctatgctttgcttggtgacggctcgaacatctgcatctctgtaaaaggtgtcggcacctattgtatggacatgcggagcttcacatggagccacctcggcaaatggatgctacccttcaccggcaaggttgagtatgtacctgagctcaagctctgggttggcatttctgccgacacccaagacttggctgctgctgatctctcatcgatgaattcccagccacagctactagctacttgtaaggagtttgaccagccagaggaatggaagcgatgcaaggattctcaacttgtcaaccttggctcgggcaagttctgcattgcaaggttctttcacaataagactccccaaggggactccgatgaattaattgggaagaacattactgtcttgaccggtgtggaggtggtgccgagtgtttatcatgccaatggcaacgacaacagtaggaaaggggaactccaaatgatccctcataaatcgagattgtatgctggcagcgataccatctgggcagtgttgtgaacaagttcggacattctcctgtgctgtccatttcatacttcgatgtattttgatagtcacctctgcagtggtttgtaatgaagtcatgctaccatttaatggcactcttaatttgtgttatctccttatatgagtgacgacttggcttgccgagtgttgagctctaggatcataattataactgtaattaattggtatcactgtgaccctgttcttttcttcaacaaaatttgataaaattttggatactcgtggcacgcttttcaaattactaaacgatgcgtttcgtgcgaaaactttctatatgaaagttactttaaaatgtcatattaatctattttctagtttgtaataattaaaacccaattaatcatatattaatatcatctcgttttgcgtataaaacttcatcttcaagagaaaagaacgtcactatagaaataacggattactaatttaccggctcacattcttcattgtgttggttacactttttccttcatggttttggtttcactttttctatcttactttgtctctgttcatcatattataagtcttcctttcatattataataattaagtcgctttgaaatattattaatcgctttgaaacaagggagtatgtcttagattttgtttcctgaattgggacatgcttgccgaaataaaaaaaaatggtaaggtttgtgctatcctagctcaaaaataggattattataccaaaatcacttcttttagtgccaaaaggaggtgaactataggagtcggaacgatatgcgcgtagtaggaagtgggggacttagcttggattcccctggtgtatttttctctagggcctgcttgggatttgggaacaccacatatttttccccttatttttaatgaaaatacacctgtaattctcgtttacccaaatcaccagtgaaaaaagagtcgttggtatgcttaccgtttgaaatgtgaaacattcttcaggaaaagctgtgacaattaaaaaagcataacatctttgatcgatttggggacgaggattagaaactgagtgcaaacattccaattaaattacagagagaaacaacacaccatagctagtaggctgtgttcctttccttgcgttggaaacccattttcttcacgtataaaacggagcggcatatttttttttataattaattaaatatttactaattttttttaaaaaaaatgggttaatatatctttttaaagcaactttcgtatagataattttttttaaaaaaataccattcagtagtttaaaaagcgtgcccgtgtaaaacaaggtagatgagttagtaaagttggagaaagaaccgatcgatcaagaaccaatcgctaaaagagctagaaatatagtcagttctccgagtggagtaaacccatagcaacttgcccaatggttgaatattaataccggttcgtttaaaaaaaatggttgaatattaattgcatctaatcctatcttactataaagttacccccactaattccttaagctcatacaaagatatcacatcatcatccattaatccactaattaacaagatgccacatcatcatccattaacaatcatcacatttaaacatcatgcaaacatgctatatctttatgtttttataatttaagagttttttaaatataaacatgttaaattatcatccaacataattcatataatgttttaatgtatatctttattgtgttttatgatatcctatatacttatatagttcatcctcacttagttagtgtttaaatgattaatctatggtccaaattatctttcttcttttttcctctaattaagtcatatcacatcaattgttttttagcctttagatgattaatctacggtccaaattatctccctatttttcttcttccataaagtcatatccccttactttttacgtttgaatcaccgttctacatactatttaaatttaaactatcataaaccacattaatttaattaatctgatgttatctagctatcttacacgttattttttttattgttatcatactaaattcccgcagcaatgcgcggggtttcacctaatttatcaaatgatgaagggacaattgctcattttatcctcttttgaagtcaaactatcaatctgatcttgttttttcaggtttgtttatttgaccctcttgaaaacagatcaaggctttttgtttatcgtgaagacaatataacattgttaactaagggataaattgccattcttacccttgctcatttgaccttgaaatatcaaagttttgtttatttggacttttttgacatatttaaaacaagatttgcaaattttaaaatgtcagattttaagtttttgccaaattttggatgtttacaatcttatgttcataataggatattttgataagtttatccaaattttggaagtttttgtcctaggggtattttggtcatttggatgaaattgtaccgtgctaacggaggctaaccggacggcgatggtaaatcgtagaagttaaacaacaaccgatggcatattgtagaacataacaaagtcagtggtaaatcgtggacgtatgacaagtcagtggcatataatgaattctctcttatgttttatattcatcgtatcatgtatatttactagtaactccttcatgcctccatgttttcagtattgttatgatgctctaaggacatgtgcaataatcattagacataggaggtttttagtcctaccaattgggaatattttgctaatacgaaaaagaaaaaaagaagatgacgttactgtagttaacagtggctcaacaatgacttttgacctctatattgaaaacatggttacataagggtgaaaaaaaagagagaatagtaataaaaaattagtcaatggttagagatttatagtctcagctgttgtatctaatgacagtccctaaataatcttgtactactattacttaaaagtagggatgaaaacggacggaaactagctttatcatattcgttttaatattttttttcgaaatcggaatcggaatcgaaaacttggatacggaaatgaaatcgaatattatcgaatacaaatacggagcgaatacgagacggaacgaatacggtagcgaatatttatcggtatataaaaaacccctcaaattgagtttcttgatcaaggaagagatatcgcttattattttagttcaacatctccaacatttatatcgtcaattttatagacggtcccacaactgtatgtggaaatcgattttcatggctgttcctctaagagatccatatgcaaatatgattatcattttctattcccgagacctttcactagatgtataacttacttaccattgtataaattggagattttgtttattttacttcacatcttcgaaacttgtaatgtttgtattgtactttaaatgctttcaaatacaaatgttataaactgcaaagtggtagatcccattgagctctacaattttgatatggaacacatctcctcagatgtcgttgaattgtagatctgagattttgtaaaaattaatatggtatattataatgaatatttagacccataaatgacctcaaataataaaatagtcaataataaagttgtagatctcatcgagctctacaatgttgatataaagtttgtcttcatctgattccgtatgaaaaagttatgtatatatacgtgttttttatataatttgcttaatgtctgcggatatctgaaaaaaattctggatagtttccgaccgttttctgattccgacggatattacccttactgtattcgttttcgtttccaagaaaaaatatccgaattcgtttccgaatccgagaatttccggataattccgactgaaactatcctaatccgaaaaatggtccggacggacgaaaactatccgaaccagtttcatccctacttaaaagcttacagggtggtgctaatatagctaaacaaataatagggtgatgggatgatccttctaggtaactaaccatgttataattctagctcatgaattactcacttcatcccataatataaagaattttgaagggatgtgacacttcttaggactacgaatctggataaagagcctgtcaagattcgtagtcctagaaagtgtcactcccctctaaaattctttgtattatgagacggaaggagtatttgtttttgtaatatttaaatccatgatgtagagtattatggtcaaaaatagcctttttagataactaatatactggtagacatagatttacctccattttactgcatgaattccattttttatacatataagataactagataagtcccatatatccatgaactgagaacatttatttacgccaaacattatatgtctatattggtaaaacaattaaatatatctgttctttataaaccgctatcacgcttgaaacacgacaaaacttgttgaatataaataattgaaaagatgcaaatcatgctctcgctatcaccggtaatcaggagcatatggacagcgacaggaagagataaacacgaactcatgattaatactgcctagacgctgttgattttttatctaacgtttgatcattcgtcttattcaaaaaatgtatataattattattcattttagtgtgacttaattcatcatcaaatattctttaagcatgatataaatattttcattttacacaaaaataaaacgaatagtcaaacattggttaaaaagtcaacgacgttatacattgaaatacggagagagtagtaaccagctagtacatctataacacccaaaaagaaaagtccctccccacaaaatcacagaaagagaacaaaatgaaaaaggaaaaaaaaagaaaaaaaaaagagacggagaaataatacggccggcgtcgcgccagccagcggccatgtccgcgtctgcatccgctgtctgtctccttcctccccgaggaggaagcctggcccgacccgacaccgcactccccccagccagccagccagccactgtcgcggtgaaccaaaatatcccccgcctcgcctcgcctcgcctcgcggtaacatccatcacactcctcccccgccgcggccgccgctgcgcggtagatctcctcctcgtccacctccaccgtctcctgctcttcctctctctcttctcggaggaaacccccaatttattccttccccgcaaacccgcagccttcctaaaacgaattaaatctccctcccttatccgccgctgcaatccctccccacaaaatctcgctgcgccgcgcgctgttttagggtttgagctcatggcggtggaggaggcgagcagcagcagtggcggcggtcgtggtgggggtggcggtgggggt

SEQ ID NO: 28285 - DNA, 14296 bp, Oryza sativa
aggaggtaaaggtggaggggggcatggggagaaggggtcggctaagtcctctgagcaggagcgccggaaggggatcgcctggacggaggacgagcacaggttagctttgccttcgttcctatctaccaaattgcattgctgctctagcctagacaatatttgatgattgcagaaactggcttctgttcggagcctgtacaacttcactgttttattgtggattaatccgtctagtcattgtaaatggaagttgaaattgaaatgctctgggaattttggaaatcgctgtttagacagtctagcagcttcttttggttgcagaactgcatacttgtaggtgtgttgctcttcagctttctttgcactggacaattaggtagctcccttttctatttcttgaataaatgattgcataggagctagaatagtagtttatttaatcgtgaattaggtaccgcttctgtgttgttgggaattttgccgattggtttgtcttgttattgcagcctgtttacgattttggaaattactgcttcagaccccaggaagtaggcttgttggtttgtgtgtgctaggttttgtcccgcatggtttttttatgggtttcaccacttggcagtttatgttacatcctgcatagttcttctcagatggagcggctgattacttgtgctgcatacttgttttcaactggaagtggttcattggagatgttgtttcttccttgctagtttcgacaactccagtaactacttaactcaatcaatttttgaattataaactgttttctaacaataacctattcacgttacttcttatggtggatcctatgcatttcgagctacatcccactgatttagttttaggtttgtttctcatttcttcttgctgaaggcttgtttaattgattcatcttagcatatttcaccttcctcctaaaaggatgagaaaattctgttcatagcacaattcgtaaaatacaactaagctttttctcactctgcttaataccatagcgcatcagttttttgtttgaaaaataccaccgaaagaccaaaataattttacttcaattgcaatgcaacaagacctacctcttacgcattcctgtttgctggggttcctctggcgcgttctccttctctttgttcaatctgacacctccattagctcatacatcatctttaatcacaaaccaacagatcaaacagatagtttatcaaatatctttgtcaccattacagaaatctcctatttcataggtacaaataaaagaaagaaagcaaatctgtctgcttgcatctactttgattttccgaacgccaatgctcaatcccctacatagctccagcagttcatggaatacaaaattaaacttggtcatttggcttcaaagtggagtgaagaacgatgttgtgcatgtgcgccttggcttccagctagaagatcgattagccattgacctgggttaacacgtggtgagccagcaggctagcgtcactggcaagcaaccatacggccacatccaccaagcgcgtttgctgtgtgcaggttggagggacggcaatcaccatggacgtcgctaagcttcgagctcacaggagttggttgagggtgaggcggtggcaccagcaagtgaccacactgccgcgtccagcaatcgcgagcatacaggggaggggaatggcggccaccactagcccgtgcctgccgagaatgacgaaacacaagcaggccccagcagcggaagagggggttagatcaagggatttgaggatttggaggagatggggaattattgttcagtcaggaacttacaagatgggttcgaatcatctaggctcaatctgagggacaattttgtccaaataaactcccgttagctcaaaagatgacggtagtggtatttcccctagaaaaacccacaacctgtggcattatgaaggtttgtgctattttctgaatttaatggtcagcgtgtgtcatggacgaattttccctaaaaggagttagaggaatcaggacaatggtagcttataactgatttttgtccatcttaaatttatttcagcaaaatgaacattttgaacgcatttgtttcacatttcatttttttttccgtatttgatatgctaattttagttgaaattttcctgctagctttagaccggaacaagctagtacatgcttgctgtgcgcatataattggtttttgtgtcttttagacatagtcctgttttcatttgcaacctgtttcttccatgatattgtggacagtatttctggtccaaggagataaaattttgatatcttattggcatattggtaatattgaatgtgttttatcagtatataaggcagtatgcttgtcagatccccatataaaatgatgtgattatcgtgtatttttgtctgtttgaatggctgaatgagtgaaatagacataacataccaagatgatgcagagcatgaaaatacgtttcaagtagaagtaacctgatgccctgatggatgctaatgtgttgttcgttcattgccatgtatgcacatgcatgatattgattacaactcaagtgaaagcatggttgtaaaaatggcacaactaacctccttttgttctgatgcataaatttgtagctattacccctctcttcaggatgagaaatatccaaagttgattaattcatgcagactgccctttactcatatggttattgatgtgtcctaccacttgattttaatttgcaggctgttccttcttggacttgagaagtacggcaaaggcgactggaggagtatctcaagaaactttgtgatctcaaggacacccacccaagtagctagtcatgcacagaagtattttattcgcctgaactcaatgaacagagagaggcggcgatcaagtatacatgacataaccagcgtgaacaatggagatacatctgctgctcaggggccaatcacaggtcagccaaatggcccatcagcaaatcctggaaaatcctctaagcagtctctacagccagcaaatgcgcctccaggcgtcgatgcttatggtacgacaattggacagccagttggtggtcctcttgtgtccgcagttggcactcctgttacacttcctgttcctgctgcacctcatatagcctatggcatgcatgcccctgtccctggagctgtagtccctggtgccccagtaaacatgcctccaatgccctaccccatgccgccaccaacatctcatggatgagggctttgaatactacagttcttctagacaaactcataatatctgtcttgtttagagtttcaatgcatgctgttatgtctcaataaagcaatatcaataaactcttgtacattacaaatggttattgaatgtagcattttgaggacatcctggactgtatttatcatctttgttacgcctgcacttcgttccatcttcaatgtacgcctgccaccctgccccagtcgtaaaatggttggaatgctgaatctccttcagcccagatgtagtggtttattatctgaaaagtaaatatcgagtcaatacgtaatcatgaacatatgtaatggttcagtaagtatccgactatctgattcgtaattatgaacagatgtattggttcactacctgattcgtactagtaatgaacctggtgcaggtacaaagagatcgaaaccttgccgtgctgctctaactccatttttgttgcactggttatttgcgtcacactaataatcatggtggtcgtacgtgacgtaataacgtattatgtcgtcagtttcgctcttatacatttttttttgtctgacaagtttctgctttttaagagcgtgccaactatagcagaaaaaaagaggcagcaaatcctggaaaatagcaacgttttacgttacattccgagtcatttccatccgtcacttcctggtttgggaggtgttaccgttaccatcctaatttaattcctcctaatcagtaatcacccttgtaatcaaagcttctatgatttaatcattcgtgtgaaaccaatcgtaaaaccccaatttggttattagcattaccacgatcccattggcttcgtgagagacgcgattgcaaaccgaacggtcatttccatccgtttttattgttttttccgctcccaacgggccgcggcccacgacatcaagaaagcttctcccatcggcccaactcctcctcccgatctcttctctctctctctctctctctctcaggccaagcgcgacgaggggacggcgacgcaaaccacaagccagcgagcagccggcgaccaccgcgccatcaacggcgttcgagattcccctggagatcgccgtggtgagaactcgccaggtatgcgtgtgctcctctaccctaaaccctagcccgatctcctccggccatcccgcctagcgcgaccaggtcttccattcccgcgcgcctttccgctgcgtcgagtcgacgccgccttcctcaaccagcaccgacctcgggccgccgccgtctggtcgctttccgctggatcgctgcatgttagatctgggcattccagttcttgaattttgtaaaacaattttgttcttgatgatatgatactgatcaagtgcgaatccgccactttggctcagctgcaaaacccctcactcatttcaaataatctgatgctgcatttttactgtagttgatttacagtttttttaatgtgtcgacaaaggatattttatatcaacaaaggttagagattatgtcatattttcaaaatgcaggaacatctctgtcaatatgatttatcatttgttaggcgattgcagcatccatcaagctgcaacccactcaacacatccgtataccctttttgtagtcatctgaatttgataactctagaatggtgaatagtcatgttagattgtggttcttttaaaaaaaaaaagttagattgtggttcactggtttcagtcttaatatgctcaagccagaatgtacttgatcatccaaaattccacatagtttgatttgtgggtaacttaatattgtaagtgagattcttatctaaaactgttggattaccatagtacatgtcttaattttggatttggtaaatcacataattgtaactttgtaacgattgagcatgctggcggtgttggttcttttcatttggtttttttaactatattgcctacaaaattttacggaagcattcctgaataaagtttataactatagatattcattttcttatgatttcagcatgaatgcgcaaagcaagtttcataatttgtctgtcatgtttcaggatgaatgtaacttatgaagcctacaaatcattgatgtgattttagcttagctcagatcaggattgtggactgtaaaggtgagcattcgtggaagattgtttctatctcattcaattttgaacaatctcacactgaattttcatgtggaggtagtgtatatgcaataattctaacagtttctacctatttatttatttttttaaaactacaattgatttattttcaccttgccttttttcttaacagtgtaacagcaaagtgagctccctttcccagagaagatttttttggtcatctgttcccctacaaaaaaaaaaaatcccccaaagtgaaccaagtcttcgaaatcaaaagagagcaggagggggcacctaccccttcaagcccacggctacttccaccatcggtccatcgtctctcacactctctcactctctaaacagcacacaaggcaaagctgcgtgctacgtgcgcgcgcatggctgatgctaggggctcctcttcttcttccggcgatggcggtggcggcgagggcaagggcggagcaggccatggtgactttgtggggggcggccagcacaactggtaccatgggatccttggggccgtgccgccgcccaacgttgggcgacaaaacatcgtgcaccatcagtaccctgctgctagcttgatccagcagcaccaccagtcgccaacaatgccgctaccgatggcgcagctcccctacgtgccccaatacaccgtgctgcctacgcccgccgtgctcccgtcgcaccaccaccaccacggccagtcgcagatatctcaaggttagttctctcctgctccacatacatgatactccttccgtccctaaatatttgacgctgttgatttttttaaacgtgtttgaccgttcgtcttatttaaaaacttttgtgaaatatgtaaaactatatgtatagataaaaggtacatttaacaataaatcaaatgataggaaaagaattaataattatttaaattttttaaataagacgaacggtcaaacatgcttaaaaaattcaacgacgtcgaacatttagagacggagggagtacatcttaattttctcatggctgaatttggcacgacagatcttttcccccatagggtttttttctaggtcgttctagggttacttatgtgcacgcagagatctgtgtgttttctcatggctcatgctacctagatgtgagacccggtcttgcatttcttgccctcgtcagtgttattattcctgccaacacttgatgcttcatgctgtttattctttagttccttctcgcttgtctcccaatatgacctatcattaataattttgtttgatcgttcttcagaaaacttccaagactgggttccctccaacaatgttgcagctccgcatgttcccagcgcttttcaggattggaggcaaatgtgcaatgggtcggcattcatgccttttggccaaactgctgccaatagcaatgttttttaccagaatctgaccttcaattcatggactagcaataacatgccgaggaaccctgtctacactagtttccaccctgctgcaattgaggatcaccatgctcctctattccatagcaacaatcatgacatagacccaggtacatatatatgcacgcatgcatggtctttgacaaatattaaatagaatatgtacatggattgatattctgtgcaattatatatagagggttagaaaagggacattactacattagggtaaaccctcagggctaccaacaaccctgggagagtaggataaagtgagtgtttatgcaaagtgtggaatggggatttgaagtagaaaactgtagtggttgtaaacggtttgtctcataaaccacttaccctatttagattagttgaatacgtaattgatatttaagatgattgttcctgctctaccaatatgaacttcgcactgtctcgtgcgagtcgttaaacaaaaagatatttaagatgattgtgctataagtaaaggggatatataggttatttcctttgaagatttaagggcatccacaatgtagaaattgagggggtcataagctagacccttaagttctacatatacattgtggagatggttcttacagagtttttgggaaaccgacacttgcatggagttgacatcgccggagctccacccgcaaaagccacctcacctgccaccgccggaggtctgctcacgaacacagcccctgccaccgtgtcacagatccatgcgagatgccgccgtcgccaaatctaccgctgctgtggccttcttccgcgagcacctccaccatcagatccgtgtgcgttcgcgagggccaccatcaccgctgccagatccgcccgcggcctcctctctcatttgtacggtggcttggtgttttggcttgttgggaaaaggaagctgggggagaaacgagagaggaagagaaaagtggtggctgggatggtaaatattattgtattgaaatatggggcccaacttaataactcttcttgctatgtacatcataatgttggatcgcgctcctctgacgtaaagtcagagggacgtgggtcactgacgtgtgggcccaacctttgtgggtcctacatgtcagtgacaaagtccctctgactttacgtcagaggagactcatcccatgatgttatactttagttgggcccatttgggacccaccataaggccaaggctgcgttggatttaacatttggagatggattttctaccgtatgcaaaataagacgggctattagcgcatgattatttgagtatttattattacaaacttgaaaatagatttatttatttttttaaagaaacttttatatatataatttttgcaaaaaaatgtaccttagcagtttgggaagcatgctaacaaaaaaggggaagttgtaatttaaagttagaggtaaggaggccttaagccatatatacacacattgtatttattaattcaccatgcatttcatgtaagtatgcaaatatatatggggaaactattttgatcccttgaggatcccctatatggctgtgtgctactacttttatgcattgcctcactctaagcatcttattatgtgcaggcttttaggctaacttttttctttttttttggagataggctttcagactaacttcaggatggatcaagcatttgtacctgcttcttcaccttttccaccggtgtcatcatcatcccatagtttctcctcagctaaaatttcaaatggaccaacatatactaagaaagccaagaaatcaaatgtaaaagtaagactcttttagaactcgttgatagatttcgggttcatatgagcagtcctaatgtgagatttctacaggatccaccaattgtcttcagaaggagcgatatggagagcgaaaaaaacgatgataatccagatcaaactccggttagtgagcctccaagcatgaatcagaacggtgaaaatcttattattgtaagtaacacaatgccattcatcttgaatgctactattctctattagtacatgaatgcatttttaactgttccattattggtagattaaaagtatcattaacaattggtagattaaaagtatcagtaacaatttcattactttttaggataatggcaactattccacaattttttaactaaatgattctacctttagcaaggaggattagattgacttcaatcaattcgttctgcatgtacatcattatagtacgcagtcttcccggggacactaacttaaatctgaactaactctgaacttccaagcagagattcaactgtagagaataccgtgttatcttgcgcaaggagttaacaaacagtgatgttggtaatattggaagaatcgtgatgccaaaggtaaaatcttgtatattctcttaattaagtgacatcaacatattatattctacaacagatactgttctagcacgaaccacacaactactgtgcgatatatttagttatgaagtcttgagagttgagtgtgattttatttccttccaaattttgtagagggatgcagaggctcatcttccagcattgcatcaaagggaaggtgtgacgctgaaaatggatgacttcaagtttgaaactacatggaattttaagtataggtaatccgatcataatatcatattactagtctagggaattgtgtacagatcaccagctgaagttcgaatattatgtctgcaatgatgtagtaacactatgatctaattctatcctattgtgagaaagtactttaaattatatcaagtgcacgtgacatcatttcttccatgtaacccaataattataaagaaaatcttaaacgtagaataagatagattatgctgttatctattggtttacaaatatacaaactcaaatgtgatctatacatggaaaaaaaatcagactatgtaaagtgcaatcgcatttatagtctagataatatgtcaatctgcttctatctctctagataaaatttgaccttcacatgtttgtggagcaatagatgattgtacaataatcttctttgttagttttttttcttcaaagtttttcgtaaatcgtaattatctgggtcacatgagagaaacgcgaacatatatggcttataatctgcgtcacatattactgatataattggagatacctttcaggttctggcccaacaacaagagcagaatgtatgtcttggaaagcaccggtacgtttaaacactgaagcatatacttttggatttttctaagcttgtactgaacttgatggattgctctcttcaggtggttttgtgaagcatcacggtctccagacaggcgacatattcatcatttacaaaagctcggagtctgggaaatttgtatgtcgatcataaccacaattccttattcatcatttacaacctattggatttcttgtttccacacatggctaatcttttcaaatgtatttcctaaagttgtattactgttgtatatgatatagtatgttgccttatgcctcttttgaaggttgttcgtggggagaaggccattaagccgaatgccatcatgcctgttgtggactgcagctgcaaaaatgaactcaacaaaagcgaagaatgcgggttcaccatcagcctacagaccaagaaaacctgatggaatggcagcttcaggtcttgacttaagatcagcataagagagccttattagaaggcaatgcatgttgtcatgttattgaagaaatgtgataatgctccacagtttttaactttgtagataaaaatgcaagattgtaaattattatttaacaatccttatttttgacaaataatggtccacattagagattgcaacagagaattagctagaaactctctttaactcatacatgaaactctcaaggccatgaatacaccatcttatacttgcaacatacagagcctatatagcagttccatacttcgcaagtcgttaatgacaaaacatattcctccgtcaaaaaaaaagacaaaccctatgtttccgtgtccaatgtttaactgtcgtcttatatgaaacttttttataattagtattttcattgttgttagatgataaaacatgattaatactttatgcgtgacttgtctttttaatttttttcatatttttttaaataagacggacggtcaaacgttggacacggaaacctagagattttctttttttttaggacggatggagtagatgcattcataataatctaacaatatatattttgtatcctatatcatacaacatcatcatccatcttgaagtctaggtcttttttttttgtaaaatgggtttttataactgaaaaagggatttataaaattaatttaagagtgtgccaactatatatagcaaaaaaaaagcaaatcctgtaaataagataactggccccatccttgatgatctctctggtctaggtgagctccgtgccatttacttccacaacgtacggagaatccgacggtgaggactacaacggtgatagaagcggccccggtgccggagaggtggccgacgaaggtgtgcgggatgccgagccgacacctcacacaagcttttgtatggaggcctggagagaggggggagaagtagaagaagattgggccagtgacatttgggtcacacgctgactcagccgccacgtcagctaaaaccgctcttaatactgtatttagacctaatgtgacctggttttataagattagagatatgttatatcttacattctggttcaaagacgtttttaaaacatgacgataactcgataagagatctcaaagtgaactttttcctcctcctagtcatccttctaagactgcattcggtataggaagttcccaacccttctccctcgttttccgcgcgcatgcttttcaaactaataaacggtgtatttttacgaaagttgcttaataaaacatatcgatctattttttaaaaaaaattagctaatatttaattaatcacacgttaaacgctgctccattttatgtgctaggggatgagggttcccaacactccctcccgaacgtagcctaaatgtggtctacgactctacatagtgggcccccacaaattccatggcccatcaacttttggcccagaataggcaatggcccagtgatgctaccgatgaagcgatccgacgcgcccgcattccccacgctgctccctattccccattccccccacgcgacagtggagacgacaagtgaagcgatcgccacaagccgccatccgcagcgccgactccgacgccggacgccgggcgccgcgtcggcgccgagacgctcacgccggccggccatcacggtatagccaccaccgtgtccggcatccggccaggcggcgcaggcggcaggggaaggcaatgctctatatactttctctccatttctttcttatattttaatcagtgtaaaacagtagtaggatttgctgcgttctctgtgactgtgattatattaacggcgattgttttcttcagatttcagaaagcctgagtttggttggtattgttgcgcgaagataaacaggaaagaaagtgagatcagggaacaagtgtctaaggagaaagtggtatgccctattatatggctgaaaattatctcatctaatagttttattgtattcttagaactccaactgaaaccttagagactaacaatggttacgggcttacggcaagctatcaaggaattattagataaattaaggatacaatcatacaaactacggtgatttgctagttcaacataattattggtgatatgtttgaaataaattagggaatgatgtaatcatcggtaatttggatgtttatactaagggctttaagtgttcattgatacttcctccgtcccaatataagtgcaattttgcactattcacctccaatgtttgaccattcgttttatttaaaaaatttttatgattactatttttattgttattagatgataaaacatgaatagtactttatgtgtgactaactttttttaattttttcataaaattttcaaataagacggacggtcaaacgttagacacggattttcattgctgcacttattttgggacggatgtagtaattgttattatttagatgtttatactaagggttttcgtgttaatatttagaaatgtagacctagtttgtcacctaattatttgtttctcaaaaaggataattggtttatttttcactcgccttgccttatttttatcagtgtgaagacgaggcgagctcccttttgggagaagattcctttttaggcatatgcttccctacaaaacttccccaaagtgaacctggaggagattttttttttggcgagagagagagagtgggaggggcacctaccccttcaagcccacgaccacggccgccgcctcttcttgtgcacaaggggacgttgtgtgcttcgtgcacacgcatggccgacacgagaggctccacttcctctggcggcggcgatgacaggggcagagaaggccacgatgacttcacagggggcggccaatacaacaggtaccataggatccttgaggccgtgccgtcaccccttgttaggcgtgagaatggtgtgcatcatcagtaccccactggcctaatccaccacccgtcgtcgacaatgccggtggcgccatgctcctacgtgccccggtacaccatggtgccaacatccgccatgctcccgctgcagcaccaccaccgccaattgcagatatctcaaggttagtcttctcctaaccgccatatacatcttgttgcaccacgatcatctgcacttgttgaattcagcacgaagatattttccccatagggcttcgtctaggtcagtctagggtttattgtgcatgtggggcctatgttttttcatggttcctgctacctacatataagatccggtgtctctcttcccttgccactgttccttgcatgtcaggtagggtttctgtctcattagaatcacgcatgttcttgtgagcataaaaatcattctacagtttgagatccactgcaagtctgcaacaacatggtaactaggatcttcaatgtaattcatgtatgttatacatcatcttgcatttcttatggtcagtgacgacatatatagatagcaattatgtacagcatatatataccatcttgcatctcttgctctggtcagtgttactattcctgcttattctttaattccttatcgtcttgtgtccttatatgttatttcatcagttttgtttgatttttcttcagaaaacttccaagaccgagttccctccaataatgttgcagctccgcatcttcctagcaattttcaggatttgaggccaatgtgcaatgggccgccattcatgtcttatggccagactgcttccaatagaaatgttctttatcagaatctgacgccatactccttcaatgcatgggctagcaataacatgccg

SEQ ID NO: 28286 - DNA, 993 bp, Oryza sativa
acataaagggttatttcctttggaagatttaagagtagatttcagagggcaatgcattgattagtccaccatgaattgattatttcacaatgcatttcatccaagtgtgcaactatatggatgtcagtgttactactacttatgcatttcctcacctctgagcatcttattgtgcaggtttcttcaccgtttctactagcttcagggtggatcaatcatttgtacatgctccttcaccctttccaccagtgtcttcatcatcccgcagtttctcttcagctcaaatttcaaatggaccgatagacgctaagaaagccaagaaatcagatataaaagtaagactcttctagagcatgttgatatattctgggttcacatgagcagtcctgacatgagatttctacaggatcaaccaattgttttaagaagaagtgatacggagagtgaaaaaaatgatgaactagatcaaactccggctagtgagccttcaagcatgagtcataacagtgcaaattcgactattgtaagtaacatgatgccttggtgatgatggcatccatatatcctgaatactactattctctatttggtacataaataaatgcattttgtaacttgataacttaattgttccattgatagattaaaagttgcaggaacaatttcattattatttttaattaggataatggcaactattccgcaattttccaactaactgcaatcattagtaccatagtttagtagtcagatctgaaccacctatacaatcattgttgactgcagtttacattgacttcaatcaatttgttctgcatgtatcttgttaattagactgctcttgtgagagccttgctctgtatatgtaaattttgcttctatcataatagaacagaggacttctcccacacccactttggaagggacattaacttcaaactgaactaactctgcattttctagcagagattcaactgtagagaataccgtgtt

SEQ ID NO: 28287 - DNA, 223 bp, Oryza sativa
cgacgcccagccgcgccgcgccgaagcgttcggcatcgccgccgttaggtgcgcacggaggtggggaaccttggccgccccctcgccgccgtcgccggtcacaggagatgtcacgaccggaaataacccaacgggcgttccttacgtgcgtgcattaatccttgtcccaggaggcaaggtacaccaacagttgatacaaatcagagtttaacaagcggaagcg

SEQ ID NO: 28288 - DNA, 531 bp, Oryza sativa
ttaatcgcctttggtgattcataccgaagatcaaattcggttaaagcaaatattcactcaaaccgaaagtcattacaacctactcaaacaagccgattgcacaaggacatctgaaagccgtcttatgaatgtcttcttctgccataaagatctgattgttacctgcattgacatccataaaacataatatcttatgccctgaagcagcatcaaccaattgattggcaaccggcattgggtactcgtcctttggggtagctttgtttagatcccgaaaatcaatgcacaccctgactttgccatttttcttgataactggaactatgttggaaacccactcagcatatcggcatggacgaataaaaccggcatcatacaaacgtttaacctcagccttgacagcttcaagcatatcggatttgcatctcctcggcggttgctagtatggtctaacccccggtttgatagggagccgatgttcaacgattgatcggctgagtcctggcatctcataatattcccaagcaaagc

SEQ ID NO: 28289 - DNA, 237 bp, Oryza sativa
tctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagta

SEQ ID NO: 28290 - DNA, 628 bp, Oryza sativa
  unsure (1)..(628): unsure at all n locations
aaaggaaaggaggagaaagagaaagctaagaacaaaatgccgggccaccacagctgataaaggagagcctaacaacaaagtaccaattcaaagaccatcacttcagcacattaaggtcatctgtctagcagcttccatagcaccaccatccaccatccatccattcattctggaacctccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28291 - DNA, 448 bp, Oryza sativa
tgaatagtatttgaactaaattgtagcagtgtgtaaatccggtatggaagttgagggtacagggcatacaattctcactgcggtgtgtatttggttcagcagaacttggaaatcccatcctgtcaatcacaccaggttttgcatcttcccgggtttcttcagaaattccagactgaacaacaccattcctccgaggaaggtatatttgacaagtaaaatcatctgtttcactgtttttgctccctgcatcaactttatctgcatcagctttggcattatttaactttcgtagttcactatatcttgattggaccctaaacggtgacattcttccagcagaaatttctctcctagaatccggagccatttccattctagaagttgttctgggaacaacaggtgccacatcagcactttctttccttgaatcagtagcagactctaccct

SEQ ID NO: 28292 - DNA, 3789 bp, Oryza sativa
taatggcatagtgctacttgacgaacttttcaactctgaatgaccatttaattttgttgaagtacccgttgcatatggctcaagacgctgaaaattgatggtttttagtacattataactaaaaacaaatggggaacttcaatgaaaataatatattggtgttagaactgtagcagggaagccagaaacataccgttagatctacaacccatattccaacacaactttgattaaatgaacaaccaagaagttttccctcgtggacatttagatcagacagtctagaccatcccacatcaacggtatcatgacatcttattggttcccaagagaaaacctgcttagattaagagaagtttatctctaggaaacatggagaagaaatttgttgccatgctgtaacatgagaaagtaatgaccatacctttaaactttcatgcaacccacacaacagagatcttccatcaggattgaatgtcatggatcgaacacctgttgtctgatattcaaatagagacgtcagcaagtaatataatggatcttttattttgaggttctcaggaactttgggcagcctgtgctaatcttgatgtatatatgctagttgtcactacagcagcatataaagcactaactacacttgaatgttgaaaggccatgctatgccataagcaaatggaccatagaattaggtaagcacaggtgattgtataaggacatgtaattgcgagccttctagcatatgcactagaacaggtagcccacatgttttgaggagataatgaggttatgacatgctgttgagagctgattacgacatagtaaaatatggttgggcacaccaaatagagaaatatcacaaaagaattaaaatataatcaatgatgtcatgacttaagagaactatgcagtatgctatttaattctagattggtgcttctatgctctaccaaaattagagtgacacaaatcctaaagtactgagtagtcgaacagcaaccaatgagtggctgaaaaccatgcagttaatgtgattaaaaaattaaaagaaagcctgtgtgttggaaactaatgattagttgttagtgtaatggagtaatataagaaagaacaaatatgaggacaaacatttgaagcactcctttacatgttcaagaagtcctccaacattttttggttgagaaatctgtgcctactaaaagtcatccggtcttgcaagcataacaaagctttatagcgaaaccccaaggttttacatacctcaggtccagtagacccaatcaattcaaaggtctccaaatcccaaaacttgacagttttatcggatgaacctgaatgaggcaaacaggagtcatacaatgaatctttagtagcaaagcgtacaggaaacaaaaaagaggcaagcacaacttctgacataaacagttatattcgaacagtgcccaggctgcaaaaatggtatgcatctccatgataactgaaatgggattcttattctacaccaatgaacaaaatatttctaactacattgttgtattgcacacaatttcaatggaggaaaagattataacataccaatatcttaaaaattcatgcaaatctttcatttcaaaaataggtcattaaaatatgcaaaaatatatatttcgcaaagaaataataaccgatgtactgacatagcaatttaaaaaatgccagaacaagacaatttgatgtttggcattgttggacagcaaaaaaggggagtgtattaaaactgccaggactttcacaatatatatatgggcacataccatttatagccataatatggtgaattgcagtttaccatttaaattattttcaaatactactatactagcatgtacagcatatgtttctaatcactaaacgaaggaagcccaagagttaagtataacagactacgctgtacaaccaaaagggtcaaagaaaagttgatgactaagtgtcagattagcattgtaacatctgaacctaacctgttgccagaaggaactcatggggatggaaatctatgcactgaatctggccttcatgacacttgaaatcatgtaataactttccagctgtcagatcccagagctgccaaggcaaacttaccataagaaaaaacaagttctatggaaaatttactgtaaggcaaattcatcatcatcatgttgagttcactaaaggaaaatcaacctgtttgctaaaatcttcacgctagcagaatctaccgcagaatcagcacaacgatgtagtgtatgatttgaaagattattaggcattgacaattcttaccttcacaacattatcttcaccaccagacacaacccagcggccatcaggtgtgaatctaattgcatttacacctcttgtgtggcctttgtacgtgtggatacagcccttccttcttatatcccatatcttcagatttgtgtccagtgaccccgaggcaaagaattctccaaaaggatggaaatcaactgacatgcagtttgacctatgtccagtaagcgtgcggacaactgcatacaaaacaaatcaagtggtgctaatcaaataagataggacacagaatgtagtcagtatacatgcgatagtaaaaagcatttgcattcacatatagacaaggaatgtggtcaggtatatatgcaacagcaaaaggcattcgcattcacgtactttttgcctcctctaaatcccatagttttattgttccactggctgctcctgcggccacgaaaacttctgtggaatcaaaattaacagactccacagcactggtgtgccctgataaactctgtataacaacaaaaagaagttaatcaaataaagtattccatcagctgaaacaacacagatgacacctccagtagctagacccactgtgatcgaacacatgtaaggtagtaggttgacacttcacataaaagtagcccctagttaataaaacaccaacatacagaaagtgatgctggagaagtcgacaagagctaaaatggtgaaattttcatctggtggttaattaaatgccccattgactattgggtagacttacttgcctgttttgctatagaaccacattttacatagtaggcatactagtcagaacaggacaatagagacttaccaaaattgaattgggcttcccaatagcccaaagattaaccttatggtcatctcctcctgtcacgagaactcgtgaagtcttcctcccaatcttgaggcagttgacattggatgaatgcgccacaaactcctctacgccaaacgcaagtcaaggcattccaatgtcgcaagttcacccacaaaatcacccccaaataaatcatgttgcaatcttcaggcagttcataagcacaaagcagcagtaatcccacttgtccgacaatcagacataaccacggtcactactaactagtgatcagcaacagcttaagtgataaaatcgagcaaacactaaatcccccattatcttaacgaggggcaagcgagataaaagcataataaaatgatgggttaaatttgaagaactaaatcgcccagctagcagaatgaatgcgacagtggcgatggatcggtcaaacagacacaatgtacctcgaaaaaaaatacaaaaaatactagtcaaaaatactggaaacgaattcgcgaggatacggagcttgtaggcgcgcttggtgttggtcgtcatggcaggcaggtcgtctccgaacaccgcgcctcgggctccaatctcatctccagatcacgccgccgccacggcgccacccccctcccccg

SEQ ID NO: 28293 - DNA, 11630 bp, Oryza sativa
  unsure (1)..(11630): unsure at all n locations
gccaccgcccccgtgggaccaaaccaccctcctctctcccgccgccgccgcctccccggagatgcggcgagaggagggcaggtggagcaaatgcggtggcgatttggggtttggtgcgcgcgggcgaggtggtggtggaggcggaggcggaggggggaatggagctgtctggttggggccgggtggtggagaaggaagacgcagccctcctccgcttcgaaaattttgaattaacaaagggttggggttggaggcgataccggattaaaaatggagcgccagtgttgggggaaatgcaagcccagatggatcttgtccacttctcggttggttcgcgaacaaaagttttaaaatctcagttttaaatccatacagtttgatggtttcacggattcacgcaccaccagcagctgcgtttttttgaaagggtgaatttgagttttggaatttgtctgggtttctttgtgttttgtagtagtgggtttttaaaagtggttgagtagtatgtgccatcgagctcaacaaccgaatgaatgattaaactagttaacactaccggcgtgtacaattgggacggcaaatggtcataccatttgtttaacgttttatggggagaaaaatatcttgcacttgttggacacaacatggttactaggagtgcacgtttgcttgttgcatatccaacactccatttatgttcgtggttgttacgcttaatttgttgtttaagccttcaaggtaagatttagtttatctgtggcttgaatataactaaatgcaggggggggggggtttatataatcgcattgtaattttgcgtagacatataatagcacattcaaattagctcactagtagatttcctcgcagaatgaatgtgtataaaaacgaatacgtacagcaggacaaacgaaacagtgtgacacttgaaaaaagagactccattagtgtgcatggtgcgctcgtattttaatagggcggggccgtggcagcttggtgagttcatgattagcagtggttaagttggctaatcgcagaggaaaaaaatcgtagtattataatcaagtagagcgatcccatcccttataacattgtccgcccagtagttttctccttttcctgacgtatgcgtagtgattagataaagaatcacctaattaagcctctgaaaatataattttgctatctacattttttttgtcattttcaaagtatgggagaaccgtacaaagtactactacaaacgtatacatacgacgagtaccctgtattttcgggggacctgtgcgttgagacgggcccatcagttcggaatttgagagtcgagattacttgggtgtactagtacggttgggtcgtccaaatcaacgaaaagcacgtggcctccagcctccttgcgggtcccaccaccaagggatccttttgacgtggccgcgacctcctctctgtatcgttttccgctgtgtgtgccgcacccatacatacgggcatactacctcctgccacaatatgggctccatacatgtacccacgtatagctctacatactaataacatacatgtaccccgtagctgttcgtgtatcaggggaatggatacatgccacgtgagcattaaatctcttgtaagaaatactatgtatgcaaattcggaatttcactattagaagttactactaatattcccactatgcagttgttttttttaaccaaaaaaaatacaaaccaagaagccggcgagttaggttccttacggtgaaatttgtttagatggatttaagcactcgactttgtacgactatttatatttacggttagttatttttttaagtgatgtttgacatattagttgatagcgagacgcttgtatgaatatgagcatacgcgtgcttaccgtgttttgggaaaaaaaagtgaaaaatatatgccgtcgaaagagtgtttggtgatcgaagcctgtcatccactgctctagcacaacgcacggacaaagcgtccttgtcctgtaaactgtgtctaagcgaagagttttcagacagctctgcctccgctgctgctgtatagatgagcgaagttaaccggcagcaggaccaacggcctcaaccgacaggtatacaacttcccagcttcagcaacaccaccacggccggtgaaaccgaaacactagctagtgatcctgatccggacctaatttaaaggcagaaaaaatatcttagcagcaaatggaagagttaatcgagctttgcaactgaaaagctagtataacagtaatggggttaggggaaggcacgcagaggagacgtcccggagatcattgtaggggaccaataatgcacaaagcgtaatacaattatgccaccatcatcctggcctctccttcacagatgatggatggagctgcgtgatgtcgcgcctggccacatgcccggcgacgacgaccgatgattgtcgtgtgcgtgacccatgtggaggacctcgctacccccaatctctcttcagcctttcatcaccaaattaggctattagaatccggaataagcttagttaattattgattaggtagctagcttaatccaccatctggagtagtattattacaagtagtaggagtagacgagtagtacgaattgtgggattggtttgatgagcatatgtcgtcgtcgaggctggaggctggacgttacggtcgttgaaaggtaaagggcagttggtgtgcaggcaagtactggagaggttgcagtcagcattggagctaaaacgagtagtaggagcagaggaactgagcaaattttcagcttagctatagggtggcaagtgtcggtgcagggtacttgcggatagctgattttcagcagtaaacgcgaggatcgcaacacgcgaccgaccgaccccggccggcgtttcagtacaggcagccgagcgagaggcaaggcacaagacggacagggatagctgctgcttctgctgctgctgctactgcacatcggattccttcaattgagacgcatcaaccacctggtggtggtgttgtgcaccgcgccgcacgagcaacgcgacgtgggattctatagccccccgcgttgtgctcgggcttggcttggcgcggcgttgttgttacgggggattggattggatcgctcaactgcagccgcgagcgcggacggacgcggccgggaaaatccaacgggagatcgcgcggtccccgtttcatgggatcccgcgcgtggagttcgtaaattcttctcgcccgctccgcctggccgccgtgcgatttatggtgcggcgcccaaacgcgcccgagcagacgcgtccggccgcggtggggtacgatacgacgcgacgcgatgcccacacgggagcgccgctgctgcggctacgaggctgcaggaaacagcaaatgaagcaggggctcggctagcccttcacagtttataaacatcttaacaagtgcattatattcgagttgacacaattgaacggacctccaagttagcgttaagttagttacgatgaagtttgttattgtttcatgacagggcccttttcacctcgacgtgaataaccagcacgttttctactccgtattactgattataacgtactgatctaccacatacaacttgtatacatgttatgtttgattaaaccactggaactaagcctgctctcgtactcggctcacaatgccaaccgcgatggtgtttccctgagatcgtaggaacactcggcctagcgctttcaggtttgagaattcttccacgcatacctctttctccagcttcacctgaaagaaaacaccaagcgttacagagacaacaaacatgatatcagcaacaaaactaccccatccatctgctgtaagcttacctcgattacagcagtctgtctcgaggtgagaaatcgtggtatcttctttgaggctttgccggtcttctgctccagcaatgacagtattttcaccatgcttgcagacaccttcgcatgatggatgtggagctcaaactagaaacatgggtagcgaccatgtaaggtgtcgatattaggcctgaagttctctttaaaaaataaatgaagcatgaacagttgaagagatatgctcccctcttttgcttacctgcaagccaaccagtattggtacagtgatatctaggaccaaaatttttagctccaagcaagaagccacggacacaggataatctggatggcatatgactccgccaggcatgatatgactagggtcaatcccttgcaaaccaatagcgacattgtccccagctcttgctaaattgcaactagaggaattccgctcaatagttttcaccacagctaactccccaaaaggcatgacgaggatctgaaacaagagtaccatgaaatcaggaaactgcttgaacatcttacaggcaaaagcatagttatttaatcattgagcacaacattatttagacggaaaagtggtaggacaacgaaaacagtgcaaaagatatagttagaacacaagtgatgttcaaccatacataaatatctcgcactaaggcaatataagaaacaaagacaaatgtattgtagtatgtgcttagaataacagcagggtgataccttagaaccacttcgggttgctccaacctctactttaccaccaattgcaacttgccccagcttatgtgacgaaaagacatcacaaattggaaggcgcagtggctttgaaacatcacgagaaggaggcggtaatgtgtcaatggctttcaacaggcaatttccatcatacctgacaccatgcatcaattacgttggcgaacaaccaccaggttttaaggtcaagggatatgcaggtttaccatagggaatatctattaccatgatgatagtcgagtatctgaagctgttgtcattaagttctcattctccattgcactaattggaacccaggcaactgctgagtctttgtaaccgcatgaccgcagaaaagcaccaagctgtgatttgataaaattaaatcgctcttttgaatattccaccgagtccatcttgttaacaacaactatcaagttatccacgccaaagcttctaacaagctgcgagtgctcctttgtctgtccaatcccattgatgcccatacctgcttcaaatgatcctatagaagcgtcaataactaggatagctgcatcagattgtgttgctccagatatcatattaggaacaaaatctttgtggccaggggagtccagcaaaacaacatggtaatttttggtgtcaaagtatgcaacaccgacagtcattgtaatgccacgctccctttcatcagcactctcatccattgcccaagcatatgcaaatgatcctttcccctggaagaagaaacgttatatatgaacagctcccaagatgcataaaaggcacatactgagataacatcaatcattaaaataagagaaccttttctttagcttccttctcatatttatgcatttgcttttttgaaatcctccccagggcatgtaacaaacgaccacatagagttgatttcccagaatcgacatggccaacctagcatgtttctggtttgagttattcataaagataggcagatagaaggcaaacaagtaataagcaaaatgatggatacatcaaatatatcgtgtatatatagatatgtagttgcttacaatagcaagatttaattgtctagggatgccttcatcttcatgctggagcatccatggttctggcttgtacagggatgaagaaactggctttttaatattggctttacttttttgtgacttcctctccaaactcaaatgctgtagctcatggtccaagcaaagtgtttcattttgactaccaacagaaacactctcactactttcaccgaattcattcgactttacaggcaaatttgagtctgcagttgtatccttctcaggtgtagaactatcattatccatcaccctcttttcagtgacatggggagcatctgtgtcaactgatgtgaatcaagttactatggaactatagcacgcactgcacaaccaaaattattcaagtgtggaaaagaaactttgtttagaaaactatcttagcataacctttcattggtaccaaccacataaattttgaaaataacaatatctataacaaggaacagttcaaatgttcaagtgtgttggcacacagtagttctctatctgaccagactaactcattcagcataaactctaatcaaactaattaactgaaaaggttccacaaagactcgcgcatagaaaagaaaataaaggtttcacatatagatgttaatgttaagttgttaagatgcatccttttcactagtctgagttagtctaactacatgggagtgggggaatgcagagataataccttttctaaaacttctcgacgattttagtcctgtagcgaccacgtcatccggagatggtgtatcaaacttgaaaggcactgtgaacatgaagatatgcagtcatattacagatttctccatcaggaagtctaataaataaatgaaacataagttcaacatatggatctcccattggaaaaacacgggtcaactgaatgcttaccctaattcaggggaagaactgaacattcataagtaggttaaaatttacactgactatcttcatatttcaaagttcaggtaaaccaaattatataaaaccctgtaaactcccaagacctgtaagctacctcccacatatgtgcttcagtttgtttgtttgcagaaggaccatggcaggctagctaagcttatagttcagacagtcacttggttttgaaacaggaaaattttacacccaaaatggtagtcacaccagatgcacaatgaggcaattgagagttaagctatgcaaatgactagcatatatagaatcatacaacattaaatatctggtttatatatagcagcaagtacatataactacaagaatttggataatgccataaattaaacaaatcaaattaccaaaagcgcttgatgtacaaatgcagtgtacctatgttaatgtggcgttctttacgggtcatgtatgtcttatgcagcgcatccaacgtagctcgtgtacttcctgttgcatttctgctagctttaaagccaccagaaagaacaacgtcttttgacttggcactggatggtgagaaaagagttcttgccagtacagataccgcataatgcttgtctctccgtttagctggatgtcatgatagaaaaataaataaattaacaggctagaaaacataaatatatctaatcaaagccataagtcaacagtgcaacaaaaaactaaccataccagggaatggaacaacaaggaatacactatacctctgccatcaacttcaagggcattattgaaatacagcgagaaatatcgaagaacaccgcattgctcacatgattttttttttgcatcatttccgtgttcgcaaatggtgcattgccaaatgccaggatttcttgatggctcctgaggatcagaccggttatctaattcaggaataaactagagaggagttagtaccaagcaaaccctatctagatgttttcatgaaatacttgtgattctgagaaaaaaaaagtgagcaccaagtaaattccgtaaatccaaacacccatcaatgaaggcaaaggtagcaaaagcactctagtagtaactcaccatctcttatgatgagatcatcaactttactgtctctaggattgccaccagaccacacgcaccgtcagaatctgggttgatatcaaccatgttaaactctgcctgattatgcaacagaagccctaccataatatgcaattccatcattcaagcagtcaaaaacagatctgctattgctatatgagccagtcaatcagaactcagaactatgaattttctcaatatatatatagagaaggaaactccattgggcattaaccagcaggcaacattaaaagagtaatgggggcgcagatagcaagcactggaaactcccctacctataccattcaccaccaaacaagacaaaatactaatagggctcatgaagctcaacatggagaagaaaccaaattcagagcgtttctgaatcggaatcgcgataagaggactccgcccgagatcctccgccgccgctccttccccccgacctcctccgagcagcaagctcccgccgccggcagtcacagtctcagagtcccaagctccacactaggatcgacgcatcgcgtgcagtaatagagatgagagagccatcagagacgagcgcgcttacctgattccaaccgaggatactccaggccaaagagagcgaccccgccgccgctctcgcgcacccaaccgcggccgccggcgacctacccgattgcgcccgcgacgacgagcaggggagaagggggaagacgacggggagcgattgcctctcttctcgtcgcctctgcagcttctgttcatctcgatgccttccatggaattttttttatttataatttttcttattaaaagttttacaaaaataattttccattttgaaaattgacggaaatagtcgcctaccgccctcgggcggcgaaaatgacgtggcagacggccgctcgctctcgggcgacggccgtcaacgaaatttgcaggcggcccccttgccgccctccgcgagggcgatttttgcctcccccctataaagcccagcccctcccctatgaaatttcattatattcactaaaaatccaaaaaaaacgaaagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagttttgtttgatctggagaatgtaacctacttttagaaatttagagaacaatattgtacagaatgtaacttagggcgtagtacagcaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtaatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28294 - DNA, 677 bp, Oryza sativa
tgatggatctgactgcgtcatgcttagtggagagagtgctgctggagcataccctgaagtagctgtgaagatcatggcacgtatatgtgttgaggcagagtcttcccttgacaacgaagctgtcttcaaggagatgatcaggtctgcgccccttccgatgagcccattggagtctctcgcatcctctgctgtacgcacagccaacaaggccaaggcagccctgattgttgtcttgactcgtggtggtaccacggcaaagctggttgccaagtatcgtcccagggttccaatcctctctgtggttgtccccgtgttgacaaccgattcattcgactggacaatcagctcggagggcccagcaaggcacagcctaatctacagaggtcttgttcctctcctggctgagggttctgccaaagccaccgattcggagtcgacagaggtcatccttgatgctgctctcaagtcagctgtacagaagcagttgtgcaagcctggtgatgctgttgttgctctgcaccgtattggcgtcgcatccgtgatcaagatctgcatcgtgaagtaatcgctacacggtgtcttcttagcgccattttgctgggttaagtggcaaaacaaaaactgctatgcttgtttttactcccatagtccatctttgggagacaatttaattaccg

SEQ ID NO: 28295 - DNA, 691 bp, Oryza sativa
atcatataaggcgggaccggcctagaattccagaagcccgagaattccatggaatgagcagtcaattagtcaaggcaatgccaagccttatcttcacgaaggtgcaagaggacaactgcacatcatcaatgtgtgccatttgcttggaagactacaatgtcggagaaaaattaagagtgttgccttgccgtcacagtatgtttttctatctctgcaacaccacaactaccttttctagttcaaattgatacgttgaggacattcccatagcctattggttttaggaaagaaaatagtcatgttcagttgctaacttaactcttcaatccttggatttggaactgaaaacattctatgcaagtttttttagtctgtcatcacaattttgtgtaaagtactacaccactctgcatttttgttttatttgtttttgaatgtctggactaagtatgggtttgtgtatttcacacacaattagtacttttgtgtagtatccactttctgaaccttggaaattccacagtggcgttcactattgcagatgttttaactggacatttaagttatacttatgcacaattgattatttgaagagagatatgtgttgaataaacttgtataccttatatacaatctgctatctgaataatggtattccagtactctgatatttgtgcatattactttgcag

SEQ ID NO: 28296 - DNA, 994 bp, Oryza sativa
ccctacagctaccaccttggtaggtttggcctgtcatatactagtatcaattgataaaatatagaaaaatcatgcattgatattgctaagctgctctgctaacatatttaaatgcatcaaatggatccacatatattactttatcatgcagaggagagagaaagttctctaaatttttagtgcccaaatgaaattcccatgtaaaattattcttgtaaaaaggctttgtttctaaccgaggaagagcacctagatgacatctataagattgataaaagtgacaatgaaaagcccaacaaatgagttcacaagaaaggatggtttaggatagcaattatctccatctttaacttaaaccaaaactaaagaaagtaaccttaagttcctaaaaccctacagatctagatccacaaacaaatcaccaatatttttttaaaaaaaaaacaacttttagtaggaatgaatcaggtttgcaatatcgtgcggcagtgcggctactgctcggttacaacggttacctcgcacaataatcctcttggtttttaaaacctctcggtttttgcggtaaccatgacattaccacagtaactgtgataacaccaggtaggggtaatccctccccaaatggtaaggtaaatcctcctagatccagtggaaaatcataccattcattaaaaaaaaaacaacttcagaccaatagtggaataacccctgactctaaccccaaacacatgacaccctcaaccactgtttttattaaagcacacgatcgaagtcatgtgactcaccagagatcgaagcacacgagttacactggcgaatggattcacacactctctttgtgctgaacccatctcacaaagaaaatcgccgagaaactctctctataaaaaagcctcaataaaagcaggagaataatgattttatatcaaaccggtaaaccccatccagcgcgcacatggtttggtcttgtagaggttttcttttgggggag

SEQ ID NO: 28297 - DNA, 19139 bp, Oryza sativa
  unsure (1)..(19139): unsure at all n locations
catatgttagtgctggttgggagttgactggcgcaagttgatttttttcttgtaaattttggcccaaagattacgactgtttgtatgtgaaaatggttaaggtgctctcatgcttatgatcaaacagtattcccaacctgctgaaataaaaacaaatgataaatatatgtgtgtggtttattaaattagacaatcttttctttaggttttctagtacttctttaagcaaagctatcattttcctaaccaacctggtggtaggaaatttgggtactgatgtcatgatgtgattcttgaaatctctatacttacctaacattttatttaattgtacagagcagctcatatctgatcaggtctaactgtttgaatgttagatcaatgtgccattgataattgattagttaattggttaattgcttcatttaggccacccattagcataggacctagttgactagttagcagaagtttcaccaatctcacttcagaattccaaaaggttttaccaaatctctgtagagaaagctaagaaattatcatggatggcctaaataaaaaattgtttctgttgatgtctcattttctcgttgaggagcagcatatgtagcttgtctcttagctctttgtactatagtactttgtacaaggcgttttgctcaagagagtagtgaatttatatttatctgcatattgtcccctgtcccgtgccaacaaactaaggagcactgaatgttcttaattctgacctaaatacagatgctagcacaacccaaataattaattcactggtagattgccattccccttactccttacccaaatttcatttcagagtggaatacctgaagattctgaattttcctccattttcagaaaacggggtgaaaatctctccagacataaatacctgaacacttgaattaatgccgtaactttgattttgcttgaatatctcgcagtgctgttgtactggactattatgaaattccccaacattgctggtccaaatgcaccaaacacatgtataatgtagtatgccaactctgctgtgcagagctatccactggcaagctattaattccaattaaattcctactaatataattataatctttatgatatttcattagtgtacgtgcacagctagccatgctaccttgtcaaaatttccatattccaagaagtgtaacacagtagtatacacttttcacccatggaaattttagctcatttactacaccattaaccccagaataagtttatttttcacccatttacacatactagtagtaaatcaaaatgaatttattcttcttggctattctcaatgaaatttctcaataattactcttcttggctattttaaatcatttctctttttatctattctcaatgaatttattttttacttttacaaattccgatacaataattactcaaaaataaacttattttaagataaatgattatgaaactaaaaatgcatttattctagggcagagggtgtacattttactgtaaaactaatgatgggtttgtgcgtgataggggttggatccggtgacgatcgcggcgatcttctcgacggcggagcacgccggcgagaagctggtggacggcgaggactgcttcgtgctgcggctggacgtggggccgtcggtgctgtcgagctggagcgacggcacggcggaggtgatccggcacggcctgacggggttcttcagccagcggagcggcctcctcgtccgcctcgaggactcgcagctcacgcggatccagtcccccggcgccgccgccatgtactgggagaccaccatctcctccagcctcgccgactaccgcgccgtcgacggcggcggcggcgtccacgtcgcgcactccggccgctccacggcgcacctcgcccgcttcggcgtcggcgttcgcgccgcccgcgtcgtgacgcggatggaggagtcgtggaccatcgacgacgtggcgttcaacgtgcccgggctcggccccgacgccttcatcccgcccgaggaggtcaggaggagccgcttctacgacgccatggccgccggcaagtgagatcgatcaacctgttcaagaagagagaaatggtgtaacacgtagagagttagcttcggctgtgtcaacggtcaaccacccagctctgcttgtgtttgtgcatcgaaattcgtgcatgtacatatgtgtaccaacctgaggtaattactccatccgtttcaggttataagactttctagcatatatatatatgttaatgaatctacgcatacatatatgtctagattcattaatatacatatgaatgtagacaatgctagaaagtcttataatataaaatggaggaagtacctaagtgatgagtaataaatagttacacaattcttaaacctgtattctgagtagttctgacttctgagaagataaaaactactgaactgactttgcacagattgtagatacctgcttagccttactacatgtctctaggttattgcgaagtgtttttgacaatcttaatcttcctgtcttcttggaagtatatactactacatgtgagttgcatttgtctgaaactttgtagctacttctgcagaagctctaggcaagactgaaatcatgtgctgctttttgtaacttgtatgttgttttctgccttggtatgtgatctgcatggagatgctatgcgtgctagtacataaacagtgttattcatatgcatgcctagcagaaaccagtggcaactttggaaattggaagttgttcagcatggttcttgaacatgtatgccacttgacaatgtctgcaaatgagcaacactagcaagctgtttgttttttttcccgttgcagaagctttgcaatttacaggtgtgcattgcatttgccctcatcactgtaaaaagtctgcaacttctttgtttgcatctccctgtcctgaacatgtgtcccttgtggtgtggcatcagcacttgctcatgtttctagtgcgatcacgtcacaaaaagttggaggtcacattgggtgtggcctgttcatggatgcctcttgtcttcttcagctgcatatgcatcggcaaaatgcgcagagtttgcaccaatctgtgaagactgttaaccacttgtttaatttgtcctgtccattgttaacttttgcagtattctaactcgcacttccaactgtacatgtaactaactattgcatgctactctctctaaggaggatgtgtcacatcacatcccaccaaaatcccttatattatgggacggagggagtaaaatataagcattttttgaactagatacgggtaactagggaaaatgttttgattggtcggttggttgagaagagaaagtaaatagagaaattaaatagagaattattatgattggttgagatacaaaagtaggtgaagaaatagctttattttgagacaaggcttaagtggtagaaatagttttgttttgaaagggagtattgatcatagagcatcttcatctgaaacggataaggggttaggtccatgcattttccagcttgttgaatctagatgaatatggtaccacttgttgctgctgtctggcggtgaactgaactttgataataagcagtagattttcatgcggcgatgttcctaatatccacatggggttcttcagaaatctgctccgatctgtactcaccatgttctcatcaaggaccacattccctgaaatatacaagcatatcagcaacttaacctcaccaaagggaccaaatttttaacatgcatgaatgatcaatcactacattcaagtactggccatgaagaaggcatcatgacctgatctaccctgtccatgcccttgcattgactctgaatcagggacagattgttgttgttcatccaggacttggctaggctacattgcacatgtctgtcctttgcattcaaaagcaacaatgtactataaggtgaccatgttttactgtcgtctccaacagttgaaagaagcgagagatggatcatctgtcgagcttgacgggtcccttttgattgatgtgtcctaggagatgtgtctcataatgcctgcaatttcttgatttgcatgagctgtaatactgagttgcagtgaaaagatcaccaccaaccactgtcctcttgcgaagaaagcatcactgttgcatgcagaaatattagttaaggttaattaatactctgtttaagtgtttataatacgctcgtgtgatccttcctatggtcccagggaatcgaagtgagatcatgcagtgccaaattggcaatggtaatggcaatgcaacgctggagaggggattaaacaaaagggtacagtctgtgttgaggccctgcactgcaatatgctactgtacaatatgtataccatcaaatcacaaagtgatgtcacaagcaaataagcaatgatatgactaagttggtgatgaactagctatggtttgtttagtaatagtagtagtagtagtatcctactttccaatgggatcattatactgttctgctttgtcccctggttccatggatctctcgtttggattctagtaaagcgagctgcattttctgttgaatacttcaagtgaaaatgactaccttttctttttgtttaaaagagttagctgagaaatgtcgtagtaaggaaaagttttgcttttttaaaataataataataataataatggcatgcatgccttgggagttcaactgtagtagttgtcattctgacattctgatggctgcattttcttctggtgaccggcagtctccttaaactggttagacctgcatggcttcatttctttgattgattaattaattcctaaagtggatagagattaggaccagaagaggatttaatcttttggcatttagactctgatcacaaatggaaactcaggaagtacaggagaatccattacgatattatccctaaccgctgaatattcagaaagctggttgtcttctgttagagcagagtgtccttttgtcgtgaaaaacataatttaagacggcattcaaggctaattccagccatatgttttgcatagcagaatcattaaaataagctagccaatgagcttgtagtgtaacaataacctaaaaggagggggtgactggaacgtctaaaccaatactaacaataaattagttggataaaaggactctaattcgaaaggaaacacgggtgtttggtttcttggaccaaggacagtgagcagaaaaaacaggtggcatgctgacgagagcgctcaaccaaaaagggtcagtgctgctcgcgatgttaatcctgcacctaatcgttcaacaattttgaattagatgcaactaaccatgcacacgatacgtcgtggtcagattcagaccggacatgactgatttcatggtacgaaatgaaagagaaaaaacagacatttactcgcaaaaagaagtttaaaaagggttcagtttcaggcaacttgtttgtcactctctcggagtcagctcagagctggtcatctttttaacttgtggtcttgtttagtgctgttcttcagagttcagacagtgtctactacccagggttcacgtttccgttcgaaaactcgaggttttgatgcgggacgaaagaagattttcaaggcaacttcgaattgttctcgagaaattcaaatctaaaacagtattttcgaatgaaatttagtcgaaatttaccgaaaactgtcgtaccgccggggtcaggatccctctaaagtctaaagcccgaacctgttgtcttcctccctgacgcggaacgaactggacgcccatttctcttgtgtcattgggcccatttgggagacaattagcgggccgaatctcgtaggcccatgtgaaaatcagacaaaacgcggcccgtggggtttccccttctgtggagattaaaactgggccaaaacattatgaagcccaacttctatgctgagttaaacataatgacagaatcaacgatggatgttccgtgtaaagcttgagaatatccattcggaatttcggattatccaatgtacgcctatactaatacagtactctcactactcactatatattttatgcgatttaactcttgtagctgttttgtttttgcataggtttatattcattttttaaactcaatattcctagctacataaatctttaaatttagagataacattaaatgaattattttgtttttctttataaaaagtacttcctctatttcacaatgtaagtcattttagcattttccatattcatattgatgttaatgaatctaaatagatatgtatgtctagatacatttattagaaatgctagaatgacttacattgtgaaacggatggagtaaaactttccacctatataattgaacttacaacttacatcctttaaatatgacgtagatcagagatatgacgacgtatcaaatacaacctagtattattaccaaattaaaagttcagcgagataacgtatcttaactggttagattttttctgatgaaaccaattataaaaccctaaactcagcacgtgtacttccgtgataggtgtttagaaaaataaataatagtgccagtaatcagtgcagactgagctaaaactcgagaaaagaaagcgatatgattaaagaaaaggaaaaaagttccgatttttggaggcgcacggagacttctcgcagcagtttgttggcggtcggataaacgagacgaggcgaggcgaacgcgaaagctccccatctccctccctccctccctcattattgattgattgattcgcagattcgccgctgccaccgcatcccgcccacccaccgcgcgccaccgcctccgccgccgacgagccgcagcggccaccgccaccgccacctcatcttctctcccaccaccgctccacagccgccctcccttacatggaagtcgacgtctccatcgccacgcccgcaccgcaggtccgaccacgattccccttcctctagagctttcttcttcttccgttctcgtcaatatcccgtgaaagctccgacctttccccctcctaggttttcttttctttttttttctttctactgccctagtcgctgcgaccgcgatggatgcgatggctgtatgctgctctggttacctggtgatccgatccggcttttcgcgttcgatattacctggggattagacgcgcttgttttttttttttttgtgccttcgatctgttgcttcctgtcttaggtttccgctggtggagctgagtagtattacatcgttttctccaatatatcactctagttgactcgctgagagaataatctgtgcgttcttgtttttgttcgtgccttcgatctgttgcttcctgtcttaggtttcggctggtggagctgagtagtatagtacatcgttttccccgatatatcactccttttgacttgctgagagaataatctgtgcgtacctctttaaaaagatactacttttatcgtaccactgatgatacttgattaggactcagggatggtatctttttggatgcccagttcaggagaaatagggatcctttgttgcgtcatagcttttcgtgattcctgagattaggaccagacctttgggtctcctgatatttgtttatttcgtcctaattctctccactcagtagacctattctccaattgtttcttagtactacgtagttagggaagatacctcctctggggctttatttcttaggagaatcatcattgcttgtcaagtaccatcttaacattgtttcttttccaaccattagaggcattaagagtaaatttttgttttggaaaacaagttaccatgtagtatttcttttttgttggtttacttgtttttgcgttgctcagtagtatgtactattccagggtctttctgtgcgaaagccctactctttggcttaatgttagttgacaggatcttgacgattgtcggttttcattgcaggaatcttagctgattggtgctttggactgcaggtctggacacgttgtccgtttcctgcttgtgcagacgtaggtttggagtctttctgagtgttaaggtggctttcctttttgtccttccatggttgaaatttgtatgaacaaccttgactttctcgaagatctgtgttggtcgataagatgaatcgaagaagaacaatgctattgcttatctgtctctgtgcaacattttgcctcatgactcagttaggagctgcaaatgtagtgctgatggggacaaatctgactttgtcgtttgatgatgttgaggcaagttttggtaagttctggacatcttatcatattagttttgttatagtagagtactaatagattctatttgtcgggatctcagtctccctacctgtgaaactttattacctaaaatttcacataccttgtaagccagttgcctatggtcattttggtcttaatgttttggttttcaaaaccttgtagttgtgctactgttttatttatggtagtgtgcgaatctgttgctgtatttcctattatatctttgtgttagctctctgactagaattagcttcgattttatcccattgattgtgccatgctgcattttcttgaaaggttcttttcttctacttcccattttcctaagtctatattgtcttgtcagaaagattcattatgctgtttattcaattggtttgcagctccaggagtgaaaggttcaggttttgaaggcgttgtttatactgctgaacctttggacgcctgcagtccgttaacaagtaaagcagaaaagggtccaccatctccatttgcactgatcataagaggcgggtgcacatttgatgaaaaagtaaaaaatgcacaggatgctggattcaaagctgcaatagtatacgacaatgaaaatagcggggttctgatttcaagtaatgtaccttatcactcccacttgttttttttttctgcaacatcttagttccactgtcagggttgggcatcatacgctccattcatggcataatagattataattatgtttcttttgtctttatattctcccttatgtccatatttgaggacctgtatatgtggcatgcattaagaagagatggggccatgtgagaggcacaagagaatgcttttcaaacttttccttgagaacggatgaaacaaaaatactgtctaggctgaaactttccaaaataagtaaaaaaatatgaaaaaaatagaaattgatacttttaaaagtcataccactttgatgcttttcactagttcatttagcattgtttagactttgggggcatatggttctgcattatctaactttgaagtttacagtggctggaagctcaggtggtattcacatttatgcggtgttcatctcgaaggcctcaggggaggtgttgaagaaattttcaggccatactgatgtagaggtgtggatactacctgcgtttgagaactcagcctggtcaatcatggcaatttcattcatatctctgcttgccatgtctgcggttctagctacttgtttctttgtgagaagacatcatataaggcgggaccggcctagaattccagaagcccgagaattccatggaatgagcagtcaattagtcaaggcaatgccaagccttatcttcacgaaggtgcaagaggacaactgcacatcatcaatgtgtgccatttgcttggaagactacaatgtcggagaaaaattaagagtgttgccttgccgtcacagtatgtttttctatctctgcaacaccacaactaccttttctagttcaaattgatacgttgaggacattcccatagcctattggttttaggaaagaaaatagtcatgttcagttgctaacttaactcttcaatccttggatttggaactgaaaacattctatgcaagtttttttagtctgtcatcacaattttgtgtaaagtactacaccactctgcatttttgttttatttgtttttgaatgtctggactaagtatgggtttgtgtatttcacacacaattagtcttttgtgtagtatccactttctgaaccttggaaattccacagtggcgttcactattgcagatgttttaactggacatttaagttatacttatgcacaattgattatttgaagagagatatgtgttgaataaacttgtataccttatatacaatctgctatctgaataatggtattccagtactctgatatttgtgcatattactttgcagagttccatgcagcttgtgtggacctttggctcacaacttggagaactttttgccctgtatgcaaacgtgatgcaagtactggaataccagatcctccagcctcagagactacaccattgctttcttctgcagttcgtttgccttctcagtcatcttcgttccggtcaagcgtggcagcatcgcctccaagaccaataagtcgacgaccttcatcacagtccatatctcggattatgctgcttctggtacccccaactctcctaaccccataaggtctttcacaaactcaactgccatgagcataagtagaagcaatgtggacttatcaaacatgtcttcccgccctcgcgcctcacacctcgcctccgcacattctttggttggcagtcacttgtctccaccaatcaatataaggtacgcatcgccgcatatgtcccactctggctatgcatcacctagtccacatgttagctcatcctatgtctccaactctgggtatggatcttcaagctactatctcggttcatccagccagcatcggtcatacctaaggcgctgtggggaatcagggcctagcttgtctaccatggcccctcagtcgccgcaacagtcccagttacgtcatggcggcgaatccgacttaaatctagcaggagcatcctcaggccagtctttccggcaatcctacctgagacactgtgctgattcagaggtaaatctagcaggagcatcctcaggccagtctttccggcaatcctatctgagacactgtgctgattcagatgcaagcttatctgccatggcatcagctcaatccttgccaggatgctgatttctctgggatcagatcagcttctgtctgtactaagacctggcgtgacttgtgtatacatttgaggcatgtactataggctattggttgagagaaaatggtcgtatttgtttgtgtttctcctgctgccctgcccttttggttgtagtgattgttagcgctctatttgtttcaccctagagtgtatagtacaattgtacagcaactttcttttaaactaagcaatatcatccgcgcgttgcccataaattggatccattgccattactaatttgtccgtttcaaaaaataccattaataaaccgaggctgtttagattgttgtcaaaataaaacttaacaaattttgttaagttggcaatattactaaaattttagcatgattttttatgtattttttaaagtttggcaaaaaaaactatatttatgcacatttttgacaacttaaaaaaatggtatagtttgacatggcatcaacctgaacaaacccctatatgtttggacccatatgtcattatttacccctatgatgtatttgtcaaattattattttttaccatattcctcttcttcctttctcctctcctttcttcccgttggtggagcggtgggtggtgttgttcacttcggcagctcctccccctctacttaccccgatgaggttgggtctcatggttctctcttcgtcttcccaatttactcactccggcggtggcgagtagtgaggtagggctaatggttcccttctcttcctttctccctcggcagctcctccccctctacttacccccacgaggttgggtctcatggttctctcttcgtctccccaatttactcactccggtggtggcgagcaatgaggttggaccaatggttcccttctcttcctttctcccctcatctcttcctttccctctcctgtcacttcgggcgtagctaaattgacgttctcgcagccgtaggacctctccactattggatctgcctttcgtcccgacctttgccttcgtccctgatggttagcccacctacacccgcttgacaactgtggcgtctggagtcaagacaaaatcggtgtccggttgaagaggaatgagggaggtggccgagcgagactgacctcaacctttgtcccctttccccaatgcatgcgccaaaggaggaggcgcggggaagcatgtggcattggtgaggtacttaggggaaattggaggtgcagagggtggccggactcattggaaataggtgagaggagagaggggaaaggagaggaagaaggataaaatggtccaaaaaattttaatgattgcactgaaaagataagtagtggtatctccaataactataaagtaatgatatggttctaattaaccctatagttctattgtcaatgaattttacagtactctataagtacatgaaattgtgtacaactatcaatgaatatcttgtagatatgtaagcaataaaagttcccaatattagtgaatatcttgtagatatgtaagcattaaaagttcccgatattattagacttgtaagcatctaataattgaggaatgatgtgaacgcttctatgacgtaggggtagggcattgggggatacagccatatatttcttcatctagaacacacatcacctcaaattacgaaccgtattatggctgtgtttacttccattcaaactttaaacttttccgacgtatcaaatgtttggacacatgtatggaccattaaatgtggatgaaaaaaaacaattgcacaatttgcatgtaaattgtgagacgaatcttttgagcttaattatgccatgatttaacaatgtggtgctacagtaaacatttgctaatgatggattaattagacttgatagattcgtcttgcagtttacaggcgaaatctgtaatttgttttgttattagtctacgtttaatacttcaaatgtgtgtccgtatacgtcaatttttttttaccaaaacaactaaacacggtttatgtagagacaggaacaaataatccatgacaataatatagtgaaatagttgaaaagaacatgaccttgaagttcaagtacaagtgttatgtctccactatttactctttagcttatcaaccgcaactaagatttaaatttcaaaacctattatacttatttttagagttgatttaatgttttattatcatacttcattgcgatttccataataagatggttgctatcatcaacaagcaactttgggccgccccagggaactgaatcttttgcatgaaccactgcatttccaagaagtgcacgagctttgcatgccataagcccaaaagactcagcagcttagcgtcccttattataaattgcttcactgaccagcggcaaaaagatggcctcctcctgcaatctgcaagactgaagctaagcagctttaaatcctcctgcgtcatttaaccccctctctgcctctctgagctctgagctgctcagctacagctccctagctgttctgttcgattaattcagcttcgctttgcttggattaatttgtaggtgactaactcgatcacagctcaggtgattggcagtttgatcacaaggcaggaaggaagtagaagtagattgctgtagcacacgctcacctaccaagcttctacactcgcagccaagctttgatcgtttgcttgctttgcattgcttgggctttgtgggcaagaacgtgtctatcttcttcttgttcgtctcgtcaggcggccatggggatgagttcatgcgtgaacctatcccgtgtcgccgccgccgccgcagggagacggccgggatttgccggtgagctgggaggtcgccgtggtcatggcagaagcgtgcttccggttgttgctgcactgccggtgaggaggaagggaagcggttgtggcgtggcgtgctgcgtctcctcctcgtcttcctcctccgtgcacggcaagaactcggcggcggcggcggagggtcacgccggcggcattgggatcgcggagttcctcggcggcaagaacttcctcatcaccggcggaaccgggttcctggcaaaaggtagtaaatctatcttcttcctctcttaaatttggatcatccaacgtacgtagctcgcgtctcttcttgattttgcttgatcatctggatcagttctcatcgagaagatattgcggacgaatcccgacgttggcaagatctacgtgctgatcaaggcgaaggacggtgacgcagcactgaaaagattgcacaacgaggttctacttgcgatcattgttcgatccatttcagagaaacatttgttagtacctatctgttcatctgtttgactgtatttttccttttgttttaactgtgtgatgtgcaggttgtggacacagaattgttcagtcgtttgcaggaaatccatggcaaggattaccacagcttcgcggcaagaaagctggtgcctgtagtcggagatgtcagagaagccaacgttggcatcgcccctgagcttgccggcgtgatcgccgacgaggtcgacatcatcgtcaactcagcagcaaacaccactttcgacgagaggttttgtcattctctgaactgcagtgttgctccaaagatgagttcttaattggatcacttcatgtataataagcatatgaattgatcactgttgctgcatttggttcgattttgcaggtacgatgttgcaatggacatcaacaccgtagggccattcaggataatgagcttcgcgcagcggtttcggaggctgaagctgttcttgcaagtgtcaacaggtcagaaatgcatgtcaaatgaaaagctcttgtgctgaaaacttgcactgaaattacctccaaaaaccttagatatatctctctactgtggattttgaatttcatgtttggcaatcagcatatgtgaacggacagaggcaaggtgtggtgctagagaagccatttcgcttgggggacaccatagccaaggagttaggatctccagattcttcacaacacaagaacgccatgcttgacatctaggcagagatcaagctggcttgtgaccccagtagacccggtaatgattcagcctctttctctgaagaaatgaaagagttagcattagagaggtatacacgcaatgccagaaacgtttcaagtctgaatgtgcagtggcaagattatgcaattgcacacatgaaacagcattggttaattcgcttgatttgggtttaatttgtagggcaaaactccatgggtggcaagatacatatgtgttcaccaagcccatgggagagatggtgatcaactccatgcgaggagatataccggttgtcaccatcaggccaagcgtcatcgagagcacctggagggatcccttccccggttggatggaagggaacaggtccaaattgtaaatcaaagttcaccaacttaaaccaattttagttcatgagataatttagtttacgatgaattggcattgattttggcgaaatgaatttgagcttgattaggatgatggatcctgttgtgctgtactacggcaaaggccagctgagcgggttcctcgctgacccggagggtgttcttgacgtggtaatgattaagcagatgattaaattcgctaattgcgattagtggttaatcgattaactatggcgatttgtgatggaaggttccggcggacatggtggtgaacgcaacgctggcgtccatggcgaagcacgggcgcggcggcgcggcggcggcggcggcggcggcggaggggatgcacgtgtaccacgtggcgtcgtcgacggtgaacccgctggcgttcggcgacctgagccggttcctcttccagcacttcacggggtcgccgtacagcgacgcggcggggcggcccatccacgtgccgccgatgcggctgttcgacaccatggagcagttcgccagctacgtcgagaccgacgcgctgctgcgcgccggccgcctcgccggcgccggcgccggcgccggagacgagagggtgtcgcagcggctgcgcgagctctgcgccaagtccgtcgagcagaccatctacctcggcagcatctaccagccctacaccttctacggcggcaggtttgtttcctagatcgttcgttttatttaaaaacttttgtgaaatatataaaactatatgtatacgtataaatatatttaacaataaattaaataatataaaaaaattaataattacttaatttatttctaataaaactaatggtcaaatatatttaaaaaagtcgatggcataaaatattttaaaacgggggagtatattcgtatatacccgccatggataatgcattgtgaatttgagatgctgatgagctcgatcgccggccatggcggcggcggcaggttcgacaatgggaacacggaggcgctgatcggggagatgtcggaggaggagaaggcgcggttccacttcgacgtgaggagcatcgagtggacggactacatcaccaacgtgcacatcccggggctcaggaagcacgtcatgaaggggaggggcgtcggcggcggcagcggcgcgtcgtcgtcatcgaacgcctcgctgctcgccggcgcctccgtttgaatggccaggccggcgccggagaagaggaggatgcatgcgcggcgtgtacactaggctagattgttgttaacttgttctgccgtggcagtctgacagatgatctttgtgctgcagtaattaaggttgatagtatgttatctctatcactatgtaatcagagcaaaaattggcaatcaatttaacagaatttacaaaagatgcacataattcagaatataatttagcagagagaacatcggttgaccaagtttttggctttgatcaagtacatgtctagaacagtatggagtactagtagagtagtgcgaaatttgaaaaccagaatgtcagatacatgcgaagaaaaacatccaactagagaaaaaggtgccatggaacactgcactgtagcacatcagggtaaccacccccaaaattcggaatactacaccgaaagatgattaggttgccttgccattgatgatacaaattacaagactatcgatacaagcttacgctacaaaatacaaatagaagttcagtcttgccactagatttcctctgtaaaaatgcctaaaaaggagagggtgaggatggatgggccttttttatcacctgaaaaactcaggcatcgctgcatgagcatgacactttgtttcaggatagcagcatctcttgcattgaccaatggagggtcaagttttacgaagggatctgatgttcccttgttattgttggttggcctatgcgcaggtttcacagtccagcaaagtatcactgaccagcatttgactatcgcaaattcgcagtacaaggtgacaaatggtagcaccattaactcaaaggaaataatcgggcgtcctccgtgtcacgtcaggctcacctctcctaggagctggttcgaactgcaacaataggaaaccaacatgattagccaactacaggatatgcaattgagctaactatcagaattcagaatgcgtattttaaatgaattgaatgaaggaaagagcaaaatcaagttatcaacattctaattcagatttccaacaccttactttgacagttaagccatgaccagcacgtattacatgaacttaacgaaccaaggaagccggaaagttgttgtaaagaataaagttagcagtaatcacctgaataaaagtatggctgttgcagtcatcaacttccaaaatggatgccatattcccacatcggtaacaataatttggagcactgaatatagtaacaactttttgttcctgtatgtgcatagtgaataattatgacatattacttgcacaacacgcctgataaagtatccaaaggttcagtaaacttacatgagcccaattatatccttccataactagttgatgagcccgagctacaagtttgagattgttggtgtgattgaattgctcggatatatcctggaaaacaaaagaaagaatgaacaaactataattaaaacatctgcaactgaaaaagttcaagacagtgtagtacctgcccaaaagtgtagccagcaccacgaggagatatgccccaaccacagcggtcatctggatcagaccatagaagatcacacattggtccctcatgcggaacctcttggacacgatctaagctacgcacactatcaaggttctcaattgatggagataaaccaccatgcaggcagaaaatttcagattccaccttcaagaacataaagaaaatattaacatggctcatagatgcataatgctgacaatatgggtttattgaggatggaatgcagttattgtatgtacagttaatgattttgcagtaaaaagagttatgcactacattaaacgtttattgatgaccactttacatgattcaagtaatgcatccatacaattgaaaatccaaagatctaccagagagaacatcactgttagcaacttggtatgatgtcacacaactcccaaatggccaaggaatttcaattatgcagctgtaaatacataatgtatgatatgtcgcattctttcacaaggtaaagacactagtcatgccccatcgatatgttcccagctatcaagtctgcaggtggcgatatacaatcagtagttatcatacaggtgaaaaacaaactaggcttccatattgaaacagtgtaccatgcaataaatgcaaaacaaaaaaataaagaaaaacaagagatacttagaaatgacagaacaaaccaacttaaagaaaaagaggaggtcccagttcagagcacataccagtgctgtcagtggaaaatagtcaaataaatccgtgaatatcttccatacatttgcattgccatacctggtttgaaagaagggtcaacaacacaaattaaaaatatgactccatttcaaacatctagtagcaaatcattgttgcaaatttcacttctataaattaacaaacaatatcactgttttgtttgaaacatattnnnnnnnnnnnnnnnnnnnnnnnnnnnnnnnnn

SEQ ID NO: 28298 - DNA, 2080 bp, Oryza sativa
tgtgctaaacagaaaccagaagaattcaacaaatttgctcaaatttctaatcaactgagaaaattgcggccaagtctgcacatagtcattgagaaaagttgaacagcacctgccggctctcgtgatttccgcgaaggattgtaatccgatgtgggtgacgcaccttcagcgctaccaaaagctggataaggaataccactcagtagtgcttacacataatgacatgatctcaaacataaaacaattgaaatatttgaaagaattccagtaatcgaattttgttgctggccaataagaacaaataaatctggtatgtgaaacttgacagcttctgtaaaactgtatataaatactcatcaaagaaaataagtaggttaactcttacagtaacagtctcaacagagtaatagccacgatccacataatcccccataaataaataattagtatctgggcactgaaacaaagaagaacaaatatattaagtatctttaagaacagaataacgaaaggaagatttcaaagtatggtagcaaaagtaaatgcaaatagtaccttcccaccgatccgaaaaagttctacaagatcatggaattgtccgtgaatatcaccacaaatcgttactgggcttttgacaggctgcataacccaaaaaaaaaaaaggcaaaaccttaaaaccagtactcatctaccttaccaaattaccatggaacagaacatgcaaatattttgagaacgtcttagcagaattgtatgtgcacatactatgagctatctgaatggcatgtaaaagagggggtaaaaattaaggtgatgaaaattgaatggaaggaggaagacttgaattcctgtgtttattttagtcatcagcattggcagaattatggttggattgaaaggcacagaaatgtatgactaaaacatatcaaaggaccaactaacttgtgtaacactatgaagtacccttgctcaaatacaatgccaaaaccatagtgcaggttcaatcaactgttgaagaagcaataaggaaatcctgtcacactcacacctatcctgaaatatacccagcataacagtgagaaaagaaccggcagtatgcgatacctgaacattgctttcctccatcaatatctccttggccttctcgcacagtgctttaacctgcaattgagggtccattagaacacacgtagattccaggaatataagaacaccagttgtgtagacatttatgcccatcaaatgttcctatttttggtcaaccgtccatgcatatccacacatatgtatatatcctatcgtattctacaggttataagcatgtgaacctaatttgcgatcaaaacaaaaggtagcagtgactacgtgtgcttgtaaatttccaatttttatgctactttccgcgaccatctctagggatctactaccatgaaccaaatctggatcatcacatcggaaggcaccaaattccaagttgccctcgccagccacaacaaacaagcactcgaacccctctccaaaccgccaaatcacccagcacaacaaaaactacgcgccaatcgctcgcgaaccaccggatcacacggcaaatccgaaccccccaacccaacatccccgaacaaaaaaaaccctaggaacagatcaaagcgccaccatattccccagatcgaggcgccccccgcggagccatcgccggcgggacgaacggcgagaccagaacgcggaaaagccagagcagcagcagcagcagagggatctcgctcgctcgctctcacctcctgctcggcgagcgggcgacactgcatcagctgctcgatctgcgtgtccaggccggcgcatcccccgccgccgtccacgctcatgggctccatccccccgctccgccctccggaggtaggcgagcgcaccgccggctcgagctcgtcgccggcggcgagggggggaaagcgcgcgcgcgctccggccgaggcggattgagagagtgagactgagagagagaagagaagagaagagagagaaactgtagacactggaggtagggagagagagagagagagtatcagagtactggacgggaggg

SEQ ID NO: 28299 - DNA, 3837 bp, Oryza sativa
  unsure (1)..(3837): unsure at all n locations
aaattgcagttgtataggagtaccatttgaaggtcccctttgattcaaagaaaattcatagtaattttagaggattttattcctataggattttttcctacaaagccctttgaatcaaaggaatgaaccctagggaatcctatgaaattcctatgaaatgtctcttcctatataagttttggaggaattttaacaaagaggtagaacctcatggaaaaaatcctttgagtctttatctctcatttaattcctgtgtttttcctgtggtccaatcaaacgatcattcctacgtttttcctgtgttttgcaatcctctgttttacacttatattcttatcagaatcctatgttttttctattcctccgtttttacattcctaaaatttaaaggggcccgaaatggaggtttttcttaataaaatcctagagagtttaagactgtttcatgcacgaagtttgtttttatggctatagacaaaacaaataaaggaatgagctaacgtatgtactgataaaaaatgtgtattgcatatctgatcggattaatagctatggccttttattctcaacatgtagatatgccactgttaagggcccctttgaatcataagaatgaaaaaactgaggaataggaaaaacataggattctgatatgaatgaaagtgtaaaacagaggattgcaaaacacagaaaagacataataatgaccgtttgattggaccacaggaaaaacacaggaatttgaggagagataaagactcaaaggatttcttccatgaggttctacctcttgttaaaattcctccaaaacttttatgtgaagaggcattccataggaatttcataggattccatatggttcattcctttgattcaaagggctttgtagaaaaaattcctataagaatgaaatcctctaaaattcctataaatttcctttgaatcaaaggggcctaaaccttttgggaagggtaccttttatttgtttgaattttttaaataaattgtgaaacattattcaatgttcatatgaatagaacttttgaggcattttattatcacaccatgaatccgttttaacataaaaagttatattaagtaatcggtttgatccagttaaactcctgcaccattcttagatctcttgttgctaacaaaatttttcaataggttttcgtcacctttcattgatcaacatgattccacaccaataccatagccatggctgccttagccttttttattgagggttacaaagagtctattagatctaatttttacttttcttattttattatagccgtgcgattaacttttatagagtcatatctgtcataagcaaaatagtaatcaagccatctttactaatttataatttacctataaattccatcaacacttcagaaaatcatataccatacaaactaaacacgaaagtacatcttcaagctattatgccgtggatgataattgctttgttttatgtcgttcttatcttgtttggattccgttatacgacgaactagtacgacttttcttatccccaattctatttattctagtagtacttaaaagctaaggctgtgttcatgatttttagcgcatgcgaaaaaacattaatacatgattaattgaacattaactattataaacttataaagtggactcatttaccttttaaaaaaacaacttatatatataaagttttgcaaaaaatacactattttacatattaaaaaacatgtaaacgaaaaataagggaggtgaattttttttgggggaaagggatatattactcaggaattaaatcttcacttacaagatgtgttatgaaagaacactcatgttctaacaaaaactagaaaggcccttaagcgaacttttttttgccaataaatgactaactaggttttggttacggaagtttagagtcgaggaaaagaaacattacaatggggtctactgagactgcaattcttcgaagataaaacgtaatcccttcgtcccttaatataagagattttgacattttacctgtattgtttaactatttgtcttatttaaaaaacttaaaattattatttattttatttatgacttaatttattatttaaagtactttaaacacaacttttcattttttatatttacataaaatttttaaataagacgagtttttttatatttacataaaatttttaaataagacgagtggtcaaacagcaccaataaaatattaaaatcacttatatcagggcaaaacaattttccaagcttcaacagaagaagccagtcattcagggtggtagcccttgctgtagtgcagtacacgggtctgaacacgccgtggactgtgcgtgtgtctcatgtgcccgagagtccacacgagtcttgagaaccttgacgtctcgagctcgagccgtactgacctgaagtcctgaacacgccgcaagattcgaagccaaaccaacccaagctcccaggagaggagagcatctcctgcatctgcggcctcccccatcccactgctgctgctgctggtttgaaaccaaggcgacctcctcctgtagtagcgaggaggaaaggagaggagggagaggcgggttcttggctcctggggggccgaatcgcgggggttcttgcctgcccggatcgatccggcaatggatgcggctgccggaggcgcgccgccgcggcccgcggccggaatccgcgtccgggtgccactggtgagttccgtccccctaatcttctctctggccctagaggagcgtcgcttcttgttttgaggccgcaggtcgcgtgaatttagctccggggtagtgttcttggcccaaaggcgtcaacctttggctgccaagtgctgaatctaagggttttcctgttcatgccctggcgtatttgtgggtttttgatatggacgagggctcgatctgcgttcttagggcttggtattggagtataggttccaattatctgtgaatgcgtggtagttatttttggtgaagtaatctttgctgtgctgatgccacttcgtgagtttttgctggtcaaaatactgctagatggacaatttgtatcagtatgggatcaccaaatttgttcgtcccttcttttgtccccatttaaaagctagcatataatattttttttctcatcatagtcattttttagggatgaattaaggaggaagtagcactagcaaatcatcctattcctagctccatgtgtcacacatgagctacacaagcgtctgatccattgctagacattctttttgggaatacgcaaggagcgcatttttgtatcaagagaaataaagagttatttacaaacattgctagacattctgtgcaatgtatgtgaatttgtaaggtttgcttactagttataacgaccaagccaatcatgtacatatgaactgctgagcatgacgaacactactctagcatagctagtaactctaatataatgatgctagtatgagattagcatccataatagttgaaccaggaaatggtcatgtaaatataatggccagactaggtaggatatcctgggtctcttacactgttatacatttggtatgccagccgtgctgatgtttgtaacgtttgatggatgcaatatcaattttaggaacctttagactgtacatcagatttgtctctctttgtctcttacaaattgacagagaagcacatagcaaacatacattaaaagtgctactaaaattctctgtctctttgttgaactaattatcgccaaagaaggctggcatatgcaataagaagtnnnnnnnnnnnnnnnnnnnnnnnnnnnnnnnnnnnnnnnnnn

SEQ ID NO: 28300 - DNA, 8883 bp, Oryza sativa
agtgctcatgtcacacttaaaaatggcttatacaaggagtttaatggagaaaggataaaccaaagcctgtacctttaacatctagtccttgtatccataagttagcaaaagacattctccaattccgttcctatacagtagagcgatcatagtgaatagtgacgatgatgagcctgctatcccaccatcacctccagagttggtgggatcttatgcgagtgaacaaatagatcacttatgcacatggtttggctatttgtggattgatgctcggttgcaagttatatatattcccccctgattaatatacatataattttcgagtttagaaacttacggtatacttttgtggaatctgttgctaacgcatgggtattttgctagatatataagaaagataaacatcatgcaatgcaatcgtcacactattttgctagtgcctggacagaaagatacgtttgtgtctttagaagagttacttcttgtggttttgtttcacttatgctgttccacattcgggttagtataagcatatcctaacttcatttaccaatgcatttgcaggtagagtctgtgtcttgtaactgtggttttgtttcacttatgctgttccacattcaggttagtataagcatatcctaacttcatttaccaatgcatttgcaggtagagtctgtgtcttgttactgcagggtagatggaggtcttaaaactgttgtgagtgctaggaagtttgtccctggtgcaaagctgtgcatgcaccctgacattaaaccaaacaagcgcaagtcaaggagctcacacaaagagaggtgccgaactcaggcaccacttctacctggccttcctgacgacctagctattacctgcctcatgcgggtccctcgacttgagcacacaaatcttcggttagtctgtaaacggtggaaccgactgttatctgggaactattattattccttgcgtaagaaacttggcatggcagaagaatgggtttttgtcttcaaaagggaccgtgatcggaagatttcttggcatgcctttgacccagttcaccaggtgtggaagtcactccctccagttccagcagagtattcagaggccgtgggctttggctgtgctgttcttagtggctgctatctgtacctgtttggtggcaaagacccagtccgagggtctatgaggcgtgttgtattttacaatgctcggataaacaagtggctccgagccccagatatgctacaaaagcgtcactgctttggttcctgtgtcataaacaaccgcctctatgttgctggtggggagtgtgaagggatacaaagaactctaagatctgctgaattttacgacccaaacaggaatagatggtcttacatcagtgaaatgagcacgggaatggtaccttttattggagttgtatatgatggcaaatggttcctgaaagggcttgattctcatcgtcaggttgtgagtgaggtctatatgccaacatccaacgtatggtcagtcactgctgatgaaatggttacgggctggcggaatccaagcatttgctttaatggacgtctttattcagcagaatgccgggacggatgcaagcttagagtctatgatagggacacacgatcgtggaccagattcatggacagcaggcgccatctgggcaattcacgagcttttgaagctgcagctctggtctccctaaatggaaagatctgcattatccgcaacaatatgagcatcactcttgtcgatgtctcaaacacaccaacagttatcgagattaacaatgctcacatgtgggatgtttttgctcggaagggccagcacaggtctttcatagcaaacttgtggttcaccattgcgggtcgtaatttcaagactcacattatccattgccaagtgctccaagtttgagcatggctccatgtgaagttggaaactgggaacattctcaaattttgaaagggccgatcaatcggaagctgaaatgggtgccagaactccagcaaagagatggtctgttgcctgaatgaacatctagcgatctcgttcctactcaatctctccggtaccggaaaaatctcatgctggctgctggatgcagccatgcaggagaggaagtgggagcttcggttgtctataaaccaaggtgaaattttttggggtgtgagagtaagaaatattccatagcatcggtggtttgtccagtggtattcatgatttcagtgtgctgatgcttcctggtttggggttgagctgatactgctgatgatacggcagtaatggttgcattggcggctgtcatgttctacattttcggataggaaggtggtccaccttcatcctaatcatcatgtctatctttctttcggcttattaggcatgtcaaactgtgttgtatgatcgtatcagccgactagagtaacaaatgaataaatgttttgttcaactgtttatgctttataaaatccttgcctgtttgttatgccccagaacagtttggaatctggttggtggatttaaggatgttatgtctgaagaagatttcataggcatgtatcaaatactccctttgctttctttaatatttaacaccattaacttttcgatatacatttgagtaaagttatgtagttatcatttattttattgtgacttattttgttgttaaagttattttaaacatgacttattatatatatatatatatatatatatatatatttgcacaaaatttaataagataaattattaaatatatatttaaaagtcaactgcgctaaatattaaaaataaatgaggaagtatgtcctttgaactctgttgctgtgggcgaatctcatcatttttctttatttgagcattgtgatgcactgatgcagaagccgttataggtactatcaaatgcactagtggctaacaaatgcatgaaagctacagagaattgctgataaacatcagcccaggaaagatagtacagataatatcatcacatccagcacatggcaaattatggagaaatcgattggccgtttgaagatcattttcaggagatgacgtcaatgatgatattttcattttcattgtcacgctgatcctctctgctcgcatgcaagtcaaagccagggaaagaactgcacaagtcagtggctgctaacccagtatgatgcccttcattgtcaaactctcaagaacatactatgggcggctaatgagtgtcagcaggttagaacactgaccctatctggttagagaggcccttaattggatccatctgagaaggaagaaaacttggatgcttgtcgctacccaacttgttccatgtgtttgacaacttgcatatttttttttctctgctggatgaacattgatttcggctggcgatatttgtgattcctgataaaatcctctgcgtgattgctgcaaaatcacatgcctgataattgattctgcattaggtatttaggtagactgttttcgcagtaatgaaatgacattagctacctagtttagctagtaactaactctttttaataatacaatttattttggactttacttcagagaagctttacccaattattacaaagtttacgggataaataaccatgaattataaaattagcttaactgaaaaaaattattactaaaaatactaccctaaggacagtggtctctatttaagattgatcagagtatacaatacgtcattaccgttgtttttaccaacgatttgacttataagtagtagtattattaagttcagataatattacatcacacgaaagctactctactggcgaagaaggaaataatgcatagcactccctttcgccggtctgattagctttaccaagacctgacaaatcacgattttccgagaagattatgacaaggggccttatgataattaatctatatttagtacgtttggaattcaaggcaggctgcttatttcctgctttctcggatgaccaagccctccatgacttttgagagacaaatttgaccttttgacaaaatgatttgctcttgaattcacattatttcttttgactcagaaacagcgagacacagcttcagcttctctgttgcctgaaacaaagaaccagaggcgaaaagctgatatgaaatgagcaatagcatgcaacttttgattagatgatgtgcagggagagctcatgacaaggtggtgacacaagtggccatattatttttggcaagttaacaatattgttaaaattttgataggatttcttatgtatttaccaaagtttgacaacaaattaaatgtatgcattttttgataaattattcgaactaattcatccacaatcttaaggccacgttcatggcgtcctttattatggttagagaacccagcaaaggaatagcatttctccatgcgaggattgtgcttacccaacatgctagtatttattgtcgagaaaaatatcataatataaggggatatccatattttagaacatgatacacatcttgtgtttgtgggttcaagaatggtgatccaatcgcatcttcttagtacggcaaccttgttacaacttcactccagttgaaaatctaaccatagccacaagtcatatacaacatcaattttttttaaaaaaaacttggccagtgtgggaaacacatgccgactagggggaaattcgctccccaaggatttgaactcacgacacgaggtgctactaagatcactgcaggtactaggttatgggccacttcacatgtacaacgtcaattaatagttaacttttagtgtcgttaatcagggaaatttgctgaaatataagagagaggggaaatgttgaaatagaagagggaggggaaatgttgaaatagcatagataggggaaatgagagagaaatgttgatgttaagcttaacaacaacttttcgggcatgtacggttcattgttacagtttatcatgccacatgttaaacatgccattaggtaggagtagatgtttagtaagttgctataactatgataaatcacgcttggctaactcattgtcccatattgccatatgtcatgggtttgttttttggcactggtctttgacaagttttcaactaaacaaaccttaaatctactactacttaaaaaaaaaaataagaggtgcttccatcgtccgtcaaaaaaaccgggtgaaaaaaaaccgggcgaaaaaaaccagtttgtccgatccaaaaaaaaccggtaaagaaatttccgtttttaattataaaaaaattacccacaaaaatagtttctgtccgattccaaataaaaaaaattccgagcgacaaaagagtttccatcttcctacaaaaggaaagaatagtgcgaaaaaaaaagtttctatccgaagggaaacacgcgtgaataaatacctaattaaaaataaatatctatctctaaaaaaccttctgtcgtaaaaaaagaaaaaaaaggaccgactcccgtagagaaaaaaaaaagtccgactcgtgaaaaagaggttttctcgtccgtaataaaaaaaaagaaaaaaaaacatctaactcaaactccgtaaaaagaaaaggaggaaaaaacgacccgaccaaacttaaagtcgccccttgttatccgtatatatctctttaactctaatctaatctatcaatctaatctaactttttagaaagagaagtttccatcatccgttaaaaaggaaaaaaatgcgcaagaaaaaaataatttccaaaaaaatgcgcgggaaaaatacggtttccttcgtctgaaaaaaacaaaaaaaatgctattaaaaactatcagaaagaaatacaccatttctaaaaaaatggtttcaaaaaaccacacaagaaaaaaaaactgtttataaaaaaaagccgctctgaaaaaactaaccgatgaaacactgtttataaaataacagatccaaaaaaaacaaacggactcaacacgcgaaaaaaaccgatgtttcaaaataaggttcgagaaacccgtccgacttaatgcgagaaaaaaaccatcatttcgaaaaaaaaaatagaggaaaccatccaactcaatgcgagaaaaaaaaccgccgtttataaaaagaaccgctccgagaaaccgtccgactcaaagcgagataaaattgatggacgcttgggtcggataagatccatcgatatttttccatctcctacacatcatttgtttcctcatctaatccctgcactttttgtatgcaattatcattatcagactttttttaataacatattatatgaaaatagtattaaaaataaacatatttttaattgttatttagagaagagtgcacggtgactattttgtgtagacttgatcctgagtgtaggatttgattaacctattattggttgcaagaataatattgaaagaatatttttttattatatgtatattgttatatgaataatccaattattttagttaaagcaagcattggtaaaaagattgccatcatcgagtttgggtcattacataaagatgctctaattttctaattgtgttagctacaacgatccatagaaacattatcattgatatgggtacgcttgaaaaatgtctattgtcattggattattttttttacccgttgcaacgcacgggcatttttgctagtatttataaaaggaaactttgttgtatgataattcggaaaataaaaaagtagttaaaaatatattttggtgcattaattattaaatcatctttagtatgcggtctgaagtctgaaagcgcgatttgtttgccgtaaaagaataggaaactaacgaaaaggacgcaaaaatcacccaattccacttttcaattttgcggacttggcgttttccttcttcgtctttccttgtcctgtagcgccgcctctatcatgccctagcctacctccaccaccaccatcaccaccgtctcgctcgcggtctcgtcccctatatatacctcgccgccggatccgcctcgcctcgtcccgcgctctctcctcccctcctcgacgaacagcaagcgcgcgcgctctcatctcggtacgcgtgcgaaattcgcgaatgagattctgaaattccctcccgattctcgcattccttttgctgctgttgccgccggcgtcgccgtgccgcgggttcatatgcattgccgtttttcttggggggattttacgacggcggccgcggcgcggcaacgtgtagccctagcgcggctagcgcgggcgcaggacggcggcgagttgagcggaggggacgcggctgcacgcgcggcgcggggcggcacgcgtcgctcgcgtgcggtgatcccgcgcgcgcgcggcggcgccggctggcgtgaacgcaagcttacgcatgatcgccatcaaataaaagtcgctttttcctttttgtcatgcatctcatgaggcgtggaattattccctgtctgttgctaatgtgtgcaatcacctctgcatattcagagatcgtagctgaagattacacattgggaaactggtgtactgcctgcctctgcgatcgatcgatcgatcgatcgccatggctgacgcgaagggcgacgaggtgttggcggagggacagatgcctctgggacggtggccgatcctgtcctacggtgtcggccacatgctgaatgacatcacgtctgcctgctggttcacttacctgctcctcttcttgcaagaaatcgggcttgctccaaggtaatcattgctaattaattaattaaacccacgtagacaacagctcacaatcacactagtggtctgtgtggaatttcgatttgtctgaagcaaagtaatgttgctgcagcagctcagtttattaatcatggcttgtgttcaatttcttgcagggatgcagctattgtgatgctttctggccaggttgcagatggcctaatgacgattcttgcaggcgagatggtactaaataaattgagaaaccgtttgctattgctgaatgcgcgctgattagcaaaatacagtaactgatctgtgagcaatgtatgtggtatctgatcagatcgaccgatttgggcacttcaagctgtggcacatcggaggatcaatcctagtcggcatctccttctcctctgtcttcggtggatgtcttctctgcaccgtcctggggaccgattcctaccttgtgagaaccattggttacagcttcttcgctgccgtcttcaacatcggctgggcggccacacaagtttcacacatgtaaatttgatcacttgaactttgacagaagcttctatctaatttgcaatatgtttgggctctggcttggcatagtgacatggttttcttcctctcaggtcaatggtgaactgcatgacactgaattccacaagccgggtagccttagcaagctgcagaaatgcgttcactatggtaagtactacagttttagcatggaaacatattattactagaatactctttttttacttaaggtatctccgggaaatttcttccactgaactcttgttattataataaccttttgcacatgacaaagtgcattgtttctataccaaagatggtagtattcttttactgccatcttttatctgattgaaggtggcctgatatgtgcttcaaaaataattcctacttgtttagtctcctgtgtcttgtaccactgcaatcattgttctcatgaggaagatgctcaccagtcactacaaatggaaaatgcaggtggcaaatcttggtttatatgcgatagctttggttgtatttgctttagtgagcgcgaaggcatgctcagacattgttcttcaggtgactgcctaacctcgtcagttgttagatttgggtttcttggtcagtaaaagatactccctccattttttaatagatgacgcc

SEQ ID NO: 28301 - DNA, 5284 bp, Oryza sativa
caacggcgtcatctattaaaaaatggaggtagtatgattttacagaccagagacttacctccatgtacaatagtatacttgttactaagttgttcgtatatttatctgcagtaccgttggatagcgtacgtttcaatttttgtgggatgctgcttcctagtggtgttctatgctggaacaaaggagccgacgtatgtttttcttttttcagcgtagaataatgcattagacttttttttgggccgtgaagggtgttttctgaaagggagtgaatttggttttgcagtttgcagtcgggatctgactgcaagaaatcggctaggatttcctggggctactggttcaagaaggccttgtactaccaagtcgctctgttgtatatgcttgcaagattgatcacaaatgtctctcaggttgacatcgtccccactcagaatagaaaatattcttaattactactagcaacatgaaaatgcacattgcatactctaccatatctgttccactgtgacactgattgccaaatacgcatttcgctccctaagttttctctcaagtctgacattagtctaaaagaatttttttttcagtctctcatcgcgttctacgtcactagagacttgaagatgaatgagtactccaaagcgattgtgagttttcaaacctttttggttaacctctgtccttagaagataccaatcatctaattctctaatttttgacctgcatatatgcagataccagccatcaggttttgctgcagcttcctcgtctctgttgttctccaggtctactcctgtcagttaacccacttatactagaactagaatataacaagttaagttttttctcacgtattttgcaagtaaaatgcaggagataaagtggaacagccgccgcctgaagtcgctcctcaccatcggagcaatactctgggtgatcgctggagccgccgtcttcgtcctcccgagtcagatgcacaaccttatgtaccctctcgctatggtcatcggagctgcaaacgccctcgtcatggtaaagaacaacaagaactgcacttctcatttagagaacaagaactgcaattgtcatttttgcgtgatgggacgaatgatcttcgagttctgcttatgctcatgtgtgctgatttcctgatcaggtgaccacaattgggctagagagcgcgctggtaggagacgacttgaacggctgcgccttcgtctacggctcgctcagcttcctggacaagatgtcgtgtggaatcgccttgtttgttctagaatcatacgaagggtatccgctgtaaaaatggcatatttcagcgcattaaccacctaaattcaggatgctttggtttgtggatacaattgatgatcactcattgaaattatgtttctctcttattgcagattcgattagctgcggcgagacgagggggctgtacacggtgagcaggtttgggacaggtctgatcccctcgtgctttgcagtcttcgcgctgctggtcacctcaaccctgaagctccaggacaccaacccgagagctgccgccgctgcactggaagctccactcctcgtctgaagcacgcctccgagtgtgcttctcttaaactacaggacaccagaaaaatcgactgtatgtatcactgtatgtatcacgggaagaagaagaagaacatacataagatgaaattgcattgcagaaccctcttcagttcggtctgaagaggtaagctgcagtctgaagaggtaagctgcagcgtgatagtgtctagtaagattcagaattctggcccgaatcttaaaccttcgatgcttgtaggcagttagaaatgatctaatcagctctgttactgcttcttttcaattagatttgaaaaggtccaatgcttgtagcaatctgtaccagtgttgtatcaaagattcagtttcgagtgaggtttccgtggaaaacagcaaaagattcagttttgagtgaagtttcagtgggaaaaacacagtaacttgtttcaaacaagttctctacagaatacaaacaagttctctacagaaagatcacattattgtacaaaatgcaacagcatacagaaaacggcatcgtgtggagagctacagcaaacacactgaaaaacatcactgaaaagtgctatgttgacatgggctaatcggtgtccgtacgccggcggctagctcagagctcgtcgaccgtgcggggcttttgcttgccgtcgacgtggcggtggtgatgcttcttctccttgccgtgatcggcggcgtcgtcggcgccggtgacgcgctccttcacctcctccaccttctccttcgccttctccttcaccttctcgtacccctcgttcgccttctccctcgccgcctccgccgtctcccacgcggcgtccttcgccgcctccgccttctcccacgccgcgtccttcgccgcgccggccttccccttcgccgcctccttggactgcctcgccttctcgccggccgcctccgccttctcccgcgccgcgtccttcgccgccccggccttctccgccgcggcgtccttcgccgagcttgtcttctcccacgccgcgtccttcgccgacccggccttctccgccgcggcgtccttcgccgagctggtcctctcccacgcgctgtccttcgccgccccggccttctccgcggcggcgtcggtggattgccggagcgtctcctgcgccttgccggccttgtccctggcggcgtcggtggattgccggagagtctcctgcgccttgccggccttgtccttggcggcgtcggtggattgccggagagtctcctgcgccttgccggccttgtccttggcggcgtcgtacccctcgccggccttctccttggccgtctcttcgaccttggccttgccctgcttcgactgctcgtgcacctcggcgcccctctcgccggccgcctcggcggcctccttggtcttgtgcttggcctgctccgctctcctggtcgcctcgccggcggcgcccttcgccgcctccttcgtcttctcctttgcctgctcagccttgctcgacgcgcccgacgccgtcgcctccgccgcctccttcgcgtccccggccttcttgctcgtctgcctccctgcctctgcacagtcgcgcgcacacacacacacacacacacacacacccacatgttaattagctccaacacacgatggcatcaggcatggcaagatgccgccggcgagcgcgcgcggcggcgcgcggcgagtttcgacgtaccggaggcggtgtgctgggcggacttggcggcgtggccggccttgcgcgcggcgtcctcctcctcgtcgacgtcggcgacgtggtgcttcagcccgagcccctcggtgatcttctccttggcccagcccgtccacgactcgtcctccttgctcgccgcgtcctccgtgccagcctccgccttcgtcgccacggcggccgccgccaccacagcaaacagcagcagcagcagcgtcaccgccagcctcctcgaccgcgacacgatcgccattgctcgtgacgtacgtgaactcctccaaacaagaacagataatcgctttcgcgtgctagagaatacgagaagtcgcgaacccaacagtgcggtgatcacgctggggtttatggggttttatgggggagatgggtgaggacgcgtggagaggttggcgatggcgaggcgggtggccgcgcgacgggtgtccgtctcgggtggcacgtcgtccgccgcgggctggcacgtacgcagcgcgagtagaagcttttttgggttgggcaacttggaatttggatgatgaagagggttctaggcgtttcggctcgacccctttgacgttgcgtgtcgcggaggaggcagcacgtgtggtccgattttgggtcggccggtgtccgatggtgtgatggttttggtttggtatctcctttggttgccaacgcacgcagggagatggtatggtagtagtaaagaaatggagcatgttgaagcatgtttgtcgtcatggagcatcgtcagcacatcacggcaccaggctagaaaagtgattcgtatcactcgatcgtaaatcgtaatattagatatcttaatcttaattattttaatattttatttgttttatattataaatcgctttgaattttcttaagttcaacttcttcaagtatgattaagtttatgaaaaaatttagtaatatctacaacacaaaattagtttcgttcaaactaacatttaatatttaatcttttttataatatgtttgttttgtgtcaaaaatattgctaaattttctataaatttgagtaaatttaacataagtttgattaggaaaaatattcaaaatgacttataatatgaaaaagagagtagttgatatcttgacttcctagttcctaactatcgaaataattggggttaagattttcggtattgatatggaagtagttcaagtgaacttattccgctgggctagggggaagtaggacggcccggttcgttcagtccgtatcagcccagattccattgtggggccgaagttgtacattttatgatgggccgtgccccctgataagttgggccaaattctaactagcccatttctcctccaacaaaaaaagctggtccaaaacgtgacacggcgcgaggccgaccgaccgaacctgactgcgaagcgtgccgaactcagctactcctattacccaccgcggtagaaagatctgccacgagttgccgtgtccacgttccactcttctcttctcccgattttactcccaactttttttttcctctctctctctctctcgattttctcatctccactgctccacgcttccagggaagaacgtagaaatggcagcttgcttgccatccctctcaccgccgccgcatcaggcgccggtgccggcggcgacgaccgcgctggcggggaacctgacctcgtccctcctctccctgcccccgccgctgccccgcctcgccgtctcgcaccgcagggcggtggtcgccgcggcctcgtcccggcccccgcccccgccatcgcgggaggggggtgatggtggtggtgaggaggaagaggaggtggagagggcgatggggatggacggcggcatccctggcacctccggcgagttcttgcgccgcgtctcctcccgcgcgtacggcatgcggcgccacctcatggaatcgctcgactccctcgcctacgatggtaagagttgtcggatcctcaccctcttttcgtggatcgtatccgttcttgatgggtaccgagct

SEQ ID NO: 28302 - DNA, 2401 bp, Oryza sativa
aaaagaaaaaaaatcttcgatcgatttaggggttttagtttttactagggggtttaccgagatcgctcgataaactgcgttctccatactcttgaagtgtccgaagatttcatctttatctgtttgatttggcatcagcaccaacgacgtgaggcttgtacgtgcacgcgtacataccgtatttcgtgatatacgtgtgattcgaggtttgcctagttaagacttaagagcatgcgtgtacgtgacaattaacagtaacaatctctagctgtttccacagtttttggctctgctcaatgtatcgagatttgaatgttgacatgtcattgtaacaaagtgctgaattgacatgtatgctgtagtaaaacataccatcctgcattcagtagtatcagaaacactgatccccactccctagttaagctttatattttaacactttgatttttcaatcaaagatcggttagaaatggtgttcaaaagatttatgcttttagaaatgctgttttctttgtatgctttgctaaactgttttacaagcatggcagtctgaaattttactaactggtgtttttcttctggttcagtgttggagacaaacccatggagagaagactccaaaccagtctatgtactggctagaagagataaccatctatggacaatgaaaacccgtaggagtcgcaggttagagttattttgctgctgttgcgcttacacgtgtaattttgctgttactgaacattctgaacaagtcatgttatctctattttcttcagtgaagttgaaagggaacttggaatgctcttaaagggagggggttcaggagttgggactaaatcaaaatactctggttccaagtttaacatgcttgttgaagatatcagagagggaatactggtgagtagttaaagagaggggttaaattttgtggatgatttctttgagaaccgactaggtgtcctgcttttcctctgggttttcagttgtttacatagctacttgcttgacattctcttgaatcatatcatcctttgtctcaggtatttgaagacgaggacgatgctgcaaaatactgtgacattctacagggtggcggccaaggttgtgaggggattgcagagatagaggcatcatcggtaagaaatttggtggacatgggccttcatagtaccaatttgtggttggcaattgatcatagtagtagtacttatgtaccgggttacactcgttcttgtctgcaggttttcaacatctgccataaaatgaaagctcttgccgtccttttccgtcgtggtaggacccctccattgcctcaaagccttgagcgcgacttaagggcaagaaagagatcattggaagactagagtctttctgatacatagtatagaacttctaattgtatattcgtctagctgttgaagcaaaggccctaggccctgtatactacgtggtatgtagatccacaatagcacgtggtacatacatccacaatagcctaagaggaaaggaagtcaaatctgacagaaaacatgtccaatagctcgagatattaacaatctcagtaaattgattattcttgccattatgtacattctaaatgcttcagtttacaatgaataaatgagatctgttaagttattctctccatcttttcttgaggcttgatgaacaatacaattatgttgccatcatgctgaattgctgatgatcagatgagctccaaacaatttggtgtagtgactgccatctctattactactggcagtgaatgcttggaaaagatcttctatttttgaaatgaaatgcttgaaaaaactttcagggtgtagtcttcttttcagttagcttctccctcctgtacctcttgaaatcggctgccaggccattgtcgaaatcctgcttcatctgcagtgctagctgcctcagcacctgcaccatgatcatcataaacaatcaaagacagaatgttaagattttgcaaagcagtatatatatgttgactgttgttaaattatttaaagcttttcattactctttggatagtttttgaacaaccaaagaaacatccactcgagggatcaaaatagctttccaataaaaaattcagatacccatcagctagggataaaaacagttctccaataaaaaaaattcagctacccatcagctaggatgagtcttttgacatgggtcacttacatgcgggccttttggaaatgtgggacccatataccagtcactcaaaatcagaggacagagtcgtgtagaggatctttccagtttccatgataccatctctttctgcttgcacaaaagcagcgaaggtgctgaaaaatgctcaccgtctcgccgacgcctctgatgacgccctccggcaccagcgcgagcaccggcggca

SEQ ID NO: 28303 - DNA, 8048 bp, Oryza sativa
agctgatcatccttgcagaaatgaagccatgatcgcccccgagaaattgttgctgacgacgagacaaaaaaaagagagcaaagcttcaacattttgcatgctttgcagtttgcacaaagtgaagttgagaaaaggaaattggggaagaaatggtgatgtgcaactgaactcacatcactgagcttggttctcttgcgcttatcagggaacacggctccaacaatcctgggcctgttctgaaggtactcatcgatggatgcctgcatcaggaaattcccagggaagagtcagatcatctcaaagagtgttaactgatcatctcccaaatcttacatgctacatgcatcaggcaagaaacctacccctggagtctcggtcatggggatgtcagtgttgaatctgtaggagaaggtgaacatgtctctcggattgatcttctccttcgacttcgacttgttgccataggaaggagtcttgagagtacatgtcgtgagcatcctcgacgacggtgaaacacccagaggaagatcatttcttgatcttgatcttgatatttctcccactgatctggatggtgtcaccctggtgcagatgcactgcatgctcctgctactacctgcaacacactacttgcactgttacattgctctcgtgtattcaagtgtaagtagcatgctgttagaatattgtttccttgaaacggaggagagttaggcacctggatggatggcatgatgagatgagctgacacttagcaatgccatcttcttccctgtaatggtatcctttctcttctttttcttcagagatggaagttgtgagctacacttgttggttgctgggccaataagtaaactccaacgaggtgtgcagaatttgcagagttgagtattcttgcaagtaaacgcaaacggagtctgtaggccctacagggcgtttatttcttccggggtttgttaggagtttctgaattttgtcttggtttttacggcatgtggggcttcgactttcaacttcagtgtttcatttcaactgcggccttctcttctctgacgaggtttgccggcttcagtatttcaggcttgtaactctgaaaacgaccaaagggaaaaataacgaaccgaggcgaatgaaatttcaagatgcctgcataaaactgaaacaggtctaaaaatttgctcttttaaaatttttatttccctttttttcttggctgaagatcatatgtgaacgtgtaaggttacggcctttgtttcatattataagtcttttgaattttttttcttagtcaaccttctctaagttgttattaagtttttagagaaatattagtaacatttccaatatgaaacaaacattgtatcaagtttattcaatgttaaatataataaaactaatttggtgttatagatgttgctagttttttatgtaatattgatcaaacctaaataacattgactaagaaaaatttttttttctttctcgcccccttgtagagaatcagaaaagaaatatattttctcagcataatcaaactctttcttgaggaaaatgaggtgtgtgcaattgtaatctaggacaaacgaaggctaaattgagtcgataaattgtttccaaaagataggctctttcagatattttaacgagtcttcggcgtgcacgtaagctcgaacacgacaaccatccaaaaacactattacacgtactatgtaatagtatgcccgggcataacacatgctaaaatcatgtattgatttcttacttcagatctcctaaaccatagatgcagtctttgtgcccattctatgcagatcatcaaataaacctctagaaacataaaggaatcttccgactagctccgtaagacaagatggtggggctagccagcctaagtttaaagctacactccgggtatttatgtttttctttttcaaataaacctctactacaagcttacttgggtacattctagttatgtagttgtcaagagtattctcagtataattatatcaccttaagtaattgattggattcaataaaaatttccataaccttaaaaaaaacgagcttagttcaagcgatcatatcagacttcagacatccccatgtgatggcctaagtcttgacagtaatagtaggtgaactgccatatttcaatggaagatcccaaagaaaatttgtgcactccactattgccacaggacttgcagtaccacggttattgctacaggaatagcagtaccaaacaatatcggagacaatagatgaaagcgataggcctagacttcacaacggcgagatcacacgtaacgtaacccagtagagattagaagagcagcattaccagcgtccgtttagataagaagaaagcaaacaagtgaggaaatttcgctacaatgaccaaaggaaaagaaaatggcactacagtttacaaatcatataactgcacggcacaactctgaatttacttgcaaaaggtcaaaatctgccatgtgaccttggccattgttacagatgtttttttttgtgcttttttttggaaggaattaaggaattgcattaagctaaaaatggtgtcaactgcagtggttggaaatttgtattttcagcaatctgtttgagttactccattatccgtttctgaagattttctgttgttcagagctcgattcttttaccaaatatgccgaaaaaaaatatcatactgctgttgatcatctcctatggctatacacaccccaccacggcaccacccgccgttcgccttggcggcggcggcggcggcgacgacgacgcagagggagcatcgtggtggcgcagccgcgtgctgggcgcgccggctgggtgattgataaaatggcgaaaaggaaggtttccgatgggagcagatcttaatcccttgagggacgttactttgttatttacatgtctcttaaatatctctgtaaaattttaagaaaatatattaacatgtgatttatcactcacaaatatgtaagttcaaattcatcatctacatctcgcaaaaaaaaacaaatttgagtgtgaatatacgctaactagctgtagtttaatttattttttgttgcaaaatgtagaaattaaatataaacttacatctttgtggagtgatatatcacatattaatacatctttttaatttttttcataaccatttgagtcacgtgcaaatagaggagacatccctcgggagatcaaaatagtttcccgtttctgattgggctgggctattgtctgggccacactgatcacctgagaagttttactgggccgcaggccgcgacgccgcgtgctcccaccgtccctccctccggcgccgccctcatcttccccgccgccgcggcttcctccactcccccctcccgccgccgtcgcgcatcctcctcccctcccccatctccaaagcgccgcatctcctcccaatctccaccgcattagtcgcgggctcgtggcggctgaggcgtcgatgtggcggatgaaggagcggaaagccccgtgagtcggggtctcgccggcggaataccccgtgagttgcctgcgtgggatgattaatccgataatttagatgggcatcccctgctactgctctctcgattaagcaacttagtttttctcttcctcaaaattttcaattatcttagattgattgattggtacaaacgtcagactgcataatcgtgtccatttttatccaggatactgtgatttccaaccagtttagaacttccctgaagtacctaattttactcttaagcaatagaaaaaaatgttatgcatcagtgtcaacaaaaaatggtttgtatagcagtttcaatagatgaactttcaatttttcatccaacatttgtaagtctgttgtacgtagtaccttggtaattgacgttatacagatatactgaacgtgtagagccagttgcgttatacagaattttcttcctctgaactctattaagtagtcatatctttagataggattcttctaaacatagaagggtgtagttcataatgtgatctagattctattaagaaataattaatcatgttgaattcaagttgtggcatgttaattgcttctgcatgttgtcactaggtacagtatatcgcaaggtttactgcttcttataataggatgatgaaatgaaggattcagtggtttggcaaaagtattgcacgctacagcaaatagcatagtattgaaaggtgatcaaatgcttctactcaaaattactgctgtagtgttgtattttactactaccagttgcttttgaccaaatttaagtaatgaagaatccaggattggttgacgatttactcaaagtttagagcaagttcaatagtatagcccactgctagctccaatttatctatagccaatctaatagtcaattcatacaatagttgcttactatattattaatatatggtcccacatgtcatacatacattgcgtcttggagtccgtgctgcagctggctacagatctgtagcccgctgctcttctctcttatcgtttatctcattaaaatatgtttatagctggctagtagtctgctattgtacctgctcttatgatagtatgcccatctctgaattttatctgctgattaaaataaccttccattagacagaagagaggacaactgtgttttttagctaatctgacgctatgttggctggcatagctgcttatgctgctgagttaattttctgcataactgtcagattgtattagagatatcaatatgcagaaagttaagcatggattgttgttagctgcacacagtggatttttttatatctaattcagattcagtatgggaatcatatgatgccaatttaacagtcattgtaccaaattgttctctatgttaccggtcaagactgcagtttgtagttgaagaagaattctaacaagttggaaccttgaataattgatgcctagctctaatcgatgagctcatgagattgttttactgttgacttgcagttctgggcactttgtatttagtttgtttgaactgctgccgattttatttaaatcaagatatattttaacgtcacctttctcgtttgctgctcattttgcttacaaatctcgctagtcattttgtttcggattcatgacttcattctcctcatgtaagttttgtgctgtacattttctacaggttcatggtcatgtttttattgtgcaatttattccattatgctgaattaaacatagaaacgccagtaaacagaaaagaatgataatggtaagaactttatgtcaatcaagattcagtaatctggggtgtagcaacaagcaccccaaatttctctatttatactctgacacagccatacaggtagaagtgttgctctgctacccagtaaccaaacaacatcctacaaggttaagaaatccaggtacattctacaaagctctcaagcaggcctttagggagtagttgattagatgcgctgtgtggcttcttgttcagtgacaggagctttgatcggattagatgtggaagactttgcagttatgcagctcaatccatctccggcggcatctaaggtgagagtgcgctttctagttcaagaactgcatggttgttcctattggtacatgtacactaagtatttcttcttatatgcatgtcaattcccttctgatcgtcaggcaagaacctaagataatatgccatggttatgctaatggtgcttcagagctgaattccaacgcaaggagcttgttgaaaggtgaaatctgctacactgggaagaagaaagagagcatctctgtttccagttcaaacatcgctgtctcttcacagggcattggatttagtttggagcaaagaactggagagaagtgcttagccaattcccatttggatgtaaagctgtgcactggaattgtaaagctggttatagataagtgctcttatatttttaagagtaaagggggcatctttgatgggaactgcagattgcaagatgttcttaagcttggtttctggctctcaccagagacactccgcccattttggcgtgcttcagagctgaagcctgatgatttccttaacatcttgattggctttgggccagatgctgcagaagtgaagaaggcaatatttttgtggaatttgtactggtgggcttcgtggcagagcaaggcattccaacatcttccaaggtcgaatgaaattatggtgtcaatacttgcaaatgctcatatgcttagccaagcggaatcattgcttctcttgttggatggcaacagggttctggctgatgcaggtaaactgtttagtcaggttatccaagcgtatgcagaagctggcaaccttggtaagtcaatttcaatttatgactgtgcacaggataggtgtctgattccttcaggctcatgctaccaggtacttcttcatctactgatggaaaggagaaaaaatgacttagttttaagagtatatttggacatgcttggagctggattaggttcttacacggaaggagatattcttgatattgttgtcaaggctttaatcaagaaagacaaatttttgcaagctattggtataattcggcagttaaaggatttgaacattcaaatgagtaagggatccttatcagctgtcacacaagaattttgcaagaagaaggatattggagatatgatgaatttcttagaagagtggaggtatctacctgacttgcttctcagcaatagaattattgcctctttatgtgcaaatattggtactgatgaggcatggttggttttccaaagattggaagtcttagggtttgtgccagatgcaactacttttggaatcttcatacgttacagctgtagagaattgaagctgaaggctgcatttctatatttatctgagtgcttttctagacatattaaccctaaagtttgtgcttataatgctattataggtggtatttttaaggagggattatacaggcatgcaaagtatgtctttgaagacatggctgaaagaaaaattattccagaactgttaacatacaagatacttttggcaggatattgcagatataggcagtttgatgaaatagaacaaaccttgaggactatggaaaccaatggcataaatgatatcccgtctggaaattgtgtgctttctaaggccttatcattcttggggctagaccacctaggggtgaaagtcaagagagataatgctgcaggctatccaaaggctgagtttttcgattcagtaggtaatggtctatatttggacactgattccacaaagtttgaggcttcattggtacagattatcgattatgctctttacccagatattagcttgaatctagtcagggcatgtcggcaaggtgatatcgcaagtgctcttgtactcaaagatgaaacttttcaatggggacatgacatttctacagctagctactcagaactattaaaggccttaagcgcgagccctgctcgtgcaatggatgccattaaccttattgacgagatggcagatacacctgacaaatttgatgctcaaaatctaaatctggctgtccaaacattgagtaggaatgggaggtcagcttgtgcaaggttggctttcgacagattgcttaaagatggcttccctgctagtcaagatacctatacttatttgatgatagggttctgcatagaaagggacatagcaggattttgggaatgttggagtctggcaacaaagcatggatggtcacctggtagcagggatgtgatcccccttatcagtcacttgagcaaatggggggtaatcgaggaagccttggagtttatcagcgtgttgctggactgttaccctagtttgtttttcagtgcatactgccaacttctcgaacagttatgcatgactggttgcacaagtgttgcatgtgccatgcttgaggctctcatacaaaagggtgtggctgcggatccttccctaattcgtaatgtgatggaagggtttctaaaggagcataacatcgctgaaacaattggaatgtatgacatg

SEQ ID NO: 28304 - DNA, 1254 bp, Oryza sativa
tggacttggtacaatctgtgatgaacatggaatctactgatttctcaacgtgcagttctatcgggaagaacttattgcaatcaggaaaaataggccaggtaatgtcagtctttgaggaaacagttttggggaagaagttcaatgctaccttgctaaattcctttctacaagcatattattgtgtaaaaaattggagaaaggcagatgcagttctttgcatgatgttaaagatgcagaatagcctttctatttctagttaccgctttcttgtccgtagaatgtgcgagcaaagtcggatttccagcgcattaagacttaaagagctgatccaagatagggacaagtcaacagaactaattttatacaatattctgattttttatcttttccggagaagacacattttacaggttcataatttgttgaaggatatgaaaagcaatggtttttctccagacaccaccacttatgacttccttgtcaatgggtttcacaagtctggagatgtcgatcattcaattaatatgcttgattcttgcattgctcagggattaacgccaagcaatcgtagtctcagagtagtattgagtcaccattgcaagttaggaaaccttgagaaatcactagaattatttcatctgatagaaagcaacggatggaagcatggtttagtcattgagacaaccctcatttcaagtcttctctcatcagggaggttttctgaagcaacatcttgtctgaacagcatgaacaaaagagagctgattgggtttgacatacattttgatgtcctaatcaaggaactctgcttactgggagatgtggaaatgtctgttagtctgctaaatacaatgctaaagaaaggcaaaattccgagtgaagttagctacgactctgttgtgtacaggctatgtatgttgaaagaattcgatcaggcacttgattttcttgctgagatgcaatttgcgaacctaaaaccaagcgacatgtcctgcgatgtgcttatacagggcctttgtgccatgggaagaacctgtgatgctatgaatattttggaaatgttgaccaccattggctcttcaccatcctatcacatgtatagagttgtttttgagaactgttgcaggagtaacaatctacagaaggctgcaacacttctgcatgacatgcagcaagctgggttctcacccaactttgagatgcactggtctgttattagcaatttaagtagtaatgctaagaggactacaggat

SEQ ID NO: 28305 - DNA, 26999 bp, Oryza sativa
gtcatgataaggtaatactactgtctattctaaaagtggaaacaataatcccaaactttggctgtaatcttattatttttctaaacaggatgtactttcgattatcgtttatgttggcggagataatgctgatattatatcactccatcaaatcagaggtgattcacccctgcgacttttctcttcaattagagcctgtgtaatcgattgctttcttgaataacccaatatagagtgtgcactcaacttctcattaattttttttcaatcagtgttactactagttgtgcttgcgcagacacttcttctagccatgaaagacacactggagctcacttgagttgccatgaaagatgcactgactccacaccagtacgatttattatgaaaaaagtaatccacaccagtacgatttattatgaaaaaagtaagcggaatacaagaagcttaaaatgcttcaatgttacaaaactagagacacactggcgcattgccttatccttttaatatataggatttttatgagcatctatgggcgccaatattcaagattatcacacccacaatcagactcttggcttctataaacatacatccaaattataaagcaccaaattgtgcaatttgcatcataaaattgatgcctattcattgttgggcacgacagcacccacacctccatccatgttatatgaagcgtcaatatcagagttctgaagttctgatttctccaagcccttatctggtccaagattctctagctgaaccccatgccttttcaatgcatctttgatcttataaatctgaaatagcaacaaaatatagcttgaaagagcttaaaggtaatctgttcacaaatgggcttagattaacggaactcacagttgaaattgtacagctgaagctacagatacggccttctgcacctctgtaaaagcggaacattggcaatacatgaacattgagcctgcggcacatctccttttgttcattggagttgaccataagaaactgcagttccggatgcatgccagccaattgacataccttttgggacattatgcaaaaaggtgttataactattcaaagtatgaaatgctcttttttcgttaatttatgtttgagaaaattgtttaataccatgcatgtgttcttttaccttagggtgtagggccttgcaagctccacaactaggggaaaagaagtgcaccacggtgagcttatcgctggccaacaggagctgcttgtcaaaatcgtcttgtgattcaatgtttttcatgttgcaggatttcatgttcttttcccaccatttagtcttcattggggtgtgaacagcctaacaccacgacaatatatctcattgacatctcttttgtgcttgagcatgtattgtcaatgcatatttgagttttgttatttgtgtatttcgaatgagaccaacaatttcatcttctgtgcagatttttcaaatacttttggctgtagagaatgttttaccaataaaattctataattttaagcattactaaacatggttagcgaagcaaccaaatctcttaatattaaatgcacttgataaaacagcgatcctgtttcaagaatagttgggctttgatttagtcattattaggccagaaaatggtacctggagcaaatacagtgtgtcagtgattagtgtcatagaacacaaaaaaagggttaccttggattgtgaatggattgtggtgccccttgatatttgaacaacaaaacaaacaaaacatattttattcttgagattaaatagcacttgcaaatttgcaatctaagttaaaatttagcctgttgattttgaaacctgcatattcctttctatttaacataacaaggaaacattctgatttacttgtagaaaaattcagatgaccttctacggaaatgcactgaatatatttttacaaagaaagcatcttagtttgcgcttgtcatagcaagaatggtttttctggaggtaaatgtttttgtttgtaatttaattagttccaaacaagtaatgttcaagattttatactttcatagcgtgtaagactttcttttacttcctccgtttcacaatgtaagtcattctagcatttcccacattcatgttgatgttaatgaatatagatagatatatatgtctaaattcattaacaataatatgaatgtgggaaatgctaaaatgacttacattgtgaaacggaggaagtagtgtataaggacaaagtttcatatgcatgctcaattgcaatgtggtaagaaattacattggtggaattttctgttgcagctttggtgatctgccaaccagttgaagcatccttttctcggagcaagaggtgctttctgttgatccgattgtggttccgagctggcaccatgaaggaaccatcagaactattattcttggatccacgctgagatgaacgagaaatagcccaacagttcgtcagagcagaagccattgccatccttcaactgaaaaagaaaggatgaaacagatcagcactcctgaaatgatgtggaaaatgggaaattttaaaagcttacatgccacaacgtatccacacgaacttttcaagagctggaaatgtttgtgatggtgatatgggaatggtccatggtatggtatttatagctgaagaaaagtttgcttcagaagcaaaggatacctcatcctccctaaaacagagcccctttttgcttttttttttcagttcatgttcgtgagttcatcactctaagaagcaaagatgattatccaaaagaagatatggacagccacatttgttgttacctgccatcatatctggactagctaggtgctttatatactcagtttccagttctccagcaaaagctttggtgtttcttacactctgctgatttctatctaaggcggcacggcttgtgccatggactggatgaagccgatgtgtatctggataaaaagattgtcaacatgactcatctcttctgtagtgtgtcaatcctaatgcattgtgtgttctgtgagtcatgggcaaacttttgatctaaatcttaatctactttactcggatgtgtatccatgacatgactggatttcttgtaggagtgcctgatattgcagctatgtggtgtattcttcttggttgtgtatatctaactgttgatataaaggtcagatttttatccattatctaaaaaaatgtggtgtattttacttgtcctctacttgctcttcatctgcttgtgtgtatgctctatccagctattggaatttcagaatctgtcacgcgatgaacacggcctgtttggaacatcctgctcgatctgcgtgcgaatctatctgtgatttttacgttttagtacatactaatactgagttactgactgatcaaactaacatattaaaggggcagtaacacctgctagtcagaaaataatactctatccgttttatattatataaattgttttgactttttccttagtcaacttttttaagtttaaccaagtttatattaaaaatctagaacatcaaattagttttattaaaatgaacatttaatatattttaataatatgttgttttatgttagcaatgttgctatatttttctacaaacttgatcaaactttaaaaaattgactaggacaaaagtcaaaacgatttatagtataaaatggagggagtatttacagtatgctgcttgataattactgtattccttttgaagtaagaagatttaggtaggtgctaaaattgataatagaagaacttgcattgaacccataattccaaaatggatgaactaaaatacttttcttcaataaaaaaggagatccgctggacgaaatcaagaaaacaaagaatctaatgtgaaaattacaccataacatggtcaaaagaaaaaaaaaaggaaattacacccatagctacttaccagcatacttcttttttcccacagaaaccagggactggtttcccatcaaccttccaaggttgacattgctacagaggttacaactaggacatcttttgagtttttccacccttccacttatagatcttccacttacaccataagttgactacccctcgatggctcgaagggtataatgtatatatagtcgtgcaatgtcggtggcatctttgtgtccgacaccatgacctgatatttttcgcagagcttgtcgcttgttgggtcgacgtgtcgtttaagtcatggtatttgtcacgcaatgcatatccttttatgctcttgctctttttcggctacaaggattgtgttttcaaattaattaatgcaaaaatctagatataatataaatttttttgcaagggaaattactaaataaacaaaacagcacattcttaaaatcgttttatcccactgaagagttgtatttagatttagaagacttctttcttgagtgaatagtggagatactcctttgctatagattataattataggggaataattacaatagagggcatggggagtagagaaaacaaaaaaaaactgttaaactgtaaatggattctcgattgaggaatttaagatacacaattgtctccaatataaaaataaaccataatatttgggctgtgaatttattgtataatagaaaaatcaaggacacatggctaatggttgctaagaaaaaaaattgcaaatattctataggttctcagagagaaaagggaaatcattcaatttgattgactccaattacaaagaatttcttttagtgtcttagaaacatatttaatgatatgcagtttggaaaaaaaatagaaaataaataccgggcactatgtttaattaaaaggtaaaaaaaaatttactacttggggtgtggatttacattgtattcctgcacataagaagtttcaaattcaacagatacaattttaatattgaactctgtccactatacagcaatgcagtacaccgtgcatctgataaaaacagtgatatgctttattattcatggttctctttcttctggggagaactggaagatccaccttttggcaaaacaattcacagctttcataatacaattggctgctacagagcaatggcaactgagcgtaagtgcgtaacactttaacaaaattaataaagctcaaaacaattaatattctgcaggcatattgcacaggccagtattggcttcagaatacacagaaattgtaacaaagcaaactgcttttgttcttacccaagaataaccattatattctgtaaaataatatgggtaatttggccatttctttgcaaaggcaaacatgcaatttcgcacagttcagatccttgtccacaatttgttttgatcattgcaatcccttcttgcagaaccatcaacttatgcttatttacaaccatacaggcatcgatgacagcatcactcttttgtcgctcatgtagcttttttcacttgcacaaacacagtgccatactcccattgtacaaatgatgtgcaaactgatgtttggatggattgaagatgtttcacatatttatagccacgatccacgactcattaccttgtttatataattgagttcaggaaagggttgcatctgtactaaaaaggatatcagaagataacacaatggaggatatgtataaccacaagccatggctgcacatcttgttgttacaaattgttcacctttatgtagcttatgcagcttgggctgatgtttatctgcttgactagaaatccaaacaatagcctgtgatgcaacctctctgagtctgacaagattagacccatttcattaatatatcatcataagtactagaattcactattcaggatagcttgttgttcttcgcgcacatacatctgcatcattttctttcccatttcccatatgtgatattcagtttctgatccagaacagagcttcacaactgatatcctcaaccaatgaatccttttctttcagaatgtgatctcgactgtccaaaagactgaattatatccttcacactgccatctacaaacgtttgacctgcttctttgttgacaccactgtcatccattaactttctcattttctctgacccaaaccattctccaacagatgcatagatgtttgagaggagaacataatcaccgctttcatcattccttgcctttagcagttgcctatttgcatgtttagccagttcgatctcaccatgaaccctacaagccgaaagtagtgttctccaaatgacagaattaggctcacatttcatcgtatcaatgaactcaaatgcttcttttagtagcccagcacgacccagcatgtccaccatgcaaccgtagtgcttgatattgggttcaaccctgtacttatgctgcatcaagttgaagaattcacgtcccttgtcaaccatcccgccgtggctgcaggcgataaggacagcaacaaaggtgatctcatctggcctgaccttccccttcagcatcttctcaaacatatctatggattccaggacatgcccatgcagtgccagtcctcctacaattgagttccaagttgagacgtccttgtctcgcattgaccagaacacctcatgtgcacttttcatgctcccacattttgcatacatgtcaatcagtgcatttcctagaacaactggaaacccatttcttgaaaacatatctgaaagagaggaatgcagcctctggccaacgtccagatcaccagagtcagcacaagctgacagcaagctgagcattgtgacaatatctggcttttcacccatgcgctgcatctgctcaaacaactccagtgcatgcaaatgcgagccacatctcacatacccagaaatcatcacgttccagaacacgacatctcgctcgggtacctggtcgaatagctcccttgccaatgccatatctccccgcttcgcatacgcggtgatcatcacattccaggacacgaggtccttcacaggacattcgtcgaacaggtcccgtgcagcaccaatgtcccctcgccttgcacaccccgtgatcatcgccgaccaagccacggcatcctcacgagctctgccatcgaacagagcagccgcaatgcccaaattcccgcagctcgcgtgcatgccaatgagcgcgttcttgacgaacgcgtcggactcgcagccagccttcacaacgtgggcgtgcacctgaaccccggtgtcccccgcgcccatggcggtgcaagcgcggagcacgaacgggaacgtgagcttgtcgggcctcacgccgccgccgccgccgcgccgcagcatgcgcgtgtacagggagacagcgtcccggggcgcgcccgtgtgggcggccccgcggatgagggtgttgtacatgaagcggtccgggcggggtatttggtcgaacacgaggtaggcgtgcgcgatggcgccgcggaccgcgacggcggaggcgaaaaggagctcgcggagctcggagggatcggagaggaagccccggagcgccatcaccgcgtgcatctgcttgatgtgtcgcaggctccggcaccgccgccacgccggcggctgccgccgctgcgtccccgacttccgcaacatctcagagtctcagtccactagccttgtccacgtcgccaatgtttaaatccagtcccattttaaacgcatactaattgaacagttctccatattttttctcaaacattcatgtaaagttttgcaaacatggtgtcatggtacattcaaattcaaaccagattacaggtttaaaaatgtgcaaacatggtgatacggccttgtccacgtcgccaatgtttaaatccagtcccaccatttgtagcgtagaatggaacagctttcgataaaatttctcaaccatttagatgaaattcgcaccgtttcaagcagggtctaggaccaacaaatcctagaatcaaacatggtacattcaaatttcaaattcaaaccagattacataggcttatttactactccggtaagcgatacgggcggcggcggcgcggctgccggcgagcggcggcgggggtcagacggaggtggagacgcggaccttgaggccgtgagccatggagaggatggtcatcatccggtacttgacggggtggtcctcgacgaggtcgaaggtgtagaagcggaagaggatggcgagcgccatcttcatctggaggtaggcggagtccttgccgaggcagatccgcggcccggcctggaacgcggtgaacttgaacggcgacgcgttccggaacgcgccgccgtcgccgctgagccaccgctccggccggaagctcgccgcgtcggggccccagttgtactccatcctccccatggagtagggcacgtacgtcaccatcccgccggcgcgcaccttggtgccgtcggggagcacgtcgtcctccacgatccccttggggtcctgcggcaccgccgggtagaggcggagcgtctccgtcacgcacgcgtgcaggtacaccagcttccccaccgcgtcgtagctcagcagcgacgcgaactgcgccacgcgcgccgcgaacgacgcctcgccggcggcgtcggcgagcgcgacgccctcctcgcgcgcgcgctcatcctcgaacgcggccagctcgcgccggagcttgtcggcgacggccgggtgcgtcatcgccatgtacgtgaaccacgacagcgtcgtcgccgtcgtgtcacgcccggcgatcacgaagttgagcaccacgtcgcggaggctcttgtcgtccccgaagctgccgcccccctcgtcgccgccggcctccccgagctcgatgaaccgcgacagtatgtcgtgcttgatctgctcgccattacaaatcaacgatatcaagaaacaaaaccttttccgatctgatcatcaccattaccatgtcagttcagttctactgattctttgagcaagagaggaaggatcaccttctcttgcttgccgctggctcgagcctgcaagatctcagccttgcggcggcggatcacgctgtaggtgaagtcatcaaccagcttcatgctctgctcgaggagagcctctgatccgacgtgcaagaacttcttcagacgccacagaggatcgatgaaccgcagcgtgacgatgatgttggcagcgtcgaatgcctgggcaaagctgttctccgggagatcaggtgacagcgtcccgatctcaaccccaaacccgaccttgcagatcgagtccagtgtcatcctcatgaacaattcctgaattttggttagttcttgcatcagaattctgaacaatttggtttctcaagaaatgtttaggtattaggcaaggaattcagttggttacctgcatgtctacaactctgccggccttgcatgcttggctcagaatgcttgatagcttcagggagtactccctgaacaccacagtgctgaagtctctcaagttcttggaggcaaactcgaagctcgccgtcttcctttgcttcctccacatctcgccgtcggcattgaatatgccatcaccgagcagcacatccatgtaagacctgtacacttcaccctgcatattttcagacattttttgtgtcagtgttagtactgtgcaaggcacattttacagtacactgaagatcctatggttcttttaccttggggtaattggtgaagttggtcttcaggacatgctcgacgttcaccgggtcggcaatgtaggtgtaggaggtgaaaggcatgtcgacggtcaccgtcctgtccttcgacaagtactcgacaagccagtcatgcatcctgtggtagttcttcagttgctccactgtcgcgccgatgattggccatgatcttggccctttctggttcctcaggctccacttgtggaccaagatccatgagaggacaacaaggaagatagctatgagcttgtggattcctgctactgggaagaatgatgtcactggcattgcatgagcttcctccatggggctcttcatgaagggttcagtctacaagagatgctatgtagcattttggatggcatagttaggtgatatattgggcactgatgctaccaaccttgagacaatctttgtgtgaccaagaattaagattgtctcattcatatggtgtccctaacctaacacccttaggagttggatcttagctttagttttctttttgtgatctgtccacctagaaaagaatcgttactcatgtaaacacaaaatgaatgctacagtatttttttcccctgctcagccaagttcgttgttttgttcagataactgaagcgtttgcagcgactaaaggtatgccaccttctaatatcagaaccatatccatctgaattctgttaaattgtcaccaactgaaaccaggcttaccattttctgtcgatattgtctagtctttgatgacaactaaaatgaaatggggtatcctcaaaagaaatataaattgtgaacccaaagtagttggtttctacttcacctgaattctacttcatctgaataggctattttaatgaagagaaaatccaagaaatgccatttacaaacacccaaatccaagaaatgctatcgacgagtacgagttccataaaatgctattgtagaagcgattttgtcccagaaatcagttgccatctagttaaaacattctcacataaacaagcaatataaaatactattgccaagatatatccaatactttgcatctctaaagcttctagttattgacaactaatttcttttccagtcaatacaaataagccatctatcaaagatttgagaaattgcagggcacaattctacagaaaattaaagaacatcacttgaaaaggaagattttttctatagaacttatcctttgtgatgtaacaacaaatactcgaatgaattgagaaataaccaatgtcaacactgaaacaagtctgaaaccaagatcagaagagcatgaaaatagtgctcttatggattgaccttgattcttgcccacactcttattacaaccttcgagcaaaccggagcatttgctgaataaatctctcatctgttactgaagatactaggtaactaaataaacaatcaatcaagagtatcaaaacctacaggcttttgttactgtcagcatccaatgtaagtctgaagagagctctcattgcctgcctcttcactaccctgccataggtagccctcccaatcctcaccaccttgtcttccacctcgagccgattgccgcagccgttgccattgtcggcacccctcagcattgccctcagcacgctctcgttcccgccgattgcgccggcgacgctctctgcgacggcggcctcaccggggacgcgcctcccccacttcctcaccagcttgtcggagtcgaacagcgcggagtacgcgctccagaacgacgcgcgcaagaacgccttcctcctctccttcaccatggactttctcatcctctcctccagcctcaccaccagtgctcccatgtctcctcctcggccattgaccaattcgttctcaagttttgtgagttcttgcccaacaatggcgtcgctggcttcgaacctgcaccgatcgcattggcattcgaggccccacgctctcgctgcctccctgcgcttgctcgccggggtgagcacgtcgaagtaggcgaatgtgatctcctccccggctttgatgtcccttgacgcgtggacaatggcgtggtcgccgacgtgggtgcgccgggcgttggggtggcacgagtggttgatgaacgccggcaagatccacagcccgacgccgcagttgacgacgccattgctgccgagcagattggcggatggcgctgcgtcctcggtcaagcaattgacgtcgagcactttcaagatcttgtccacatcaagagatgccttcggcgccatggccgtgccgtcatcgagctcctccgtttcttgcttgaaatgtgccatgtccgggatggggagctcgtcttctggctcctcgccggtggagagagtgtagatgagagatgccgtcctcgggcacttctcggcggcgtcgagcaccttgtcgacgaggtccttccacaccaccatcttctcgccgctatcggcggcgtccggaattactccccttccgatcgccaccgccttggagatcaccaggttagctcccgcctcgatgttcttcaccgcgaacacccctcggccgccgtgcgcggaccggcgcacctccaccgccccgacgtgctccgcgaggtctgggcacttcccggagaacccggcgagcacccactccgacagatccaccgcgccgctcctcgcctgcgcgtccaggcgcttacactgctcgaccatctcccggacctcgtcggtgccgctcacggcgagcgccgcgcggaagcactcggcggcgcgcgagtaccggccgaggccgcgcaggacggcgcccttggacagcaacgccccggggtgcgccgggtcggccgccagcgcggcgtcgcagtcggcgagcgcgccgggggcgtcgccgaggcgggcgcgggcgtcggcgcggtgggcgagggtggagcagaggacgcggcggtctttgcaggcggcggcggcgtcgaacgcctcgatgatgagggagcacacggcgatgtactccgtccagttctccttgagcagcagctgcgtcgcgcggctgcgcagctgctgcagcgagtcgtcgtcgaggccgggcgtcgccatggctgggcggcggcgtgagatttggctggggagtggtggtggtgcgccgcggggcggcaatgtcggaggtgtttgtttggctcggtttcgaaagctcgcggctttacagcgtaacggtcggatctgatttctgaatagtttttcgaacgaaacaattctgaattttttaaactcactggagtgaatgcagtagcaacggctatgagctgtcacacactcacagtagtactccgtaatatagacgtcataatggtcatcttgtaaaaaacaaatactccgtatgtaggttatattggagtgaaaaaatatgtattggtcatcttgtacaatgcaatggacttgtgctcggtagagaagaagtgatgaatgaaataaatctagggcttgagaccgggtgactctctctctctcgaaccctccctcgcctgctacagtaaaattcccctttctcgacccctcttcctcctcgattccggcggccttgtcgccggtgacgggagggagaggggtcgtccccctcccctagtttagtatagtagtcgggctagtctcgttaggtcgggtttttcccgtttctcgtttctatggcgatggaagttgaagacggtggcggtggcgcgattgaggccggtgacggtggaggcgacaaggttggcgacggcggcggcgcggatccggttcgcggcggcggcggcggcgcggatccagtctgcggcgacggcggtggcgcggaccagctccgcggcaacggcggcggctcgaacgcggcccgtggtgacggcggcgcggatccagtccgcggcagcgccggcggctcggacgctgcccgtggcgacggcggcggcgcggatccagtccgcggcagcgccggcggctcggacgctgcccgtggcgacggcggcggcgcggatccagtccgcggcagcgccggcggctcggacgctgcccgtggcgacggcggtggcgcggatcctgtccgcggcggcgccggcggctcggacgctgcctgtggcgtctgcggcggcgcggatccagtccgcagcggcggcagcggctcggtcccggcccgtggtgacgacggcgtcgccgatccagtctgtagcggcggcgatggtgcggacgtggcctgcggcgacagtggcggcgcgagggctgtctcccacgtcgttgcttccagttgtgtcgttgtttcatggtgcaggccatctctttctcagccatctccatcatctcagcaggacagaagctgatttgcagccattcaagtgcttcttccttgaaggttggctgttcttcggattcatctatcctgttgttccctaacagaagaaaccatgttgggtttgtcattcgggttgagctcggaccacctgatgagccccgtggggatcctttgctgagtccggtgacgcacacaccaaaatctacggctcagcatcaaacctcggtcttgtgccgtttccgtggaggcagccgatggggattaacggtttgtcaagcggactgcacatcttttgaggcccagggtagcagtcgtcgcggcttcgccgcagatccctgtcgacttgctcctttttctgttctgatgttaggttatttcaggaaggttgctttcgtagttcagttaactctcctttcttaaggatggctcttttgcttggatatgtaatggggtttattccctagatctgttcctgcttaataaagttgatgtgttttcaaaaaaaaaaaaataataaatctagggactattgcggtttgcttgggaatggcaaagtatgaatatataaacttattactataaaatcaaaagaaaatgatttataagattttatacaaccttacatacaagtagtagtaaccaggaagaaaaataggagaacatcaaggggtaatatttttcaatacagtcattttgccttcacagttcatgtaatattccccctggcctttgattttccatttaccattgatgagtaatggtaataaaaacgcatagaccagactgcattttgccaaatcttactttgaatttgcaggaacctaggcactcacagttcagagagtttctgagctttggctttgtgttaatgaattgctgtttttcctatatttgaaaagggagctgctatataccggtatcccgttgggatactgtcccaacgggatcgctccctgtcccctcctcaacgtaagaacgaaggtcactatgggagcagcgtagatgaggttgacgtcggcggcgcggacgcggctgccggcgacgagctctagcgtggaggacacggccaccggcgagctccggcatggagctggtcgcatgaacggcggaggatcctgcgtggtgtcacagtcggcgccggctacaagttccggcgtggggcgtgacgtcaggaggatcctgcgtggtgatggcggtggcaccggcgacagagcttcggcgtggaggacgcagccaccggctgaggcgtggacgatggacgtggtcgccggtgtcgaggtcccggcggaggacgcggtcgccggcgacgagctctgatgtggaccatggacgggggaggatgcggctgccggcaacgaggttcgggttcagtgtggagcgtggacgggggaggacgcggccgtcggcgacgatacctcgacgcccaactcctgtatctagtaggtatcatatgatacctcgcaagtatcaccccgatacatcgtagaaatcacgcgatacctgataggtatcacatgatacctcgcgagtatcgcctgatacatgataggaatcgtctgatacctgatacgcggtagaatcacatgatacctggtaggtatcactcgataccggctaggtatcaggacctgatacctcgcaagtatcacgctctacgtggtaagaatcgcatgatacttgataggtatcatctgatatctcgcaagtaatcacctgatacgtggtaagaatcgcatgatacctgataggtatcatctgatacctcataagtatgatacgtggtaggaatcgcctgatacttgatggttatacctgatgcatgttaggatacttgcgaggtatcaggtatctataaggtattaggcgattcctatcacgtattatgtgatacttgtaaggtatcaggtgatacctgtaaggtatcatacgattcttaccacatataggtaatacttacgaggtatcaagtgatacctgtgaggtatcaagtgatacttgagtatggtcatgttaaacctaggaggtatcatgtcccccttagtatcatgttcagtctcaccaggtttcataagtgatactttggaaggatcatgtgatacctgggaggtatcatgatcctcatttgtatcatgtctgctatcatcaggtttcacagatgataccctaggaggatctgcacgaccctacttaggtatcatgtctggtaacacaatcgtatgaatttcatagatgatactttagtaggatcgtatgatacctgtgaagtatcacatgatcctacccaggtatcatgatacatgatcctcaaaagtatcattatgtgtgatacttgtgaagtatcacatgatcctatctagtatcatgtctagtacagtggtttcatgcaagtttcacagatgatacttgagtaggatcatgtgaaacctgggaggtataaggaggtaggatcaattggagtataaggagtacatcatcctcctgaggccgcggacggacgccgccaccgtcggcatggacgatgacgacacgtagcagagatagtacttacccttcctccccggcaacaccatcgccgacggcaagccgtggctggtctgctcgtacaatcacgccgttgacggcttcaccgctgtcgccgtgtcaaagaagcccagctccgacgctgcttccaggacggcatcgcttgcttgtattgctggtttaagcaggaaggaggatgtcaaccttgcggatccggccatggcgatgacgcgctgcgcgcagcggcgagagcacccgaggcggagctgctgcggatgcgccggggtagcggcgacggcgacgcgccgcctgcgcggtggaggtcagcgaggtaggaggacgcgagggacgacgtcgccgccattctctctccaagccaatcccttcgtctcgcgctgcagcggtggatgacgcggtggacgaaaggggatcctgtcccgttccgatgggatcccgttgtttagcattcctttccgtattgaggttcgaagacgtatagttgcactctccgctttcaggttccagtctcgcgccatcctatccacccgattaaaactggacggtcagatcagcaagtccttccgctctctagccttgcactcccgccctaacccttcttccccgtaaccccacgggaaggcgatccatggcggcggcggcgggttggctccggcgagcggcagcggcggcggcggcgcctcgcctgccttcaggccttcctatactacctactccccctccagcccctctcacagaggcccaatcgttcgtgctcccgggcataggcaccgccgtcgccggcggcatggacctcatggccgttcccaagaaaaaggtatcctagcttctccccccactgtatctcgtggtttttggtttgttaccttcatagtcatggtctggtcgtgggtcgatggtgcggtatggcgcaccactgcaccgtgcccggtggagtgcactctaggtgttcgtcggattgcctggagagtagaaaggtattatgacctatggaataatggaaatgtcctaacggtggaacacggggtgatagtgcacacagaagattgcctctttttttctcgatccattgcttggtaggttagtgatagatgttttgtgttttgagcccattccatttggagcataatgtcagcgaggtgtggtcttaggggtatgcttgtttaagctatctttgcaactatggcaaacaatatagttctcatgaaattcagttccacttataactgtgacgaaggctgagtttgttctttcaatgtctaaaaagctctttaattgtagagtgtatactgaaagatgttgccaagactagtggtaagttttcacttttgtttgtaattagcaatgcacaagttgtttgttatgtgagtggatttggcagatgagtcaatacatgtgtaactcatcatgatgatatgcaaatgtgataactcaggaaaaatcagaaaacaaagataaccgagcaagtagtcagaaaatgtctggttaaaggcataaatttcttgtcacatttgatatttgagcatttgcagttatctatatgtaaatagtgatagtcttgcggtgagatcaactaattctaactactagcatagttacttttgaatatgtactttttatgtgctctgttgaagcatgtgcttcatctcattgcctcagcagcttcagctgctttttgagatttgagaattattatttgtttgtttcatgttccatgattgttgcttcttgaatgttgcaggtctcaaaatacaagaagggtttgaggaatggaccgaaagcattgaagccggttccagtgattgtccgttgcaggtaaatttgaagctgaaaacaacatgcttgttagttattctgatttgttctgctatgtctaaagacaacttagtattagtaaatatcatttttttatgtaacagcatactttattctgattgtttcactactcatgtggacaattattagactgttcagattgttgtctagcgataccctcactctttacaatctagaatgcaatagtatcaatagccaccaacttaggttttagtggagcccaaagtgcagacacagaaaacatgctatgtgatctagcatcacaaatgctgtagaacaacattttggcgtgcatcagttcttcccagatgattcagaaattgcgcgactcatttcagtttccggatttgtcatcctttgctcattgttgttttttgttccatgaaatttatttacataattgttctggagtacctttccattgtgctgacgctgaaaattgttcatcttgaatggcatgttgcaaagtttatataacctggtatcctttttgtgcctgtcaggtgctgtggccgagtgaagctgccccacttctactgctgtagcggagaaaaagggaaccccggcgactcaagctcataaacctgttctgtttctccccaagttcagtctgcactcagcacatcaagcaatgtctgaacactattccaccatgaacgttttcagatctcattttgtgttcggccgctgttctgttttcaagctttttaatcagtgtacacactttaaccccagcttggatttcaaaactccccttgtcaaaaactcaaatgccactcgtgacatgaatggatgcattctgtctgagacaagaaccaaatgtgtgcatgtgccttgctagaagaaagaaataaagggcctcatcttttttttgcttatgcttatgtttatcagctaaaatttaaattttcaaccttaaatttggagttgattttggggttttttaatcaaagtttatttttcagcccttgtttttagatagctaagaacacgtatataaaacaattaaagttgtattcacgaattatttttcgtttgccaatatgccgtttcgcttattccctggtagagccgaaaagtgtaacaatccagcagcacggacaggggcgaagctagcatcaaaataagaggggtgcactaccattgagaatctagaaaatttcagcacataactgcacattctagtatttttaagtccgaaattaggaatctggcacatagtatagtttcgccactgccgcacggaaggtgggcgaggaagactggaagagagatgccagttcgagatgcggatgctctttcattttcgtgccgtttccggtgcggtgcaggtgcaaaaatgctgcaaccacacgcgcgcagtggtggtgcgggtttggtagaggacgaaaccgcggtcgttggcttggccttggctggctcgcctcagagccgccaccaactaaccaaccaaaaactcctccccaacccaaaaacgcgacgaaattcgctggcccccacgctgcgatttatgtggaccggctgcggcttgggtgcagcagcgagcagataacgaggcgaagcggagccagatttccctctcctctcctctcctcctacgcgacgcctcctagccgccaccgcttcaccaaatcaaaagctctcgctgctcctcgagagggagttggtggagagagaaagagagagagagagatggcgtcgccgtcgtcgtcgtcgtcgctgtgctcgaccttcgcctcgccgcgcgccgcctccctcggccgccgcctcgccttctcctcgcccaggtagttacccccaccgttcgcttccgagattgcgcccccttcttcgctggtatgcgccgcggccgacccgatctttgcgagctctcgcgctgtgcgtattacgtccacatggttaggggtggttgggcttcggggtacctcccggattggacaaaactccattcctgaacgccggatagcatgtcagagtcaaaccttctgggactggatgggttcatgagctttgagctgccggcgcaggttgaacgagctagtattgatgctatttctcccaactgctctcaagctgcaccagttgacttgaggagttcatcaggacggcatttcttagaacctttactgttgctatgatgctatctgttatttgtgttttgtaagtgatgtatgtattgcctagtcatgataaaacatgacaacaaaaggtacaaatgctggttaaacttaaaatcacatgttgaggacttcactgctttcttaccttggttaagtgctgtgatcttaaggttctcattctgtttttcccttgatgctttgcaggaaagcattccgagtgagggcatcatccagggttgacaagttctcgaagaatgacatcatcgtgtccccttccattctttctgcaaacttttccaagcttggcgagcaggtctgtcaagattctaccctccatcaaaccaccatgacatggaaatatatgtaggaggatcatttaggctactatatattggaataatagatcgatatcatgagacaaagaataggttgataatatattgtgtgaataatattactaggtaaaagctgtggaggtggcaggatgtgactggattcatgttgatgtcatggatggacgttttgtgccaaatatcacaatcggacctttggttgttgatgctctgcggccagtcactgatcttccgttggatgtgcatctggtacttcttgagaagccttactgaaattttaggtatttatgtgctgtaatttttctttcacccttgctaatttggcgtttgttatcttatttattgcagatgattgtggaacctgagcaacgagttccagattttatcaaggcaggtgctgatattgttagcgttcactgtgagcaatcgtcaaccatccatctacaccgaacagtcaatcaggtaaagattggcatcttttactagttaatatttgagatagctcatcctcgctctttcagtcattcatgaattagcataccactgtagaagtgtggattcctctccaaattgaatcagtattttgttttatgagttttactggtatgtgaccgggaggaaactggactttcactagtctcctgtcaaaggatcatactgtaatatacttgtatactgtactttaggactacttaccaaattgtttcttggatcctttatatactagataatggttatcgtttgctccttgagctaaccatttccttgacatggtgatcgggactgcaataagttgatttcttacctgtctaattctagttgaacttgagatatactccatattcatttttggcagtaattgcgtttttattctaaggataaaaatctaaaagtgacatagtggtctcacattttttcagatcaaaagtcttggagcaaaggctggagttgttttgaatcctgcaacccctctcactgcgatagattatgtacttgatggtaagactattctcactccaatatttatagggtgttgacacgtgtgtaaatctattgatggattgatgtccaaattctacttggtagtcgtatgaattttgttattattttcaatgtatcaatcctaatattagttgttaagtgtgatgggttgatgttgaaggagcacacatgacatgtttagattatgtttgtaattttgtgaattagacaagtcactcctgttatttagttacctattgcagtttttataagcatagccataatgcaattttagttaagagtcaaaactgtgctatttctggtgaaaatttgatgagtattgactgcattccaatcttgactttcttgactatcctgcctgtagtcacttcgtttccttggattaagcataattattaacagcactcacagtagaaatttacatgtctttctcatcgtacgacactattatttctttagttcatcaatagcccaacaggcatatactccgacaactgacaagctactacatttgtctgcgcagttgttgatctagtattgattatgtcggtgaatcctgggtttggtgggcagagctttattgaaagccaagtgaagaagattgcagagttgagaagattatgtgcagagaaggtatatcctcatttcctgcatgtattctcactgagccagtgctctaagcgtgcatttcattcttttaatagggagtaaacccttggattgaggttgatggtggagttggtcccaaaaacgcctacaaggtcacctgatttctagctttctgttactgttatttttttcactactgaataccaataacagttttggactagaattatggttcagttgggtgttaatttattgtttctttgaataacaggtcattgaagctggggccaacgccattgttgctggttcagccgttttcggggctccagactatgcagaaggcatggcttcttttcagtgacatacacattcaatcatcaaacactaagttcttaaacatgaatttctgacatagtttactaacagatagtaatatgcttatgtttttcctcttgcaattttgcagctatcaagggaatcaagaccagccaaaaacctgtggctgtaccagcatgaggatcctaaagtagtatgctgtgtacgttgtttttgtttaccagtaccgcggtttgtacagatatgtgccaagctgtacgttatattggagaaattgaaggaagaagaaaacgtggagggcgaccgtttttctcactgtccgcgaagatatactacatattctcagtgtcatgtgatactaccgtgctcacgaaattgttcataataaatatcgttctttagcaaatcctataatgatttacacttctagcatttgaaatttatccacaaatatatgcatttttagagtactactttttgccccagtaacaaacatatgctccgcactggagtattgggtaatgtgacagttgaaaatatagtactaccaaaatggtcagggggcaaaaaaaaaaaatcaacacttgcgaatttttttttcatagaaaagcatgtattttgctttggctatcatcatgaattaattgattgtcatgaacacgaacagtaaacaaccagcccaatttacatgctttagaagggcattcatattctgcattcggcaagtgaaaaatgaatcaatcaatcgcaaagcgaaaaggctgacctatacaacaggagatcaggaaaaccggttaaacgatcaagatggactctgcctgctgtgctgctggcttcagtccactgcacgtcgccataataacttggctcggtgaggttacaacttgacttgacgctcaccttacactgattgcatccttggttcggctgcaaaatcttgaattggccaggcattcgtgtgggttagcataaaagtaatcctcttcttttggcttattttcaagtttctgccgacaggacggttgaactacacgatttctatgagtttcctggacagaagatgcaaaattgttccaagagattgtcttattgttgtacagatctataaatccaaccaatttctgtcggtctagtagcacacttctcctgaaacccaggaacctgaaatattgaaatgccaataaaaaactaatgaccacaacatatatctgattgcacgccaacttttggctacatgatcaaatcatactgaactgaacaagaagcttgattttcataaagaggaaatctggctgtgtccatacctccggtgaccttcaacaagttttgccatgttaccatcataagtaggaatgaaaatatcactggctgtggatacaatgaagtcaagtgcagccatctgagaagaatggttctggaattgtcgtagagcttccaagtctagcagcgtctcctttcttacctgaaagatattcaacactgtttatatagcgaagtgagtgaacatttaggcaatgaagtggtatcccaaaacatgtgaaacagtgttggcagacagatagggaaaaaaacacatgcattgaaatttatgaaaactgtactacaattattaccagttaccataacacatggaaaaggcaaaaaaaattggcagcattttgactacaatattgcacttacaagttttggaaatgcagcttgtaatggttctaatcttttttctcccccataaatttcaccggcagcaatgtatatgagagtgtccttctgaaatcccagagctttcagaataaaagatgtctcctcaggtgtaagtgggcatagcccttgcaatctcttagcttgtgaatcaatttccttttctctccaccatggataagcatatctgtttgagagaaaaagttggcctcagttgcttgtggcttgttgtacttttcttacacagaaaacattgagacacttatcttagagacatagacgtgcaattgtgtgtccatactcagcactcaagaataagatagcaattgactaatttgacaatattaagaataaatgagtatttttcctttttcatttcattgaaatgaatccaccataaaaaggagagaaaaactaggtatgaaaatgacgatttaatagactcagagtgatgttttataaactcaaataatcaccaaaaaggtaatacgagaatgttacatagaattgtagaagactgttacacatagtatctatgacatgaacaatcatttctagacgagttaagggggtatagataacatcattaaactattacccctttcattttaaatagatgttgttttgaattgtgtgtagtcaatgacattagtaggtacataggcgaaggaaaaaaggtccaaatcgtcatagctctaatatttttagtgaatatatgactagaaaaagtaatggtcaaaggtgcatattcgaaccatgcaaatgtcctataaacgacataagaaaaaatacaaaaccatggagagtgagagagtgtgtgttttggttgaatagggggatggtgtttgcctcctactacaacaaacgacataagaaaaaacggagggagcaatggagtgtggtatttcctcttatatgcaaggaactacttgggtcaatatctgaaaggctacattttggtatttattaatatatatataagagcacaagatggcttttgacctcattcttttgagctcttcagcttcttcttgagaaagaccatgattgcaaccagaaaaggccagcatgtccatctcatagcgtaaatgcaaggctgcaaatgatcccttggcctgaagtttctgcaccagtttattccccaaggcctcaatttgaggggtgaacttcagtgcatgaaaattaacacggcacctaagtagttgaagctgtgtactgataccattgtttgctaaccgagcatccgtcttgttaaaatggatgacgctatatttgctgaataatggtaagatctgcatagataagataccatgaagagtatataatatatagtaagcatgtgtcaagcaagatatatgtacaaacctgatgcaagtaatatttttcatcagaccagctcacaggtggcatattaagtatattgtttgaatcctctggaccaaacctcttcggaagctgtttaacaatgtgcacttcatctcttaatgtgtcaatgaaatgtttaacatcaaatatatcttcaaaattgctgcaaagtattgcaaaaatatcgcacatttcagatattaacatggtaggtccggtacataacctatcctacaaaatgaaaaatacctttgatcagcccagaatgacctcttgtctagttctgggacaaccattgtaaggtttagcaagcgagcaaccgccaccatgtcacatatctggaatatatggtttcaaaataacagaagtataaaaaagtgagagacaatataatactgagcagcaaaactaactcaagtaaaaaaaaaaacaactgacctctgaacgcatctgattcaaacccccattgcaagataccttcagataaccattactcttatagactcctaaaaacaaaaaaatcaagttaaaactgatatgcccaagtgatgattaatgctgcttcttaagtaaacattcaaaaaaatgaggatgtcaatcagctagtgcatccatttatgttctgccgtgacttctagagtgaaaaccatttttctcatcaatcgcaactgtacttgaagcagccgcttctacaacttcactaacttactatcgatttgggaaagggcaataacaagttcatccacatttgaatccaatacactttcatttgtacaattctactcatccctacagaatgccaccaaatccatacacatcaaaattcaaaactgaacaaaacttaaatcaaactccgcgaagaaataactaaacaaataaacaaataaataagacacggaggagatcacgcacttcgaggcggaagcgcggtgggcggaggcgagggctccgcgtcgccggcgaggccgaacaaggcgaggaggcgttcgacggccacgagctgcccgacgaaggcccacagcagcacggcgctgcaccccgccaggagccaaaccctaggcctagacctcgccatcggtcccccaccctacatccaccgccccctcctcctcctcctcctcctgatccccgccaccggcattggcagccgcggcagcagcagctcctcctccgcctcctggttcgagaaggttccagaagattcgggagaggcctagctgcgattttttttttctttttc

SEQ ID NO: 28306 - DNA, 16785 bp, Oryza sativa
cgagagcgtgtgtgcgcgccgccgccgtttgtgtgttggctttggtttttggtaaaggatctgcttgtctagttgtctttcgtacgagcggcggcgattagtccagtggtggtcaggaggaatccacacatgagacattccagacatctttagggtccagcatgtttatttgtttagtggagttgaataaaaggtcatatttggcattgccacttggagtattaaatctatggactctttgaaacacagtattgtcaaaacaaaatagaagaaataatacatgattgaaatgccctggcaatttaaattctatggattgtgaacatgtagaaaaactacataaatgattgtttcgatggagaaggaaaaacacaagaattataagagatataaacaaaggaaaggaattgtgttttcaaataagttgaacctcatgtcaaaatttttatgttttgagccaatcttaaagaatttcataagatatttggatgcctattttttttgactcaaaggatcgcaaaggaaagttttccactgaattgagttccttcaaattttcttcaaaaaactttgtcccaaaggagtactgtttaagtgaatagtactataaggtaatgtagtagcatggtgagaagtgtaaggatttatgagccgagacagcgggcaacaatagctaatgaaacacatctaagagcgaatgaaaatggagcacactcggtttgttgcactataattacgtcgcaactaactactaaaggaaacaacacagtcgctgtcgagcacaacaggaagcctagctgcagcaaatgcagtcgagcgcctgtgaaaaaagaacattatagagtatttacttaaccgctgtgattgctattggagaacaaggaaaaggagactcaggcatgagaaaagaaactgatagatgcgttagacgttagttctttagactttggtaaagaaagtgtaaggggtttacaagatttaaagagtactgattagatctagatttggtagcctcaaatataaatatttttttcttatttgatttgagataatcatactgtcaaactttccaaattccgagcaatttaatatttgaaattagctagatttgtgttacgaagactatatcgttggatttatattatgacattacaactttattgccaatttttaatatgacacttaaaaaacaatgatccaagggtaagttttatggtggaggtggatgtcacatccaatttagaccatgttatcttctcattaattaagaggtaacacatacttcctccggtttcattttaattgacgttttggacaataacacggtctacaaaatatatgtttgaccttatttttctattataatatatataataaataaatgcatgtttacttttattatagtgttttgaaaaaccaatctatatatgttgttctaatttctttaaactaagtatttttaaagttattgatggtcaaagttataaaagtgtgaccataagcttatctaaaacgtcaattaaaatgaaaccggatggagtacaatatatcacatttaatacacaaactctaatattagtccattaattaagaggtaacacatacaatatatcacatttaatacacaaactctaatattagtccactctcacatcatcttgcacttttcttggagattgtgtagaggttgccccttgcatgaggggtggctcattctctctctctcctaactactctcctccatctcatcatctaatcatatgtggcaaatttaggggtaatatgtacgggcttagggcaacagcaatgtatgtggtccaagcaatctatatgggtgggccttttggttgatccttttgttctctccacatgtactctaaggtgaaagatttctgctgtgcttgattcttgtaccatgtatgggctttctccataatcatgtcttcaaagtactcactagtacatgtatttctgacttgagcataagccccacagaactttgcaatatccctcttgacattatcccagtgtgtcttcatttgcttgactgtccttgtatgtgcatttctaggcatattgctgttgaactcatcagctacatccttccagtaatactctgacttcttatcatttccatctacagaatcaactgagttgttcaaccaagcgctaacaaaccgcaagttttcttcttccttccaattggtgcgtggcgctctcctcactccctcttcgctgctatcactcaactcttcgatgttaagtggctgcttctcttgctgtcttgtagttgtagggcaaggaatggatgactccgacccatgggaagaagtgttggcagcaacttcaactgaggtgactttgatgtggtgcaaagagtactctgttgcttgcagctccaaacacttgatttggagagttagcttgtatccaatttccttgacgttgagtagcttgaaagcttggaggagaataaccatatggtgggtagttgcctggggcaccaaatgggtagaaattatgtaagaaatttgggttgaagctttgggaaaactgagatgggagaaaacggttggggaattgttggggaggagagttgtagtgcctagaattttctaggcttggagattcttgatttaggagatttttgaaacttctgttggatgaatccatgatgaaatgaggaggtgtactatgaagctctgtctattttgtttttataggcaacatggagctcaagctgtcgagcaagttttgtagccaacatagagctcaaggcaacggtaacttcaacgtccaaccttcaaccagcatatatctgctgcagggtcatggatcaactgcttttgtttttatattcatttccaaacagtgaactcaaaaagtaatatattgtattctcttgtgggcaaacccatagccatatggactactttagccattaatgctttaaaggccacatctacattgtatagaggcagcccatataggtgtttttattgtataatgcccgcttttgattgatattgtggatgccctttcttatagtacttgccctagcccctaagttgtgtcttagattttaaaaaacatggaagaaaaaggagttgaagtggtatattcactaatagaaaaactcaaatgccactaggctcctcatttcggcgactaaactttgggtgtgtttagttcacgctaaaattggaagtttggttgaaattggaacgatgtgacggaaaagttggaagtttgtgtgtgtagaaaagttttaatatgatggaaaagttagaagtttgaagaaataagaatgtgtaaaactttgcagttttggtttataaagtttcagcatgaaattctgaatgtgtgatgctaaccgcctaacttaaccatttgtgtggaatttttcagcgattgttcagcacttcatcagctccgacagttcaaagctctgaaccgatggagcgcagccagactccgcgatgacgccgccgtcgccgtcgatctcgccaggtgatctcgtatccttcgccggcaagtgctcgacgaagcgcaagctccgcctcctccacggggccctcctccgccgccgccaccttcttccgaccgccgacgccgtcgcggcactcgccaagctcctccgcttcgccgccgtctcccccgccggcgacctccgccatgccgccgcgttgctctccctccacctcccgttcctctcctcggcctcctcccacctcgccttcttgtacaacaccctcatgcgcggcctcgccgcgtcctcctcgcccgccgccgccatcgagctcttctccgcgatgcgccgcgcgggcgccgccccgacgccttcaccttcacgttcgccctcaagtcttgctcgcgatgcgtgtctcagcggcggttgccttccgacctccacgcccaggcgatcaaacacggctgccttggcgcgggcagctctcacgtgcatgtccacaacgcgctgctccatggctactcgtctcgggctgctgttggggacgcacgcagggtgttcgacgaaatgcctgctcgggatgtgatctccttctcagggctgctgactcttcacctcaaggccaacgatttggatgccgcacgcgtggtgtttgatcagatgcctcaccgggatgttgtttcttggactgccatgatatccgcgtatgccagggcacgacgtccgcaggaggccttggcattgtttgatgcaatgccggtgcagccagatgaagtgaccatgctgagcgttgtgtcagcatgcactgcactcggggaccttgcaactggggagcgtgtgtgtcagtatgttgattccaatggcttcgggtggatggtgtcactccgtaatgcactcatggacatgtatgccaagtgtgggagcctcactgaagcacgtaatttgtttgatggcatgaccgtgaggagcttggcatcttggaatacatttatctcggcatatgcatcgcatggtgatgtggagagcacagttgctttgtttcatcggatgctggctgatggcaaatctgtgaagcctgatgggacgacactgcttgcagttctcaccgcatatgcacacaagggctttgttgaggaggggcgtgccatgttcaatgcaatcttgagtggcaactatggtaaagtggacctcaccattgagcactatggatgcatggtggatttgcttggtcgggctgggcaacttgaggaagcatacaaaatgatagaacaaatgccaattccaagcaatagtgtggtctggggtgctttgcttggtgcatgccggacacatggggatatcaacatggcagagcgggcggtccaaaagctaaagagcctgaacccggaggagggtgggtactacattttgctcagcgacatgtacgctgcttttggacgaacaacagaggccatggagatcagacggatcatgaatcaggccggggcccgaaaaactgcaggccagagcagctggagcacaccctgtctgcctcagccgtaatttttcctaggctgcatttcacctgcttttgccctttggatcactagcataatcaggtattgtctcttactgcaggccccctgtttgatgaactgtgaaagtgtgaatcctgaatctgaactgtacaggtgctgtatgctaatgtgctatacttgctatcctacaaaagtgggccagaaacgcaacaatcattgtggagggaattgttttttgaacaaattttggaggggaaagatttcatcatggctctttaagaattcagctccccatgtatgctatcaacttatcctttcaaagttcatatggcaaatttgagtcagtgggtatttatttgcagttgagttattgggacagtggcctgagcatgtagtagcagtctatgtgacagttctctccacaattgccaattccttgggtcgacagtacttagtactacttagcgtcttggttatgtcaacatattatggtttggaaaaaggggttttctttggcactgtaggcatttcatcatatttttcatgtttacttgattctccgaaatattcttacctgaattccttgcggtagattttcagcttaatttggtaacatgtcaattatgcaatctcttagattcaaacttgtcagtctgtcacctctggagacagcatagcagtcatttcatgttacataggactacaacaccacatggggctgatgtcttattatctgtcaaaatccattataatgaatttcattaaattacagttgtcattatttgagttttattaccattttctgcataaaatcatccagggaacctttacaccttttctgaacataggaaaacttgcacttgtactatggaatgcaaagctttgaaaaactgttacatgtaaacctttttctgttctatggggattgtactgacgttttgtagcattgtgatatccacttaaaaccagtataatatttagcaatgtgcacggttgtaaatcttctttgaatggatttttctattcaagttcattctttggaattaactggtcttactgttcaagtgaatttgctactcaccattgttctcactctgtcactgatgtagtaaaacatgttgttcgattaccaaggcctacacttagaatggacaaaataaaaccgcttgctcatatgagtatatataccagtcctctctgttctttgtaaaatctgagtgttaattgggactccatattgcatattatcaattgatcactatattgagtatattcttgttgagctgcttttgtgtcttggcagactcttcatacgttgcatgataatgtgcacaagggcgcttatattggcatattgataggagctctggtacaggatcagcatgttgaagctgaaccagacggctcggtccagagaatcagttgttgatgaagctgtgcccacggccacggctcaaaacaggtatgagaagttcagcttcagcacagtatgctaacttacctcctgcctggacagtaatcaatacatgaataaatatgcacaattaacgagagagaagaaaaggtttgaatcatgtcgagagtgaagaagtattgttccatagcagattctgactcgatatcttctgtgaaacttgaattaacttgcatgctctccaagaaactgatgcatcacagtaacacacagccaccaattcacatgtttccagttcatttttcatcaaatacacactattactatcctatctacagaaaggcatctctatctctaacaatttgctgctgctatcttggcaggaacccgtactgcgagaccggaacctcgaacgccatcatcttctcccctcgagcaaacccgttgcggtcgtaggacgagatctcggtgatgtccagctccttgcacgccctgatgagctcctccccgaccctcccagctgcctcctgtcacaacaagccagccagctcaagatatcaatacaaatgagcagtttatgtctaattactaggtgaaattcttggaggcgtcgtttagaagtcctattcctttagggtgttgtgtgcttattttgttttaagtagtaggatcagacgtagacgcgtggtgtggttgtatattttctttttcctgtctatagtctcccaggactgtaggcttgtattttattccttcaatagaaacatcgcactatcttgtgcgggttgtttcaaagaaattcgtggaggaacggagtgggcggcgtaccacggcgccgcagggcgggtcgccgcagatggccttctgcagcgtgctgccgtagaagaggatcttcctgttgtggtcgtcgacgagcatggcgtagagctgcctgttggagcagaacacggacagcctcggcttcgtcgccgtgccattgaactgcagcgccggcggcaagaaccggtacatgttagcagaagggcaattggtttgtgctgcatggtgagccagatcggaacgagccgtaccttcttctgcagcctgcggttcctgaccttggggttctccttcctcgcgccgtgcctcgccgtggcctcgatcctcgggtacgagcgccggcgcccgactccgccggcgccgcctgcagaagccggagtgaagaactgcacgccaggcgagctgggagggcggcagcacgccgggcgcggcgagaatggcagcccgggggccgcgcggagcgatgccatggcacgcccacgggtggagaccttggctagctgcttggggtgggcaggcaatccgtcgagcaggtgcggcgcggaatcccggtgggagctgctacagtgcccgagattaggatttaggaatgggatttgtcctcacttctggggccccacctgtcacctgacaggtaatacaaggcttaagcaagggtgtaatcgcaaaattccccctcgagtttattctttccgtatccattttgtgctctcatctcaccatctaaacctcgattaatttcaaacccccgtcaaaaactactcacgtagtacaactacaagccaacccgctgcaaagctttgcccaccatttccacacccgcccaaagctgagcaacgcacgcgcgcgcgcatggaggggcagtgggggcggtggcggctcgccgcagcagcagccgcctcctcctcgggggaccagatcgcggcggcgtgggcggtggtgcgggcgcgggcggtggcgccggtgctgcagttcgcggtgtgggcgtgcatggcgatgtcggtgatgctggtgctagaggtggcctacatgagcctcgtcagcctcgtcgccgtcaagctgctgcggcgggtgccggagcggaggtacaagtgggagcccattaccactgggagcggcggcgtcggcggcggcgatggcgaagacgaggaggcggcgacgggcgggcgggaggcggcggcgttcccgatggtgctcgtgcagatccccatgtacaatgagaaggaggtgaggcgttggaactctcccttttccccccttccactgctgaatttcgtgatcgatcagtgtacgatccgcttcggaatcggaagcgtgcatccaaatctcccagcgatggttggacaggcttgcttaatgctctagcgctttttcactttcacatgtgacattttgcgaggcattgcttcagctctcgttcttgttaatccgcaatgcattgcttcgcagctctcgctgttgttaatctcttctaattgtgtggcgcatttgcgctgatattttagtctgttgatttagaatttgttcttccgagcctctgaatcagccgctggaataatggctcgtgggaccctgtctgtgctcagatcaataggacttagttacatgtggggttttgttttatcaatatagcgacatagcgtgcccgctagatgctaccggatgagggcccacattgcgggccttgcaaagcaaaccaggttgcagaactgttttgtagttcagcaatatccaggagctaactaatccaggaaattattgttaagggcaatttacaatcgccatctaatgggtttagcattctgtctatttggtggagatgttaactaagactgcgcgttgaatgttagttgtttttgtctgacaagcatccaagtaatgtttcaaagaatttgctaattggtttccagcatgtgaaaatgtgatgcatctgccattcttgtgcaggtgtacaagctctctattggagctgcatgtgctctcacgtggcctccggaccgtattataatccaagtcttggatgattccactgatccggccattaaggtaagttaaacttctgcatacatgcttagttttctcctttactcgagccaagtattttcagaagtcatgcatggcaaattggcggtgcaaagggcttagatgaagagacggtccatgcaatgttcatgtcaaacaagtagctagttcctcatagttcttgttgcttccttttatggtttacgttgttcagttgtggagtgcagaaggatgatggctcataatcctgtggattaaccaagtacaccccacatatttctgtgagttgaccacgcagaatagaacggttgatgatcttagtgtgacctgtattttgcctatcttagatatatagtacatgcccaaaattattttccctagatactcaattgctggtctactcatgattgctagacatgtaacacaacacagagtagttgacatagctaccacttgtagacctttatttaaccataatatcctaaactgaggtcattgacaggataaccacaggatcataccacttgcaaattaataacaatacaaatgcgtgatgaagttaaacatgctaaaatactgggttcacaaagcttgtgcttactattatttatttgcaatgatatagtttgataattcagcttgacaataaaaattgcagctgtaagctgatcccatcatgtgaagtactggataatctatgttcaacattgcacatgttaattactgcagttatttcctatgcggtaaccaaggaggttctttctctttttataaaataaaagaattcgtcgttctgcttaatagttgcagctgtgcgttgattgcattatgtgaatcaaagtagttcaacatgacatcatgaagttttacttcatgcgctataaggttactttcaggtagatgaagattgatcaagtgtacttatgtactttcactgcttagaaatccacaatccatcattattttctatttagagttagagcttaaaataggatttttgtttctttacttagattttggtcaaatgcaggatctagtggagcttgagtgcaaggattgggcgagaaaagaaattaacataaagtatgaaatcagagataacaggaagggatacaaagcaggagccttgaagaagggcatggaacatatctatacccaacagtgcgattttgttgccattttcgatgcagatttccaacctgaatctgatttccttctaaaaacaataccatttcttgtgcataacccaaagattggtctggttcagacacgttgggagtttggtaagcaagtattttcattgtttcattccaaccttgtgagggtagtcaaattaaataggggtgcttcagttgttggtctgatagtccgatttatgtttctgttgaattggtcactcaactgttatatgtactgtttgtctactaaactctcagatcatgttcatcaagtagactgaactatgaagagcttatagcactaaatgaaaatgaaaggaagtttattggaaaaaagggcacatccaatgttgcaccgttttaagttattaaaagtaaatttggtcgggtcccagaaaacccataatttggatatagatgttacgcttctgacccaatttgtccaagtttccaatgggtaatgtggtgtcatttggttattttaagtgagattttttgttcattctgattacaggctgttctgccctggcctttgctgggcaattttgcagtgaactatgatgtttgccttatgacaaggatacaaaagatgtcactggactatcatttcaaagtagagcaggaatcaggctcatctatgcactcattctttgggttcaacggtaagatccaatatcagaactacttacatgaacttttcatgcctggtcctaacatcgctgatctgcctacaggtactgctggtgtgtggcgggtatcagctattaacgaagcaggaggttggaaggatcgcacaactgtggaagacatggacttggctgtacgggcaagcctcaagggatggcaattcctgtatgttggtgatataagggtatgtctttgtgaggattgtatatgttgatcctttgataagcatatatgaatattttaccctgttttaataatgaatcttgatcaggttaagagtgaactcccaagtaccttcaaagcctaccgacatcagcagcatagatggacttgtggtgctgccaacctcttcagaaaaatggcaacggaaattgccaaaaacaaggcaagccttcttcaatgacagaatggaacatgttacgggattgtcatgcaataatttctttacccggttatatgtgattcagggcgtatctgtatggaaaaaacttcatctactctacagctttttcttcgtaaggagggtcgtcgctcccatcctgaccttcctgttctactgtgttgtgattccgctgtctgtcatggtccctgaagtcagcattcctgtctgggggatggtctacattcccactgccattaccatcatgaacgccatcagaaatcctgggtaagaatgaattctccctgcagagaacgtctatcaatctgcccatcaattttccaagattacagattttatctaatatataccaggtccatccatctgatgcctttttggattctattcgagaatgtcatggccatgcaccggatgcgtgcagctctaaccggcttgctcgagaccatgaatgtcaatcagtgggtggttactgaaaaggttggtgatcatgtgaaggacaagcttgaagtccctcttcttgaaccattgaagccaacagactgcgtcgagaggtaaaaaaaaaattacttacgatcatataccagttaccctctgatatcagagcagtgaaaaactgaaaatccatgcctgaaattacatgtctgtctgatttttcacccttgcaggatttacattcctgagcttatggtcgcgttctacctcctggtatgcgcgtcttacgatttggtgctcggggccaagcactactacctgtacatctacctccaggcatttgctttcattgctctgggattcggtttcgctgggacatctaccccctgttcatagcacagcaatacatcatcttcacttccaaacgatccattcttccccaattcatgattgcatcctgtaactacaagcaattcttttgtaaatgaaaaacaggacaagctctcaccacaaaaatctcacctgtaaacattccagtttttaccattgttgtatgcattttctacagcccctgcagtgcaggtgagcttgatgtgtagatctgaggtatgggcctggaccagagcccatcaggcctaatcacaggtcatgtgaacttgtgaagctcgtatctatgcataatgcaaagaacccatcacccatctatggctagtttctttacacatcgctgtcttccaactgaacagaagcaaactaagctggaagaccaggcaagaactcccaaaccttttgctttcatgccagagagaaaaaatctaactccagttgttggtctatatacgcttggattggatttctctattctttttcttttcttttctttttgcggtttcgatttctatactttgttagttagatcgcagctgtctacttgttacaatcgccacttgttcttgcgatgctaacttttctgcagaggctttcgtctttccacagatgcctgtgatgtaagtgaccctctcgttcttttccttagccattcttttctcttgtgtcttgtcccacgagagcacaagaaaatgggagaaaaaggccgaccagttggggcctggacgtgaccttcctttgtcacggcttgtgaggtacagtgccactgacaagtagctcaatctaaaagtcatcttttattttgttgcacgtatcatcgatacgaaacactcattcatcctctgtttcttacacgtgtattgggcctgtgtgaaattttgccagttaggataatcttttgtattaaggcacctccaatcgatcttggaagtttgctacttccaaaaatctcggctttggtaccaaaagttccccgtcaacgcttgacacgtaggaatcaaaatatgagacaatcccacgtatgctaactgaccgaccaaactaagtttatctcttttttgtcccaaaataatgtatacatatacgtctctatacgcactcacatgcttacccccacctatacctatatgaacacatcgagagagactagaccgtcacctagttattaaccactgaaaaaaaatagatgtgaaatacgagcaaccatcatctcgtgcttcgatgagcaatttccatcacaagaaacctaattgattaagatacgtttagttcgaaccaagagcctgtttatgattgataacattttcaaccataacattatttggtaaaattaataattatgtagtcacgtttagtttattaccaaattttggcaatatgtatataattttggcaatattataagccaatcatatcaaaattttgccaatgttgccaatttccaacatcaagtttttgatactttctctttggtgcatttttttatggaggaactttgacgcaatttatgaagagcatatatatatgagtaggttaacatctaccttcttaggcgcacacgcttcacagtattaacaaaagatatatggttgattttacatgtaagattcactaataagacaaataaatatgtagccgttgcaatactgtctaacagaaagagaaagggacatatttttcatgaaatatatgtactgggattatagaaatttcacaggaatacaacaggttcatataatcagtgaaacagaataatggcttactttcaatagaaacacaacttttaactttgaaaattccgctttcacctgacagctttcagttaaaattaaaaagataggcacctaaagtctatttatcctgaaaatgaggtgcgggcatgactatatatgacgcgctagccattgttaacatgcatggcataggtaaccgtgggcatggctaataatgtaagtgtgataaggtgcaatggtaagtatgaaaccaaaggtgcactaattccatcatgtaaacgtatgcaatctaatttccaaaggaaaaacattacgaccaaaattttctagccaatgaccaacatgaactactaatgaaattaactgaccttccttccaagcagcagcattttttaagtttgaacacaggaattgacaaagcgaaaactagcacctgggttgccaacagaataaaaacttttcacccatcacatcgaatatttggacacatacataaagtattaaatatgaaaaaaaaaccaattacacagtttgcgggtaaaatgcgagacgaatcttttaagcctaattacgccatgatttgataatgtgatgcttcagtaaacatttgctaatgacggattaattaggcttaataaattcatctcgcaattttctggtggaatatataatttgttttgttattggactacgtttaatactttaaatgtgtgtttgtaaatccgatgtgataacaaacctaaaaatttttcccaactaaacaaggcctatgttaagtatagctattctcaaaaggtatttcgaaatgggcacagcaagagggaactatcaaaatgcactttacaagttaaccaaacaagcgtatacaacaaaaacaacgcacacgagcggttcacacaagagcacgtatagcggcacaaagataaatccaggaagactaagcctaactcagcagagtcagattgtactacaccactcaatttaagtaaacttcggtcaattttctgttcttaatttttgctactaaacagaaaaacaataaaagggtagggtgcttattggagggtttaatatttcgttttcagcattctgtatcggggggtgccgagatacggaaatttcaatccaaaagtatttgaattttctaaccaaatttggttgaatttaaacaaaatattgccaaattcaccaaaaatgaaaaagtttaaaaattccagcccaaataatatcatatgggggttcctacagagccgaaattttaaaccctggtttactgtacgatagccctgatctcataacggagatactccctcgttctatattataagtctgtgttcggcagcctgtgttcccaacacatatccctcgtgttccgcgcgcatgcttttcagactgctaaacggtgtgtttttttttaaaaaaaaagtttctatacgaaagctgttttaaaacatcatattaatctatttttcaaaaaaaaaactaatacttaattaatcacgtgctaatgaactgctatgttttacaggcgcaagagatttatcccaactcttaggaatgtcttatctaaaaagacattcctaagttgttttaggtttgtcttacctaaaaagatttataacatgtgagtacataacggagggagtaaatttgcttttgatctttttttccccttaaaggattataaatattagcccattatttcctgtaattagtcataccttgggtttaaatgataaagttaggataaataaagcctgacctgaaaatattagcccattatttccagtaattagtcataccttgggtttaaatgataaagttaggataaataaagcctgacctggagattaacagaaagctgagttggagcagactgtcacccactctggcatccacaggagatgtttggcagcttgttgtacagttgaagtggaaaatagtacgctataactggaatatgttcggtagccacgaaaattagcttattactaaactgaacagttagcatgaaaagacatactagactttcgttagctaaaaagtgcaatcatcccaggatggagctacatatatagacatcaggataacaagtctccacggtccatgcatcccaacatgcatgtttgtctgaagtatacttcagtattgaacttaacatcgaacatttaggatgtattaatagctccagtagcaggtaaactttcacctgaaacaaagaatctctgtctgatactaataattagcctaactaggattaatgagaactcagtatagtcagtgcaacaataacaatcaagttgcaaatattgacaaccacatcacgatcaaattgtccttcccctgaaggcacaaatcaaagcctgaatacacgcaaagaatgaaaagaaaccagctgagataatgccactgcaagctgaaagacattaccaacagtccaacactgtcattttctttgtctgccagcctgaggagagggagctacaccgtcttcagacactcagagccacataataaaagatggacgaattttagcaaacctccgtcctactatcgttttgaatttttgtttgtaacgtctaactattcgtcttattcaaaatattatgaaattattacttttttttacttactttattattaaaagtattttaagtatgacttatcttttttatatttggactaattctttaaataagataaatagttaaacgttgtaagtaaaaa

SEQ ID NO: 28307 - DNA, 686 bp, Oryza sativa
attttctaataagccaaataagccattttgggccaaatgggcaaccgatgagagccttcttatctcgatttagaggatgaattgatcccattatccaaaaaaaaaaagcttcacaagtatatatctccctccgtctcgtatcctaaaataactatgttttgggatggaggaagtatatccgtacacaaggcttaagcttcatgttcagtaaactgatcagtgcaagaaaacttcagaaagtgtgacatacattagtgccactggtgtgcacaaggaagaagaaatgatttgctactgttggagaagacctaagatctcaccatgatggcctgagctacttgtagaagtagaagtatactaaagcctttatgacctttgcattggccatctagtcggtctagtaataaaggtttggccatggtcggtgggcaaaggcaagtgcttgcacatcctgcatcattgttagatttactcctgttgtcagatggacatgcatcccctctcactccccatgatcatcatcacatcagatgatcagatcggattcagagctagcccaatcttcagggagacctgatatggccaagctagtcaaacagccaaagcatagtactccctccatccacaaatataaggatttcgttcacaagaacaatatttttttggtcatgcacgtcgattgccct

SEQ ID NO: 28308 - DNA, 710 bp, Oryza sativa
  unsure (1)..(710): unsure at all n locations
nnnnnnnnnnnnnnnnnnnnnnnnnnnnnnncacggcaaggagaagaagcatcaccaccgccacgtcgacggcaagcaaaagccccgcacggtcgacgagctctgagctagccgccggcgtacggacaccgattagcccatgtcaacatagcacttttcagtgatgtttttcagtgtgtttgctgtagctctccacacgatgccgttttctgtatgctgttgcattttgtacaataatgtgatctttctgtagagaacttgtttgtattctgtagagaacttgtttgaaacaagttactgtgtttttcccactgaaacttcactcaaaactgaatcttttgctgttttccacggaaacctcactcgaaactgaatctttgatacaacactggtacagattgctacaagcattggaccttttcaaatctaattgaaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28309 - DNA, 49934 bp, Oryza sativa
  unsure (1)..(49934): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattaggaggcggcaactggtggtggcggatccagcgatgtgaaattgtcgaggctaggagactcaccaccaccaacttggggaagagtatagggagggggttacatgtgtcattgaccccttctggtcaaccggcgaggccgggaggcatcgtgtggaggtgcatgagctcacaactcactaattggggtgacgtagggagtgacgagaggggagaggaagggttagggctaaaggcacggtccataattatcaatatttgttaggtgttttatgtaaataccctaaagttaaatgtctcattgaaggggatagtcattttcaaagatcattctccaaactaaacatattgaaaaacgggtttgcccaaacctgacccatctagcccctcaaaccaaacatatacttaaaaaggttgggtcaacacatcatgagattgatgaaatcactatatatatctcacggataatgtaacatatcaccaacatgaaataaaaattaattttgaccaacaatacacggagaaatccattcacattctacaaagcatttcttgtcactcaaatatatctatacttatcttagtaaaagatatgctaccatcatcccaactaccatacaaggcccacaaaaagtgagggaaggctttacatttttcctatatatccacacaatctaagatcctacatgcacatgaaaaatatgttagtcgacccttattataaaatttttcatcactccatgacatattagacaatagaaataacttcttttagaggctttaaaaacatatagaatgaactttttttttaaaaaaaaaagaagatccattgcaacaccacgggcattaggcattacgctagttgattaaaatttctaaaaaaatattatgttatatatcattgctctatgaaaatggaagactatatttgaatatttgatctacacgtttagaaagaacataaatctgggactatgaataaggtacatactttttaaaccaagttaatctgattttgggacaaataatttgtgggacagcatatactaagagaagccaatgcatatggtcaaagttattaaatactagagagatcatgtcaatcaattacgtactccctccatcttagattagtgtgctccttttaaactagagaagtatatttattttaggacgaaggagtctaatttcacccatatgttaaaatcaatttcttatggtctagcccgatgtaagtccgaaacataacatatgtgctcgtattttcttatgactttatctttgaactcttgccaggacgtgtcaacgtgggtgtgtagcgggcgtaaaagtgtggtacgtgcatgtgcactttttttaaaaaaaatgaagatggatgaagtaaatgtcagttaattacatttcagcgcatatccttctttgatttggtttgatatactttgggagttagggcacggtacgactcagagaaaggtgcttaaattgctacttgatatgttaatattaatttagaaacaagaataagttctagcatgatctgagatggatttgcatgcatcatattcagtgggcttaatctatcatgcctgcagcatctctgcatggtgcttgatcatcagtaattactaattattatcaacaattcgatatattggaatctgttttttattatatggaatgtactcccggacagaccacaaatgttgggcctagatttattgacactatatttattcagtgttgattcacactaaatttcgcactagcactataataataatacaataagaatatactgtatatatgggctaccgattgatcggtcattaatttagtgcttccaaattaaaatgcatgcgttctgtcctggatatctatctctagcaaagtagattagtagagtagcaaagcatatgcatatgcatgattttgcctcagctaggcttccgaccagacatgacttaaccatgacctaaccgcacgaaatattctacacatgcacgaattaagctccctgacttttttatatgccattcctagctgctgctactagctactccctccatcccaaaatataagcatttttagctatgaatctggacaaatgtaagcaggtacttccttcatctccaaaatataggccagttcccaaaaaaaattcccaaaaacatcacattaaatcttttaacatatgcatggagcattaaatatagattaaaaaactaattacacagtaaggtgggaaatcacgagacgaatcttttgagcctaattaatccataattagccataaatgctacagtaacccacatgtgctaatgatggattaattaagctcaaaatattcgtcttgcggtttccaggtgagttatgaaattagttcattcattcgtgtctgaaaatcccttccaacatccagtcaaacatcctacgtgacaccaaaaattttcttttcgcgaactaaactagcccatagtaatttttagcatttaaattctattttaaaaatatagttatttcgttacctaacatcttatctcaaccaattacaactatggctgatataaatttttcagctatttactctttttaatcaatcacgttatttcttatttagtctcacgtagtttcttagtacctatgttttgctttaaaaatacttatattttagcactgaggaagtagtagccacactggcatccacgccttgatcttttttagataatggaaatggattacatttccggcttctgtcataagacacacagccataagtttaatagtaataaaaaggtaatataaaagtaaatcaaaatgagaaataaggtgatgggacaaatccccaactcctctttattattgactagcgttaaaccacgtaaaatattttagctagcaattcttatggaactacgccacccatagtggaataagagatccttggctaccgattccaagagtgtagcaccattgcgcatagtatcctgctcctcctgtggtagcattgtagaccaaaagtggagccagtaggaagacatgaagataacctgcatagggttagataattgtttaccattaaaaactttatcattgcgacaatgccaaattgaccaacatacagcactagctccaattagaatcatcttcttaatggacctagttacccctctaagccaattaccgaaaatgtttttggcattacggggtgggggatattaaaagcaaaaagcacacatctccaaacaaactgagcgacatgacactcaaagaaaagatgttggattgtctcttgtgcatagcagaaagaacaatgtttgtctccccccattttcttttagccaggttatcttttgttagaattactttcttgtgaagaaaccacataaagaccttgatctttagtggaattttcaagtcccacagaattctctttttgatccgaacattacagttcatgatcgcggcatacatagatttgatggaaaattgaccattcttatggagcgaccatacaaagcagtccttttcatttgacagagttatattagctagcatgaggatcaaatcgttccactcgattagcttttggccaacaatagctcttctaaaagagatatttagcggcgttgtgctcatgacctctgcacagtagactgcttctttcgagccacattatataatgtagggtattgatctttgaaagcacgtgatcccaaccacgtgtcttcccaaaatcttatgtttgtcccattgccacatctaaaagaaccaaacctaagaaattggtctttgactttcattaaaccggcccagaactgagaaatacctatcttgctggacataccacaaagaggtttaccctttaagtatttatttcgcaaaaagtcttgccataggccttcaccattaaacaactggaaaagccatttgcttaataagcagctattttttatatcaaggttatggacacctaggtccaccttgatcttttggtcgacatatgttttcccacttagttagtctatattttcttttacggtcatcattactccaaaaaaaacatgacctaaagtaatccagtctttgaagcacacctcgtggaatttcaaagaaggataacataaacaagggaaggctcaaaagaactgagtttagaagggccaatctcccaccatatgacatgtttttgcctttccatgtgctgagtttcctctcaaatctatcttcaactcctttccaatcaacattccggagtttctgataatgaataggaataccaagatatctaaacgggaaagatccagaattacaaccaaatagttatctatattgatcctccacttccttggctttcccaaaacaaaaaatctcacttttatgaaagtttattttcagccctgagagctgttcgaacacacataggatggctttcatatttttggcctgttcaaggtcatgatctagaaaaattactgtatcatcagcatattgtagaatggacaaaccatcgtccactaaatatggaatgactcctctaatttgaccatcgcctttagctctctcaatgagaaccgctaacatatcaaccacaatattgaaaaatataggcgacattggatccccttgttgcaggcctttgtgcgtttgaaaattattacccaaatcatcattgacttttatacggacacttcctccttcaaccattttagaaatccaatgacaccattgctgagaaaatcccttcatgcgtagtgtttattagagaaattgccatttgactttatcataagccttttcaaaatcaattttgaaaataaccccatccacgccttgatctatcaaagtatcgatcgatccacagtgcttgattaattgaccgatgaatgcaaagacagccgtggcccgtacttgattaattgagctatacctatatgatagtgagcacagtgtaaattaagatgcttaaaatttacggcaaaaaaaaactatatgtactgcaggtacacacgcatggatactggatagatcactgccctgtacgactcgattggaatctgtattatctgcatggatgcaaattaagtcaaataatcgttcgctgctacgaatagtactagtagctaggtagcaattaaaaggtttcatgcctgcgatgcaccgtgactatattgtcttttgcaaccgatccatcgatctgatcgtgagttgaatacatatgcaaagtcatgtggttttgtcaccgactttttcatattcgttttacagagacctctcatgatcttacattcttaaaattccaaaattgcgtcgcagtggtcagctggtaattaagaacaataccgcatgtacaattgcaagatctgtcaaatgaaccaaacacacgtcgcaattaagtcctagattcaaatactattcgatagcgggggcagcgaatgaagatgggtctcttcaattgtgggagctttagatagatgcaatgcactgttcggtgacagacagactgacagagagtgatggtgcagcgcatacaatcttgtgtcaactgaattgaattggaatggatcgaatcgaattttgcaaggcacagattaggccctgtttagttcccaaaacaaaattttttacgttgtcacattaaatatttagacacatgcatggagtattaaatgtaggaaaaaaaaaccaattacatagattacatgcaaattacgagacgaatcttttaagcataattacactatgatttgacaatatggtgctacagtaaacatttgctaatgacagattaattaggcttaataaattcatctcgcggtttcttggcggaatctgtaatttattttgttattgaactacatttaatattttaaatgtgtgtccgtatatttaatgtaacaaccaaatccaaaaattttccccaaataaacaaggccttaatatcaattatcactgctatgttatcaggcagacagagagacaggctttaatattattattgatgggcaacaagttgagcaagttgtgtttatgctgtcggtcggacccatttcaaccaaagtgatgcatgtttgatagatatggaaagcagcccgttttggctatgtcaagtgtcccaaagatttgcttacttaatttcaccaatcatgcattcatgcatgcaccttcgtcatcgatccaagcattgtcctgccctgtcctgcaatctcgaagaccttgcttgttggggcatcaaaatcatctccccgtactcgaaaacacagcaaaatcaacagtcaccttatccaaacatttgtcctaacagtgatatagtacaaaaaagaaatacagaacaaactacaggtagacattttacctacctgcagtgcaggctgcatttgggttgggtgtcatatggtttgaaggaaggctgagctgacacaacccaggagcccatatatacaaatgtagttcttctggttcagcacccagaaaccacctactatgtgatacagtacgtacttttacaaccgaagcacatgcctttgccttccaaaagaaagttttgcaacttcaatcagtagcaaaaagatctgatgtaatcccttctgcagcacaccaacatgaacagctaagtttccgtttgccaatgcaaagggtacatactctttcttacccatataacttggcaaaatagtagcaagatctaatcatcctagttttcgttgcgctgaagctgctgagctccagcataagtaactccactgttactgccagctgcttgttgggacggcagggaaagaagcagaccttgctgtggtagctgagctccattattcaagtgaactaaattaactggtgggggtcggcccagcaatcctcgactaagctgaggagccactggcaactgaagcgataaactgtagccaaaaccagaagggataataacaaaaggtggcgttggcttgtgcgcacactgagtactagccttagcctgggtgggatgtcgatgtacaacctgaggagcttcagcagttgtagaattagcatgctggtctgatcctactaggtgcacagcatgctttccctttccgagcccatatctgctatctgggctcgtttgtggcttgcgttttctcttgccacgcttcaaacgaggtttactgactagctcatctggtttaaggcatccaaacagaagggtctttagctttgatgtatctagtttacccctcatgaaatctaacaagttcaaagcacaatctcgaagacatctgcaaatcttctgcatctcctttttcccaactgacctagcaaaattttgtgaccggtccaagaaatcttcaacctacatgaacaggagtaaaggaaaattcttgttgagggcataatacttaattcaaaacaaatcttacatttaaattgccaattcctttcttccaggtcttagagatccatgatgcttcaaagttgctagcgcatagcccatgctcccataagctctccgctgataatagctggagaacaaaaggccaactttgtgacttattagcgaccataataaactatcacacaatggtaattaaggtggtacaattttaaaacaagttcaagctaatacaagtgaccaaataattgtacacacaaaaatgttaattgcaatattggggaaaaaacgttgaaattaatagtgtgcaatgtatttttccgtgtaatgaaaatagctaaaagccccaaaagcacaaacaaacaaatacatcctgctagaacgggtacattatgagaatttctggacgagtattatcttgtttgggcttgcctaacccaaagttcttaaagaaaatgatacaaggagaatctgagttcaaaaggaacctaggcacagtaatgaacatttaaatgagtcaacaaatcacattattaataaggaaagtaacttaaacataaaagctatataaaagttatatcccaaaggaactcactttactgatcaacgatacaaacagttcagctacagtttctttatttgttctcccaaaccccttaaatgccaacgtattcctctcaacactttcaaaatctgaaccatctgcaaggaatctcatcatcagctcagagtgactcagttgctgccagcacatgaaaaaaaacaaagataaaaaattatttcaaaaaccttttaataaggcagataacgggggtaatattggaggatcccgggtctgcgctgcacattgcaccaatggtaagaagattcaacttatacttattcatataaaaaaggaaaagaagtattaaatgccaaatgtttgttttcttaagcatagatctagtgagttactagtaaaacacccagtttcataaagttcgatgcaacaaactccaaaacgaatgtgtaaaaagacttcatctgttcaattgaaattcaacataaacccctggcatcattccttgatattataaggatatgaaaaactttttagtgaaaatcctctttgtttgctagacatattgattcaaatccaatagttgaaacaaaatatgggaaaacaactaatcatcatataatagtcaaacagtgcattgtgaaatcctctgtacctgcaaatggaaagcaactaatgaaactattgacatggagctcagcgttcgctctctcgggctattcacatcatgtatcttagcccagaacttcaccttcaaacacaaaagaaaaaagaacattgttatcaccttgcatttgtatagtatatctttttttctcgggggaggggattacattaccaggtaacttagtatctgaaaccttggatcaagtgaagaaatgaacttaaagatcattgatcttgtcatgccatctttattttcaaccgtaatatcacactcaatcccagttccccgatcaataacattcacaataggcaccctagcagttacaacaggcagaaccccacagaaaattccattccctgaaaatgtgagtatattactgcagttggagatagatgggcttagaaagatgcataattatagcgggctatttttatgctttctctatttgaaaaaagaaaaaaaaaagtggccaggatggtccattagtgaagtatatcagtcggcacacccagtgactttgtaaagctccaattttcagataagctgatttgaactaattatcctatgattacttttgcagtgcgcttttttcacttttatgagatttagtagcaactgaggcttagtacatataaaccatctgcaatgttgtcagttttgatatcctttttttatccctgtatgagctatcgttgcaattggaagtaagatcagaaaaccaagtggcatgtcacaggaaacggggtcgaaggaagcattccttgacaccggggaatgccgtccccatcctggaaacgtgggtgcattttcattcccaccttataaaaacctctcacaagtagcataccacgttcctcgatcccatcgacctgggaactttgtgactcatgcaaaggagcctaatgataaaaattggtggacacacaaagtactagtgaatatttagagatactgtgctctaggcagtaattactttgatgagaatatagaactttggtgaacttcctaatagcagaaatttttttcttgcgagcatactgatcgtcagtattagcagtaaaattgacagagaggtccaggtcacttctaggggtaaataaatccattgtaaatgatccaaatgcctccacgactggaaacccattattgttacctgaaatgatttgttaaagaggatggccaatcagcatgctagagacaatgtttagcaactaatcaaactatcactttataaagagttgttttacagtcattgggaggtattgacagatatggaggcatattctagatttctagtggtaaacagtggccaagtagtgaagtagagtattgtgaagaacattagtataggatagtagatgaacattggtattagaaacgattacaggggtatgcaataagcagatgagtaaggaaatgaaagaaaaatgatgcctcttagcataccgaagatttggtttgctatgttgttgaagacatgaaccaaggtagtccgttgctcgtaatcaagtggttttgggcgcagcatagtatacacctgaagaagcaaattatcgagaataggaagaagagtgcgattgactgacagggctgccaactcctccgactcgagacattcggcatgcgcgcgtaacactgaagagaaacaggaaatcgaaattaaaaggagagctagcgcaaaatgcatggaagatgaatgggagcagcagctagtagcctagtaccgtaccttggggatcccatgcgcttacctcactgtcactggacctaggtggagcaccaacaatcaaatcaaagaggaaaacatatgagatccagtggagtatgatattcccagccccagcgagcgggaaggaataatacaggattggattggagtagaggacgccaactaactgtgtgctttcggaggaagatgatggcatggagaagaccgccggcggagatggtggcggggatcgagtagtgtcctctcctgtcatgtgggtcctacaagtcagtctcgctcactgctggaatactgactactcgcgcaactactcctgtcaactcctccgacgccccgccgcgctccccaacttgtcgcccccgcccccgcagaggaccggcggatgagcagggatcccgtaccacccgactaggccgctgggtgacgagcgacgagggatgacgggtggttgaggaatgggcgttgctaccaccgccgcccccgccggtgcgctgtccctggccgccgccgccgccgccgtccgtgcgtggccgccggtggactgggtggggtgggaaatgaaatgaggataacatgggctttttagactcgcgatatactagtagttattattagtctaatatacatcctccggggatccacgggtcaaccgcccccgatcctactcatgaccgggaaatcaacacgcacccggcaccccccggcctctttcctactgattaaatttaactgttagtagtacagtatttgataatcacgctgattagcgttaatccttagggttcttcctactacaaaacatgacagacagacagacagacaaccgtcgtcaatctagcaatctcatataccaattagagcaaggataataataatatagcacacttcctacttcctactattagcctatcttaaagctaacatatataataaattagctataagattgtctacaatttttttctcctctctctaggtatttatcttggagattgtgttaagttagctcttgcatgagagccaacctttacatctctcatccacactagctaattaaatcgtgcattcgcgcgaccatgacatgtccttttatgtattaaaattagaactaaatattgggatgtggatttttatttctcgagggaatatcctccactcattgcttgaaacatatcacttccaacaaattcgatttatacatatggccataaaatatgttgtatttacgaagggctaatttgagttgtttcagctttaatatacgtgcgtagatgccacatcaaactggttaattagctggtgaaaacagcggttttctttatcgttagttggaagaaaaaaaatcagcagtaatgcaggaggctgctacttttttccttggagatggccagcaggattgttgccacgtgtctgtgtttattgctctgtgttgggaaccagagaaacgatcacactcttctagatcattctcttgcctcttagcttttgatcaatccaagccatccctccttaatccaatgactaatataatattgtatacgtggctcaatggcagagggaataaacattctacgttcatatgatgatgatgatgataagcttataataggcttatagttcactgttatactttctcttaacgtgatcactccagtttcattcaacaagcgaggtctatgcgtattgtctgcatcaaaattacatgacaatgtgcaggtaggcgcatgcggccagcattttatgttgtactagacaggaacattagttccctcttactgtatcccatcaatcagtttgttcaaatgatcagttgtgaaatgaattagtagctgcctccggtaatcccagttcccaaacaaaacactttctgccaccccaaaaccatatattacaccaaggcagacaagcagggccccaatctaacaaaacaatggaactcatcagagacaagagacacacaagacaacacaggcatagggcatagctaaaattgaatataatcatacatccactaacacctacaagctctaagtaggaaaaagaaaagaaaaaaacatttcttcttctttatcttcctttctctctgtatctacatgatgaagtatgctcggatcacctcaattatgggtgcacggcacagcgggcatttccctccgcttcgaaccaactcattcgcgcattttgaacatgtgcacatgtgcccacatctgatagaaagtcaacaccccaacccccaacaaagaggcaaaacaaaccatcattagtactgttatactgtattagagaagaacaaactacatggacctattattcattatttcagaagaaaagcatgagttcaaacctgtacaaaagagagtcaatcggagtatcacagcatatacagcacgtcccttttctcacatggatccattttgatccatcgtctatagtttctttactttcacctgagataccaaatacaaagcttaggtacaagtctgagccaatgcgacaagcatctaagcatcaggcgttacaaaactgcatatgatgaaagtttattgtataccaaatttatcgttccatgatagatccaaactacctagctagataacaacttaggtcaaaattaacatagcttgaccgcacatctcccaggacttgacatgttattgactggaaggagtataatagcattcgttcttgaggaaccttattatcttagctaagtgacaatttgaattgtaaggcgcgcctcgcaaccttgacagtgtaagcactatgacgaagaaacaacatccacgtatcatataaatatactatgcatcaaagtgatacaccaagggataatcaaagattaatttcaatgctaaattttgttttgttagtgttgttaatagatgagtactttccagatgagttactaaccttgctccccgatgaagcgattcaaggctgcagaaacttcctgccttacagatcgctgtaactcgagctgcatgtccatacaagcttccaacattctttgcatatgactcatgccctgctgaagcctagccatatcagcccttaagtcattaatagcctcccattcctgcaaatacaaaccaaaagaaaatgagcctttaacaacaaatatagaagcaacagtgcactatgcatggaggatagagaggctgaatgtggcaacctaattttaaaaaaaagtgcaagtctcaattaaaaatggcatgttggcttggccattcagaaaaaaagaaattgtgcacttggaacgaactgaggaagatgaaaagctcacacatgtgacaagaataacataggtaataacttacaatatcagagcgatgtatgttttgtctgatccagttattacgatgcaactccgaatgccaaagtggctggcgaggaggtataggcggaggtggaatcactaagggaggcctaacaacattatcatgaagctcctgttcctcttcatctctatgctgctcctggctttgctcgggtgagtcaggcgcaggaggtgctccttccaaatcccaagagagaggagcacgaccttgcctttcaacatatgaccggataagtcggtccaaattttcacgaaaagcactatgaagaagattagaaacactccttctgcagaatgaacactaattcagtatttacgctgagaactaaagaaatatgttgcagagactttcttcatgaaagaaataaaaaaacctgcttaggagttcccttagttctgtactgtacacattatcatcatcagctgggacaaacgtattagctcttctaataagagcagaatcatgatcaattggttgatcagagttgtcatcatgccaattatctgcagtatcattggactcatcatcatcatgccactcttcatttactccttggaaatgatcatcgctgtgccactcgttgtgtacttctgtaggaataaatggattactgccctcattccactctccacgagattgttgaagatcactgtcatgcagctcttcattctcctcgggaagatggctattgtcctgctgttctccatgagattgaggaggaagattgtcactagctaactcatcatgtgattctggaatatgtgcatcttgaccaccttcaacttcggtaccctcatgagatgaaccattgtacgtattttcatgccaatttatttcagattcctctccagtaatagcatgggaaaattgttcccaatctcttctctcttgttccaaatcatcctgccaactctctgcttgactatgaggttcatacaggccttcagcaatactaggagtattgcttccagattcagatactgtcgctgtaccttcaatttgctgaagaccaatattcagccttgtccgttgatgtctctcgagattatattcagaagaagaagggcttgattcagtatggccatttatagagagctcaacattttgagctgaagaatcatcggattggctaactgcatgacccctgacgacgttctccaatctgaagcggaactcttctctagttattaaaaataataagtattgttattatattttatatcccacaaaacttaatgtatacaagtaaattatatccataagttggtttcaagatgatgtgctcaacaaaaaccatatgctctaatatccatatccagttgacaaggtcataattactcattagttgttcagatatagtctagaagctctaattgtacattaacataggtaatctgagaaaagatgcaacgtaaataagcaacatatagcaatggcggcatgaatagaaagaatgaagaggtctcataagaggtaacacatgcaaccaccgagcagctaaggatatactgacaatgaccttgtaggccaataatcacatgcattccagaagagaagtggaagacaagcagcagcagtagtgcagtagcaaaaagaaacacgcgaaggcagtgatagtatagcacaatggagtatgtatgtagtgggtagagagagacctcaaaccagagacagaatgacgctgtcgtagctggccgagctcggtggcggcggtggatggtggccttctgtcgtcgtcaccattgcgcagaaacctcccccggagtagtgcctggtaggggaatccgtagattagattagataggggcaaggcaaatggggtcaacaaacaatagaactaatggtatgggggattgttatcagggtacgtggattcggttgcggtgggggaagtcggacacagcgcggtggtgggagaggcggtggagctcggcgtgtcggacggcggccatgcgcatgacgagctcgaggcgagcctggcggccgcggatccggaggcgggcgtggtcggggggctgggtcgtcgtctcggtcgtggtctctggaggccatgtacatgtggagcgagatctgggcggggccggggtcttaggtccagcgtcagacggcgcatctgacggcgaaggcggagtcggggtcgagggagccctcgcggctggatccgtcccagtcccagtcgctgtcgctttggcgccgggtcatgaggcgtgcgtcggcggaaggtcgaccatcgtcggccgaggaggcgaggaggcatgggttcaggattcacaactcctccatttatgagtcttcctgacactgctggagacgacgaccaccacaatggattggatttggatacaccaacaacaacaacaagaagccgatgccctccggctccgacgaggagagtccactccaacccctagctaagcctaagcaaaggagtcccctctcccctcccctcccacccaaagcctctcgcctccgctccctccgattgctgtttttccgccctttcacttctttctgttttttttccctttgtaaataataataataaataaataagcaagacaaatattctggagggaaacaacattccaaatgcatcacattcatcatcattattgttattaacaattatatttgataataatccagaaacacttgtattatacaaagtgaacttattcttaaatattattattgatttatttgtgaaaagtccatgagatgcacatcatgcgcagcgtgcacgatcataaagtctaagagagtgcgatgattttgttcatggaataaatcctttgtacaaatctagagcttgtcaaacaacgacgactactagatagtatttcacaccgcatgataaattttactttggatcatcttttattgtcggtctagttatgtggcatttttgatcaacctcaactcttatctatttacatctaactttgtcatatgtcaagaaaaaaaatctacatacagttaggggagtttgttgacgtgttggaccactctcaattcttttatccatttaaatcgcaaacttatcatatgtcaaaaaaaactacatacacagaagcaagcgtacccaaggccattcgtatgcttgagaggagatacgagatggtccaaactaaaacaaaacacacaagatgattaaagaatagtttaaagcgatacatcggtgataaaaaaaggtggctcaaagtaaaaataactcttaatctaattaactactcaaaataacataatgactctttgcttttaacactatttggaatattgggggatttgggatacacccccaaacatctttatagactatactcccttcgtcctcaaataaaatttgaatgagatgttatctaatacaatgaatctagatatatctcgatctagattcgttgtactagataatatctcatataatttttggttattttattttagaacgaagggagtacgtttactactaaaatattctccaaaatgttttttttaaaagaacagtgctcatactctatcgaataatcataagttatttttaaagaataatactcatcacaatgcgcattaacattgcttctctgcaatgcgcagagagggagagacggtaaataatcatgcttttctggaaaaaaaatgtaaagaaatgttatcattataactaacacggtttcagtgtacagcatcacaaaatacttctcctacctactatcactaaaaaacccatttttgttgctggatggcaacatagcaccatctgatcttggtagacgcaatattattcttactccctacttttatttcacatgcagagatttgagcttttcttaagagtagcgtgcaaattaaacatattccttctgttttttttatgaactaaggctgcgttctttcaggggagatagaggagaaggnnnctcgtgttccgcacgcacgcttttcaaactactaaacggtgcgttttttacaaaaaatggctatataaaagttactttaaaaagtcatattaatctatttttaaaatttaaaatagttaatactcaattaatcatgcgctaatggctcacctcgttttgcgtatcttcccaatcttctctatctcctcctcaaacacagcctaactaacgtaatacattttgggatgtaggagatattgtttcaaccagaagtttaaaccatttatctgtatttttttatgtagacaagtagtatatctcctcctcaaacacagcctaactaacgtaatacattttgggatgtaggagatattgtttcaaccagaagtttaaaccatttatctgtatttttttatgtagacaagtagtagtagctccatactgaaactgttactcaatcagctcgtcagaaaccaaccaaaaaactataattcagtagtttttgctagcaacagtaacaagaagcataggatgattcagcacaagcatagatagtcatgcgatacgatcccgcaggatatgcaaaataacaggagcagcatcacaaattaacaaaaaaaaaagcttaatctcccaaaatgctctcataatacacgagtttggcagtagctctagctccttcctcgagcaagcaaggtagctggttcactagtggatcaatatttcaaaacaaaagaagatgttaagcaagttgggcaggagcttgttcagcgacaagcttactgcaaagactgacacttcttggtgcagatgctttcaggcagcgtaaggtaattcactggctccaagtttcagttcacagactaatccattgcaactcttcagtttgctcttcattgttttcagtgtcccaaccgtcaaacgcagctatatttctcttgctaaaatgaaggttttcaatcagctatatctctctgtctaaacgagagcttttcttctcgtaccacaataagacatcagcaaaatcagctatactttttgtgcgtataagagcatctacagctcattcaagaactttctctccagttgagaagacattccacaccactgtccctactatgtacaataccacagccacctgaaacacactatcccaagaacctggcagtccaaaaaagaaagttaagacgtaagagaaagttagcataaacacacattgatacatattccacaagaatgaacatgaaattcattattaaaatatggtctgtcctgtttgacatttctaaagataccatgtttttcaacatccctacctttttaagaatgtagccagtggcagcagtaccaaaaactcctgcaagcacgccagcagtgtttgacagtccaagaagtacaccctacatttttttgtaacattgtatcgttagctgatggatcaaagttaaaaagaagcaacttaacatcaatacagctagcagtaacactataatttctattgtgaactagggaattttggagcagtaacaatctatgtgagagcattactgcataacgtgggcctatgtcctggtgattcgaatatagcccagactgtgaaaaggcatcactcccctgccaaagaaattggatatcaagatcaacaagcattaaaagacaatagtcaatagatggttcagaagctaaatccatatgaatagcctttcagaagaatatcaaacctgactgcatgccatacacaatacagccatggctggagttcggactttgctcagcagtgtcaagaagagggctggtccaaggaaaccaatcgattgcatgatctacaaaatacatttcaaaagtatgtcaaaaccaaaagctcagcagtcagcacagctattcccagaagttcatacaggaaacagctattactgaagaatttaccttacgaacattcgttatggaaacccccctcccaacaagagtgtcagcaatccagccaccaatattcgcaaatatagccattgtcagccacggcaagacacacaaaagcccagattcagtaagattgaacttaagaacctggataagagcacctggtgagtacaaccaccaagaacaggatatgctaccattgtctgatatgggcagtgggtattaaattgtaagaacctggttgtagtatgtaggcatccatgttagaagaatgaaggttccccaattatggcaaaaatgtgatactattagagcccatactggaggctttgatagaattagcttccaaggtatggaggtgacgggctccttcaaggtgcttccacctagaatgtacctcttttcggctttgcttagttcgggatcttcactcggggagctgtgtgcctaattaagggtagacatgcactaccagttagcccttttttcaggggtaacggcaattagtcatgtaagaattaacaagaatgagcatctaagaaccaaatagtacggtcatttccagagttacttatgtggttaacataataaatgaaatgacttcaaaagcaaatttttaggttggaagctagtacatgaattgatttatcttacttttctttgccaaagtgcaaaccagacgcttccaagggacccgaatgcgtaaaaaacagatggccaaccgaatctgctgatcaagagaggtgaaaaggctaggccagtcactgaaccaaggtacattccactgtacactaatgcaagagatctgcttctctctgaaactggaacccatttggagagtatgttgttcatggctggcatggcaacaccctgttaaaccataatataacaaaattaatcacataaaggaaaggaaaagcatcagtgtaaaaactttgtttttttttatactcaatgaaagcaaactgagtggtactggcatttttcaccgagatacttgatgaccagttacttcaaaagcttaactttgcttaatttggaggagtatgacaggtgtttttgtgacagacaattgctccaagttagacagaatttccaccctcacatttgcttgcatttcattaaacctaatctagaggaaccattgtccggactattacgagaagtgtgtttatacaaacattccacttgatggtagtggcagtttgaattatagtagagagaggcacagatatctacctctcctatccccatgaaagcccgcatgacaagtaggaaaggaagtccaatctttgcagcaaggggtgtaagaactgtcgcaattgaccaccagacaaccccaaatcctagcaccaccttaccaccaaacctgtcggcccatatacctccaaggatctgcagtttagtatgaaatattagtcctcacaaaggacagattcaaatgtgagagaaactgacgcataaaaatccctggcttacaacagtaatgcacctgagtaagaaggtaaccccaaaagaaggaggactggattaggcctacagttgctggactccagccgaattctgatgacattggaaggatcgcgatactcatattaacctggcagaaggcagtaaagaaaacaggaggagagttataattaatgaccttacataaaaagaaaagaaaagaaaaaagaggtaattcaactgttgttatgaggtatatttggagaaaggaaagggcaactcacacggtccatgttgcacagaaggaaggaaaagaagcacaagagaacgactgtccatcgcttagggaactgctgccaccagggagaaatctcatttgtatctccaatgagaactgcctcggcgggaacatcagaagggctcaacggtgatcccgttatctcatactgctcggctttacagtcggcgcgtgttctgaccggaattttgtagtctggctggacacaagcagtgtccaaactagtgaagttgtcccatcttcttggttttagccaaccagtgtttattggatccgaagtgagaaagcattcaatccgccgcctcttgaggtttgcattgtaaaaccacctggtgaggtagtttgtagaagagtcaaccacaggctggtggaatcgggcagaaagttgaaatctttccattgaagtgctcctggaatagttagagacttggaaaatggtggtcctagtagtgagtcgactgaatttatctcgggtgggaggtgaggaacaggtgcacttgttgttttgtggtggatgctgctttcctgtaaaacccaaagggaagaatcaggttgacatttcgtgtaaatggccatggccggccctgcccttgattatagtcaacctgattacactgactagctagttagttatgatgttgggtatatataggcagttgatgaataaattggtcagtaatgttacaagcaattgaaggcagtaagcgtgtcatgttatacatagttatagggaatgagagagaaatgaatggagtcccgtaatagctagcagtgaatagtactactagtgtagaaaagaagttagtaatagtattacggacctgaggaggagagtggagaggcgaaggttctgctggagagcacggcccccatagccatggcctccgcctggtcagagcacaagaggatctctctctctcactcactcactcagctctgggggagctgctcccctctcgtgttgcataggaaggatcttgcttggcccctggagcctggaggaggagattgggggggaagacgatgagacgagaggaggacgtgtggtgtggataagcaagcaaaagtagagtagcctctcccttcttctcctcctctctctcctgttatttcgatttcttttttttctcccttttattgcaggatatagagatggctgtttctgttgggattctttccgactgaacaaaaacaaaaagcagagcgcgaaaatgaccttaactgaatgaaaagtaacacactagacacgtctcctgttgtgatgtccacatccccatctgctcttggacggaaggcgtgcttttctccacgtacgcacccaccccgccactccatagccgtccgatcgtctccactgccatgtggcccctggttaattggtcccaacccaaagtaggagtatcttgcatttgcatctccactcagattcagcagcgggaaccggaacaaaaacaagcaaggcaatgggtactacggaggaggaggaagattcgcatatgcttattactcactactagtatcatgttggtttgatgtacgtacgcacgcacaccagatggtagctgccatagttaagttaccacaatttactttacaggcactctctcaaacttcaacattacatagtatctctcattcagttcatgaatcaggtcaggtcaggtcaggtgatgagctcgatgctgtactcccacagcctcttggccagctccatgtcattgcctttctcactcgcctcgttcacattgctgtcactgaagtacttcccggacacacccttcacctgtgggtgcaatgcaacataacaagtggtggccgccccctgttcatttacaccacaaactcaccatcaccaacatattacattcaccatgaatttgatgcaccacccagctcccccctctagcccgccctatctagatcgtcaactaaattgcagataatgataagcacaatctggccatcatgcaatgctctctactcttaacctcaggattaatctgccatttcctatatctcacaaaatccaaacaaaaactggtgtactactaccataccagctagagaacattttgaaatgctcagttatcttgcattttgctttttctttagcacggctagatgtctgtaatagctgattcattgttccacccattgtcatgtaaagagtttttgtgtaatagcttttctgtaagggccaaaactagcatctccaacaaatagtgtatccattaaaacaaccagttgcatacaactgatttctatgaaagatttgctaaccattggcataaccacatataaagcgtagaatggagagaaggcccagaatattaaaaaaggtgcacaaccatacctgctgagcatttttaagcaccaatttaccaagtgtccgatggagaactgcatataacaaatataatattcatgagatcagttattacaacagaaaacaagctcttttaaccatgaaaaatctagttttaacccaccactgcagtcaagtaaaagcactagtatttcgtttcacagtatgtggttattttcttccttttggttgctatccttggtccttgctgctattttctttatggtgtggtaagtccataggtggcatgaattttcaagagattttgttttgttacatgtttcagttcaattattttgagttcatgagtgaaagatccctttagcttacaaaagcaggaatactaaatatctcctagagttcaattcaagtatattttaccatctaggatactgtggtgacgaagaaggttcgtgatgatagatccaggatgaagagaatttgcagttatgttgacaccctcatcctgttaaaccaatgatgatagtcaatacaaaacaaaactatgggacatgtacaaatttaaaatttatttcagaaaagtacaactattttatcaaaatatcggtttactgcaactttagttagacatttcaggaaactgcaacaacagtcaacagttgatggctttggcgtaaaactgcacctttatttgcctgacgagtatgggcccacctgtcaggtgaacattaaaaaatcatacagctacaggtcgggcccacatgtcagtcatatagtgggttaaagttacagtttatggttgaaatcatttgctatagtttgtagctttgtcaaatgcctaactaaaattgcagcgatgtgatagttttaacgaaatagttgtagttttatgaaatttactcaattcaaaatggacaacacctgaaataaagacaacgttcagttggccaatacctgacacgatgtgtttatctatcatgggtgtagatttcttactaaacagtgcaacagacagctagctggtgcaatttttagagtttagcagcaaattactagagatagaattcattgctggtgcttgtggaacaacgctcctgttggattacacgctaataaacatatctcaattgaaataactccaaatacagcgttgcaccaaaaaaaatatatctataactggcgacatgatctaagagaagagcaatgcgcaccttaaatctcctagcaagttcattcgcatgcaaaatgtttgcaagctttgactgcccatatgctccaatggagttgtacctgtacaacacaagattgaaccatatattagtacagtacaattcctttgaaggaagttaacaaggaaaagaaaaacaaagtgcataaaagttgcatactccgactcgtcatttatcttggcaaagcggatgccttcccgatatgcaaacctgtgcccctctgatgaaacattaacgattcttccttccacatttgattcacgagaggtctttttcattgtctccaagagaagatgagtcaaaagaaaatgacctgaaaattatgacaggagatacacattttaacgcaatgatacacagctctctccagcatgtttgagagaaaaagggacacattttaactcattggtatccgtaactatcataatgaattagaacattgaggaacaggtgaagtagaaaattgctatggactgttgaaataaatttgactaattagaaggatgcaaagtcttccttacttcttaaagaatatggctggaaaaacatttgcaacactacgtagtagttaatgagaagcttttaaatcagtgtaaccggtgcatgaagttcataccaacatggttagtggcaaattgcaactcgataccatcctttgagagagagaaaggagttgccatcacccctgcattgttgctgcaaacaaaaccaccaaccaatcaggaagtgtgatgagctataaaagaagcattctaataactacgcaaccaaacaagcatgaaacacagacacttgtcggtagtactaaatgtgatttttagggtattcataggaaggagctgtactatcatagtagtataattaacggcagcaagatataaatgaagatatccagtggctgcagaaaaattttgagcaccaaatgtaataaaacacaaacacatgcacaagtcatgccattgttcctggagttataccatttcatggttaaaacaagaaaccatacatttaacatgccctccctgatttttgcgctagaaaagagtaaagaaaagcataggaagagcttgttgtgaccttcagctagtaagattgtttacaataaaaacatggaaatcgtagctaacatgatagaagaaagtgttgtttacagtaaaaataggtccatgcggccgtagtagaagtaatatagcagtaggctagtcatatgtatccagcatgcaactagtactactcctacttgagaaagcaaaaaggaagttgtagtccctctgagagctgaatcataattccatgaaaatggcttccacccactcctggaattggagtatgtcttagcgtggggtagagatgcaggattgaatgtgtagagtatgatgttgcattgtccaaaaaaacaaggtgcaactgaggtagtatagtactagtagctgaatttagtgaaagcagcagtgagtagtgaatgcagtgcaggtaggtaggatactgctggtcctaactgaaaaatgagggaatttgtacttggcattgaaagaggagtactagtacatgaggatattgagggggaggcccttggcggcgaagtcggaggcgaaggcgcggacggagtccatggaggcgaggtcgagctccatgaggtcgagggaggcggcaggggcgtcggcgaggatggcgtcgcgcacgggctgcgcggcggcgaggttgcggacggccatgacgacgtgtgccccgcggatggcgaggacgcgagccgtctcggcgccgatgccgctggaggcgccggtgacgatggcggtgaggccggcggcggaaagcccggcggtgacttggtcggcggtggaggcccacgagaagcccgagggcccactccgccggaacaaccaagaagacatcatcaatctttctctccgccgcgcaaccgcaagatgtgtgggtgggacaacgcagtcgctgttgcctcgtcctagtactgtctaccctagtcagtggactactcgtcacaagtcagcatcatcaccatcagcagccagactattgattttattatagaggacgtgcggattggatgagaaaatagttatggcacgcgagattttattacagaggacatacggattggatgagaaaatagtccagacacaaattttagggtaaaaaagtcaagatatgcgaatttgatgctaaaaaagtggcatacgaacaaattttatggtaaaaaaagtcaagatatgagaatttgatgctaaaaaagtggcatacgaagaatttgatggtaaattctctaaattctccacaaggagagcatccatccatcatcaattgacgaaccagaaccaaaaatgaaaaaaaaaacattgctcttgaattgctattcttcagtcatcgtcgatcaaacgaaacaaaatacgccttacaataaaaacataagaaacggagggagcagtaaataccccatttactcctgatatgatatgatggagtatattacaattacatacatgcaacccaaaaccaaaaccaaaaccagcacaacattcactaatcttgtccatgtttgcaacgaatccaatgttaacgcacgcaccggctgtcatatcatataactataactgtatatataaacaaataaattcaatgttcatgaaccccggctgtcatctactccaaaccaaattaaaatgcagcttaattccctgctcgtctaacaaaaagccatcacttcatttcctacggagtagtgcccacacgccaggaacccccctctgccaacttcactagttctagtaactccgattggttgatgatgcagactcaacccttgctacttcgccggctcaacaggatcccacgttacttgcttcagccttcagggcacaggacaagcttcacatgatctgcgtttattgcttccttccatcctacaaaaacagtacatgaccatgattccagctaaacaaggagatgtacttataagtttgatcaaccttttatacggtatgcgagtggataaacagtagtaatggaaaaaaagaaagggtgaccatcagcaccaattggaaaaagaagtggaacagccactagcaattaacaaatataaaaatgcgcaacaaccaccagcaattgaaagagtgcaagaaccagaaagataattactttgagaaaggaaggcagctgcttctttactggaaaagatggcgcctcgtaagcctccaccctctgccaaccctgcattgcagcagcttgaacaattgtttccatctgtcataacgccggatgaagaatgatcctgtgctgttggagtaatactaacttcaacatcattatgagcattgtatccgtttccctcttctccatggttaaatggctgcatcaccttcgttacaggatggttgccaatattcaattgagaagcaggagtcgggtattccttggaatattggttatcctccaagcattcgctgccgtcttcaatggcaacacttatggatcctattaatacacgagacttcttgttcagaacaatctcttgcccatcatctatattcaactcatcttttgggctgtgctcttcaatctcagttcgcactttccatgtccatgttttgtttctatttgacactgcaccggcatttgcacccctgtaatgtgaatgccttactgaagctggatgctttgaaccaattgcagaaccaccagaggcaaagctattttgggcaaagttttctgttcttcctacacgatgtcttgaaaagacttgttgattcaaagtaacacttggattcacttcatggcctggatcatgaatgtcatgttctacaggtaggtcagcaaaactactattatcttccgaagccactggcgttggcaactgtgtatcttcttgctcataaaggccaggatccgaagtggcttccttcagacttagtattccagaagaatctgttgtcccatccacagatccaggaaaacggtctgtgacatcctcatccttcaagtctttcaatctctgttctttctgcctcagtttcttcatccgtttcctttctatcagttcagcttgccttcaagatacagatgatgatgttgaattaaatgattttgcattgatacaaacaataagctggtaaatagtgctttccagcttttagaaattgcaatcatccatggtattaagcactaaccttttctgagcagcttcctcttcctccacgagcaacttctggcatcttaatgcttcagcagccttatcagcagaccatgcttcgacctgatgttttatgtacagccactataaaaactgaatgtaaatgcatatcatattttgcaaattgtagtgaaatcttaccagtgtttgttcaagcatataactagtgcatgcaacagcatttttcaactcaggtgcaactttgtcagcctccccgttaaatataaacttttgtatacaggcggttgggttagtagagagaaacgtattctcacttgcttcgtcaagcatgctaaatagttcattcgatgatacaggtaaccttgaagctgttgtttcaattaggtcctatagcgggtaaaatgaagcttagatatgagactaataataggtttatatggtagagcaggataatttaggtcaaaaaccttaccagaagttgattgccagctctggcatatggcagcggtaatgaagcataccccggcttacacatccatgtggacagtgctgctaaaatggaaggaccagtgacaccctgaaaatgtattcacattccaactttagatcactgtttatgatcaacacactgatccagagacattattgcacatattttctggagttacctctatatccacatctgccaaggacaaaattgttttggcctgatccaacgtaagctgaagagcgtgacaaataaattcaatgctatgagaaacagttaaagtccagcgcatgattaattattatgtcatctatataaggagttgttactcaacatgcatgcatatggactagtatagatgcacatgcacttcatggtgtcaagataacaaaaacagaaactagacagtgaaaaatgcatgctggcggtagagtattcttcacgtgaaaagtacggaagcatttaatagtcaacaaagcttcaatcagtgaaaacattactcaatttaataaataatattgcgattgaacttaatagaggaagatggtgatgttatgatgggcatttcattcaagaataacttactttgtcccagaatgcagcaatattgtctctgttcttcaggaaatcctacagaacatcgacaaatgtcactgcttgcaatgaatgactgaatggtaacagggaatagcttaaatactagaaacgaagtttaatatagtatttagttgtactgacaagtccatgtacatataatcattttgtatgaacaccttttctatccgaatcccccgataaatgtaatcttagccaaaacaaaaaagggaagagataaaagaggaaccttttcaatttggagagttcggcggtgaacacgggtatggcgcctgtagttgattgaggagcaaaattccctgggacacttggtacacttttgcaactgaagcttaggaggcgaaaacaatggccatccaggaagatctgcgacaggggaggacctaacgttgggcattgctgaacccgaagaaattgccactgttagcaatatacacgcaatctgtcaaaggaagaaatcgagaagaaaccaatccaaatccgtatgtgttgttgaggaggaaggaaggagaagggggggatttcgggagaggaatgaatgaatataccttggattggattggacccgaaaataaaagtcgccgccgccggcgcagaagaaagggaaggaaaggaaaggaaagggaggatcgatcggaaattcggtttgcagatgggatgggtacagaacagtaccctagaaccaaccaaccccaaatgaaccgcaagggcttcttggtcaattctcccttctctcaattgaattgaaattataataatttctcagtaggaaccacattttcttttaaaaatattgtatatatctttgtttttttaaaaagctaggtttgtttcagtttaaaattattataatttagttttttgagctagattactataagctactcccttcgtccaaaaaaaaaaggcaaaccctagctattttttggacggagggagtagattataataagatgtgagctgtttttatttctatagattattggatgcatggaggctaatgtctataatactctcatctattttggatatcttgtgtaactgtatataacaagtatataatatgaagtagctaaaaaatatattaataaataaaacattcatgaatatttttatttgtataataggctgaacacgaaatattatctcttagcaaataaagcatcaataatactatcccgaaggagctggatttgcgcgcagctagggagggaggacacgaatgtgtgcatgatcggagaagaaagggaatgcacactcggctagggaaagagccatctccataatcgggaaaggaagggaatgcgcgctggactagggaaggaagggaatgtgcgctcggacagggaaagaggtatctcgatctgtttggttctcgcagtggtgggtaatttacgtaaagtttttaggggtaatgggtcttttgtcacccaataatctataaaaaaaacacctttagaggagattatcatattataccaatatagcttatattttataataatctatctggtttgttttagattactccaaataatttaaatcattataatcctaagctaaatcaaacatggcctaaatttaaactttcaagtttcggtcaaagctaattagttgtacgagtgcgttaaaattatattgacatttttaaatgttttcacttagggcctcatcttttcgtttatgcttatgtttatcagttaaaatttgaatttttaaccttaaatttggagctgattttgaggttttttcatcaaatattatttttcagcctttacttttagatcgctaagaacacatatataaaagttttattcacaaattacttttcatttgcaaatatgtcgttcctcttattctgtgaataagcgaaacgatggctccgtcaatgttactactagctattaaaaaaatatttattaaaagagtaatatgtaatagttttaaatcaaaatatgtgttctaaaaccttataaatatttaagttatgatattttgttgcatgctaagtatggtagtacaatttccatccttcaaagcataatgatcttttttttaaataaaataaatcaaagttggaaaataaaagcactggtcaacagtgacaggtaaataggagcatattgatgcatacattgatacatatggcaatcttgaagatgaaaaattggagcaaccattataatgctaaaataattacattgacagtagtacaaaacaggttatttgacactttgactgttgactaccgtagaccccctatccttatgtacatgcacaggcaacatgcatactgaaaagtagctagctactcctagtttttcttaaaagaaaaaagaaaaagaaaaagaaaaaaatacgcctatactgtaggagtagtaattactatcgacggctaggttgcatgaatagaaatagaagtccatttccgagatttagatggtgaatttgccatgcggagcataatgtcaagcgacctccactcagcgtcgcacgtgattgccggtcgccgcttcctctccaggctgcagcagcgcagcgccaggcggagcagcttctcggcctgcacctccggccagctcccggcggaggcgtccagcacggagtggacggcgtccatcttgagggcctcgcgcacctggtcggcgatgttgaggtcgagcagtccggtgagcacctggaggacgacgacgccgaaggcgtagacgtcggactcggcggtgagctcgccggtgacgaagaagacggggtccatgtagccggtggtgcccatggggttggtgcggcggcagatggtgtccgcctggtcctgcagcggcttgacgtgcaccgcgcgcgccgtgccgaagtcgccgaggcggctggagttggcggcgtcgaggaggatgttggtgagcttgaggtcggcgtggatgatggcgtgggggcggcaggaatggaggtaggccagcgcggaacgctgctcgccgaggatcctcacgcgatccttccatgacagactcttggagttggagaggatgtccaagagggtgccattgggcaggtgctcgtacaccagcccgcatgactccgggcacacgcccatgagcctcactatgtgtggatgctccattctactcagcaccacaacctgcaatcatcccatgcattctatataatacaactgcttccttcttcagtaaactaactacttaatgttaatgacataggaggaggagtatatatatatttacctcctgcttgtactctggaaatccttgcctgccatggggtctcagcagcttgatggccactgccacgccacccagttttcccttgtacactggcccatagcctccttcacctatcaggtttcctgagcagaagttgcccgttgctttactgatcatcgacatggagaaccgtgagatatgttgtggaagttgcagctctgggtatcttcctgttgatagcctcttctccttcttcagtgaagcagcagcagccttttgcctaggtgacaagatgctcctatcatcctcttcttgcagctctttcagtttcctttggagtttgtctatttcttcctgccaacaacaatgtgaagcattcatcacatatacaaacttctccaagaaatcaataaataaattcaaatgattctgtgtttttatgtccatgcttagataggccctgctgtttctgatttcataactggaatataagctagagaaatgaagcatatatgcaacttttaccatcagttcttcagctctttcagttgtacttctaaaactctgtatctcatcagttctatgagcagtctctccggaagagtgctccccctcctcctcataagaatttagttcccctgtttctatgctttcctcatcctttgtttcggtttcctgcacatcacactacagaaagcaaatcagctcttctctttatttatgaacactgcagctttcacaaatcacaagttgtaacaccacaacatttttaccaaatatagttactgtgaaaaccaaccttattacacgcagtgtgaacctaaattatcaatctttcctgttgtgtgggcaaacttgaaaaaacatgcataagttttcaccactagcgctcatgctctaataattatcttatgggtttcatctatccattatctaaaaaaatgttgtaataattgtcttgaaagtaaaattaaggaaaatagccataccgttgccaattcatcagcaccatccatttgaataaccccatcatcatacatgatttcatctgcctaaagtgaaacatattcgagaatacatcagaaattagtattcgaaatctgaaccaagatcatagactgcatgcatttgtttagtgctttgctaggaagccgcttacaaaatcacttggtggtgttgtgtagccatttgaatcatcgctcagctcatgtacagatgccaaagattcagcgctccctccatatccaatgctcccggtatgttccagatgatcattgctgcattttagaatgatctcatccatgaacttgttgctagatttgatccaatattgctgcaggtgttgattatagattttggagaatatctcaaactatacctagtacacatgtgttttccattgataaccacccaaacctgacagcatttgcgcagcatcgcttcctttgacatgctcctgcataataccctggtttagcatgcgcatggagtaatatatgccaatagagaaatggatctcttttgaaagaaggaatggaaattcaaaatgtagaatttgggatcttaccttgaaccaatgataattctcttaattttgagcttctttatcagattcacaacaccagcaagaacatcatcgtgtgaaaggtaatgtgccctaacctgtacggacagcctgcttagataacatgatttctttttcttttcttttttttggccaaatagtaactatcccaccacacttatattttattggttcaactgtcaatatcgttgaagtcaattattcaccatatggtaggaagctcattcattgcatatttggggttcaaatagtagacctaaggcaaaattctagtatttacaactagaactcatttccacgcttttttaggaaggactgcagaaaacattcttatgtactccatagtagtttatgaatttgctatatgcttacaaataagaaaccctgaaaatctcatagaattaatatctgatttatacttgtcagatgagtgggatgcttaaataagcactgcttaatcggactcacatgattcaaactaagaaccgaaggataattagtatcacctttcttgatccacaaaggtttttgtattgtgacaacatcttgaccatcgcatccgtttctttggctcgatgcatctccttctccttttcatctgcaaacttatatagaactttgccacccactgcagttgttggaaaggagcaaagtattgttcatacagcacatgacaatcaggacacgctatgctgttagtttttacgttcatcaagaaaaactattttatggcaatttattatacttccatttcgcagaataacaagagtgtatgaaagccagcgttttacacatgggaaatcacaagtaataggaattaggcatcttccttttactctactgataggaagactaggatgcacataaactaagatggtcatgaatattaaatcaacaaatcatcttttatcgggtacaagatcacctatcgtactgtcaacaaatttccccccttttttaggattgaatggtgtagcgctttctttttaacacagttgaaagataaattgcattggcttatggaaataaatttgtctgaagaagtatgaagatcttactgaagggcatccacttggaaggccagtgaacatgaacaagaactatagtggcccttgggaaccttgcagcagcccataagatgttagccttctcctttctgaagttcttcccaaccgcaatatgaatctcttcctcatccatcttttcttgccctcttctacatcaggaactaaaatcaaattgtggttctgatcttgtcaatatatctggttcagcagcagaagcaagcaaggcttgaaaggaagaaggtaagagtatatctgaacttgatccagaagaaagggaagctaaagtaccttattgtggtgcaccacttttcatcaacttcacttcatggtggtatctgtatcaataccatcaacttcatggtattcttaaaactagaaagtatcagttgaaagaagggccaaaggtggggagagacagccgggggttttaaagcttgtttaccatggtctgaggtttcaacagcttgatggtatccagcagcagtatcaggctgtgggtcccaaaatgcaatccaatcaggaaattataccacttccaacttggcagtattgttttgccctctcagtattcagtagccactaactcctgctgcatacttggtttgcgaaacggcaggttcatttagatcatcaactgcaaatgattttacaagttgcataggagagactgtaatctcatcaatgtttctattcaatttgaatttttaagctaaaatcatcatttttacaaatcttttgtaattaatggcttgtctgtttgttcatcagatagaaacaagaacgaatggtattgttccagctgagggttccgagttttccaagaaatttctgtccaagacgctgtcgtacatgtttgtccttgatcgacgactgactttggaagattagcagtgaagtcttgtatatatctccccggccggtcggcaatataatgcagctaaacacgttattttcaagttgcagaagaattgattagtcgtcattggattggatgcaagctttgaattctggtgtgcatttgctgaatacctgaatggttattcgacatttggccctcatccttctctttccctggacgttgctttcacagaattcttgctccccaggctgtcaatatagtaatgcaaatgaagacatgtcattaaagcgatatgaacagcatataccagaatcattctttctttctaccactgaacaaatcaagtgcatgcgttaagattgaggtttgcattgtaatctccacatcaaggaggcgcagtttcttccagatttctgacttcagaagatcccagttgattcatcacacattattcttactgtaactctttaagcagcaatttggtccgacattgcacctttttataatttttcggcgaattgcatatgcaaggaactttgacaaatttaagcactggacgcatatttcaaaaagaaggttttgtcctactcgatgactttgtgtcatcagcatacctaaccagctagcttttgcacaattcaaactttcaggttagacatcgtggcacaggaaacagtatataatcagaatggttacaacacgtaagcatgataacattataaatggtgaaattctgatctgatagttctattcatacatgtatttccacttccatacactctagctgagcatttttttggctattgctcagatatcacaactctctactacactgacaaagtgacaagtgactacctgtacaatgtctaccatgctactgatggagcagagatagctccgaatttattatattttttacatacaggttttgctaaaaaaaagaaaagaaaagaacaaccgtgtgtatacctttaattagtcattccttcagaacaaaaaaagacacaagacgtttggtttcctgtggtttctgcttattaaccctggtctgagatgtatcttcagaagatatatgacataattttcattgttactttccatgatgagaatccaaacatattaatctgcatttgactgaagccattcttgaattgcagaacggagggcatggttcggcaaaagatcacggtgtggtagatcgaggtttgtcatgggtgatgtatagtgaccactatcaaaccactctcttatagcctctgcttcgtaggtgaaaccatctgcagcaattaaagggtccctcatgacatcctgcaatgcataaaatgcacaggtgaaccaagggagaagaaaactgattatctttccttaggtaacacacaaaaaatttggtgtgtcattgcatcagggttgagaaacacacatacaaacagtagtttacaatggtcatttcattagtaacaagaactgagagctcccataacttgaagttcacagagatgtttgcagaactgatatctcaactgctgtccaggcaaacaattgactgactttctctaaaattactaagaatcatactaaatggaaacagaagctcaggagtaatttggagttaatcaaataacatcaggaatcataaatggaagcagaagcgcaagaggaatttaaatccaatcaaatgtcaccctttgatttctcttattgtatacaaaaaatatttcatctagttatcctttagagactagtatattaaaaaaaatagaaatggatatcattacatagacggaccaattaccaaacatgagagtctgaaggaaatcatggtgaggaaatacttttgagagaagggggagtaataatcactaagtaaagtatatatgactaacctgttgtattggacagatgaagtaggatggcacattaccaaagtcttcagatactgatttaaatgataatgaacatagcatagaggaagcagacctcaacattggttcaagtactgtccaaacctctgtttgcaggtcaggacggttttttcttctgatttcacagcatcttaggcctacccgagacaactgctcagcatgcataagaggccagtctccagctgatgaatccaatattgcttgcaagcaaccctttgctactgcccgttgcacatctttcaaaagaccaaatcctgatcttccagtcaagagtcgcaggagtatgataccaaaagaatatacatcagataggggtgtcagatcaccagaaatagcgtattcaggatcaatgtacacaaaagttccttttgggtgggtatggcggtatagagtggttgtggccttgaattcatcagttaacattcggcacacaccaaaaccactaagcttagccacattatttccatcaagaagaatgttagatgctttcaagtcactgtgaacaatgctgtggggtttattggaatggagaaaaatcagtgcagaacaaatattggaagcgatgcgggtacgcaactgccaactaagaggctttgaattgtccttgcaagccaagcggtcatctaagcttccattgggcatgtattcatagacaagagctcgggcatccttgcatgcccctataagagttacaagattcggatgtcgcaccctgctaaggatttccacctgtaaattatcagcaagaacaacttaactgtctgaaatacaacagtttatttggaccaacaaaatgtcaatcaagtttatagaaggtaagtatataactagaacaaaaacttttacctcatgactgaactgtgacagtgactctgtgctttcaggattcaacttctttacagccacatttgtttgccgaagaagtcccttatatacacttccataaacactttccccaaccttcgatgagtgatcaaagttgctggttgcctccttaatctctgatatcgatagctctgtaatgggaattgttctatccgcaattgcagtagactctccattttttacacgtattgcttctgcctctcttactgctttgtcacgctgcaacataagatccttgataatacggtcagaatgggcgcttcgcttctctaggaccaatatcttctcacattgctcttgaaattttgcagcaagttcatcagctgttcttgcaagcctgtcaacttcctccattgttgttgccaattttacctctatttcattcttttgcttcagttctccaaagtacaaattctctgatacctgcacctgttggtgatattaaatgtgagaccaaggattttgtttaaatctgtaggtatcacttatccaaaacatcatttccagatttatactccacgatatagagtataacaatcatgaaagttttttacatggacagtacgaagaatttctctgctctcattggcatgcagccatattatcattagaataaccattaagtatagcacacattatatgagagataaatataattaatctattcttactttctggagagcctcaaataactcctgctctgctttctcacgcctacatttctcctcataagcttcttgtcttactctctctaactgcatgggtatatgctggagctcattgtcagactcaccacgctctttagtatcttcctgcataagattgggtagcttattcatgcatcaaaatttgtgagagcactgccattaagatattagagagctcccaaaattcaaaggaaaactagataagatgatcaaaagtacaaactggtgagctattagacaaaatggcataccatgtaatgatcctctaacttatgtatgtatcaagcaaatgctccatcatggatccatttcaagtgaggatgcaatgtggacagatcaattagtgatcttaatcagatccaacatcgacgtaattgtgcttaccttttccttatcagagtatctgtctgaactagttgtctcgatatgtggttcgaggtttagtttgtgtagccatgtgtttgaaacacaccaaatctctgacaagctactcgatctctccactgaacattgtgcagaagtagcactttgcctacagtcctgcatcacatcatggccaaagggagcagccttcctagtgtagagaatacaaaggaagagaacatagtaaatgcaaatggatgcaggctggaaagtccgtaatgtaggaacaaagtgaagtgtatgatcagcttacaaccatacctacagtataccagtgtgcctttgcaaatgaaccatattttgcagaaatgatctgcatgctgttctacaactcgtgctttcctggatttcagaaccttcattttcctgaactcttgaaacaaggagttaggttttagagaattaatagggcaaagattactatttagattttagaacgtactgaagcagtacaaacactaagtttgcttcccagaaaaccaaggtgcaagcaattagtgttaacatttaattatcttgaagaatttatttagctaagtagacaaaaaccaacacttctcccaagcatggttccttactagcatccactgtgatcacagtgtttcatcatagttactactactacggataaaaatgcataaaagtattccaagctttggcacatgcgtactttgtatagtgcttatcatctgcggcccccattacaagcatggaaacattatgctcagagatgacgtccaccaatccgtatgcaacatcatctgattcaaccaccaatttctcagcttgtacctagagatgaatagcacagtgaagtatcaatcgagattacggatgacattttgcaacaaacaaaaccaatgaattgatacatccgtgttggcctttacatgtgaatacaactgaattttagttcaataaagtgggaaacaggcagaccttctgctgcgcgcatatgagttggtattgatccaagttgtcactgattctttgcaggttcatcttcttgtgtgcaatcagctcctgctctcgcagctggccggcgggaatcttggctccgactgcacacgacaatggatggaggttgcataagcatttgcagccatacacatacatggactgaaaactctaagaggaagccagagatgtaaacaaaatggaagccaaactcaatctgaatgaattgagttggcctcgattgtaaaaacgtagggggtaaaatggtgcattaaaaaaagagagagaaatgatttagtgtgtggggaaaaaggttgtaaatttggagtcattgagggaactggacaaagaaactagacgatctgtgccaatacaatcgtggtagatcggatcatcaatctagactctagtactagtgtaggtaggaggaagagggatgcgtacggatggggaggaagttgggaggggagtagacatggagcagcacgaaggcggtgccttgggggaacttgtgcagcgcccacagcagcgtgcccctgctggactcctcccccaccgccacgtacaccttctcgccggagaaggacggctccggcgaatcaccggggtacggagagggggagcccgccgtggccatggctttgttggcctcgcctcgccggcgccgctttggaatccttctttgtgttggactctcttcttgttgcctccctccctgcctgctctcactttaatactccactgctaatctcaaaatatataagcatttagatattgtcataagtcaaattatgaggacaataaacatcattagatgcattgtgaaatatatattttagtaattttatcttttttttatgtgatagtagatgctaatgttcttatttataaacttgataaacttagcatagtttaaccaagaacagactcgtaaatacttatattctactagaacggagagagtagcattctacaaatgttttggttatgttctggtgatttgaatagtaaatatcaagattcttatttcaaaccaaactatggacactaccaacatctaattctttttgccgggtgggccaaaggctggccgacaaattttcattaataatgaaagaaaatgacagtttagacatataaagtgtcatttccaatggagttcaagagtatttttaaatggtagtttctgcaaggtcccttttttcgctatattttgaatgacttcaatgcttgtgaaaatacaatatacatataagagagttgaattgaggttgaaaacagaaggcataggatttgtattgcagttgcggcagacttataggttgcaaatgcatttaccttctgaaattgaattagttatgacgatgtcatttctgcatttactaatttgtcaacaggacctatgttagcacaattgactacaggcacacgtctgctcggtgcattgccgttgacgcttaactgttaattggtgattggctcaattaagagtgcattgtctgagtatgttccataaaaatcaatttctaactataaatctagacatagcatatgttcaggtttacagtcatgaattagttttaaattttattggaacggatcttcccttctcttgtaccatgtcctttctttttatttttcaggcccattctgtaaatacatttatttctcttaataaaaaatacgtgtctcgcgtattcctaaaattttgttggaacggagggagggagtatgtgttaaatacgtatacaaccatctatctgtataaaatcgcactgtctaacgtactgttaatctagctactagctatcaggcttcacggtttgaatttcacctagtgatttaagattatcctgcaggaagcatataactacatttttcacacctgaccttgcacaattatcctgtaggagtaacttcctttatatagaacatagtacaatacaactaaccaagattattatgaaatgtgcaactactacaattgcgtacgtaaattacctcgtcaattacaacatatcacaagtctccgtaaacaatcaatgtatgaaaggaaagaagctttttaaaaaggttgaaattaaaggttgaaaatttccttgtccttaacactactaactgctactagtgtctatgtcgaccgcacttgctcactcacaaaaagcttaccgtcatctagtacaccagtatcaccttcatcgacgaccgactgaatgaactccaggtcgtaaagtgtgctccctccgtcccagaaaagttaaccaacaaatatatccagattcgttgtattacagtacagcccccgctaaccactgtcttctttctgaaatatgaaaccttatattggacgtctcgatctaattgatagtactagcttatatattttgtgatagaagaaatactgtaatagaagcatgcatgtgcatatcttcacttaatttatgaaagcaaatgaaatatctttgcttgaaattatctaagctatatatatataagagcatcctagtcatctactccctccgtagaaaaagccaacctataaggggatccctctagtactataaatttggacaaagagctgtccagattcattgtacttttaagattggattttttttttacggagggactatagtgataaggcttaacttgtcagttactcttgtgcaaaaagctaaaacgcgtggaaaaactaaacagaatgtcggtcactgatgagtcctttgctttgctggattccgattgaaacaatagctccgttcatggttgatttgaatctctagctagccacctcaatttctctgtattttcctttcttctacttttttttgataaagtgaggatggagcgatattaaatgatgctatgcagcatatttctattaaaaaaatccattttactctctcgaataattaaaatccctaaactttttttggctaattttgttcccgtaaactattaaaattgttcactttactacttgatactctatctatctcaaaacaaaattatttctgttccttcttgtttgtctaaaataaatttatttttgagcaattatttcactgaagtttgtgaaagtggaaccaaattcgttgggagtacataaagtgggtaacatcttaatatgattaatatcttaagctgattttttaagccatagataacactattatgaaaggtccaaaatatttcaagattatatcatgaacgcttgtttacacttcaaaatctcgaagtttatatcaataagtgtttccaacctactccatatgttcgacaaaaaaccaacataatactagatgaggcatttcctagtatatcgaatctagacatagcctgtccagattcgttgtgctagaaaatgtctcatccaatcttttttttttacggagggagtatgtaaaacaatgatatttttttaaaaaataatatcaggaggtaagtgcaattttaggagtgagaggggaaaaataagaggaagagaaaattacccaacacactctattagatgaggtggtagagagtaggatggtagttaaaggtaaaatagagaaaaaaaataaatgagatgtgattaatgtgataagtagtatgataggattgcacttattttgagataggattaaaatctaggccatgtttacttcccaaaaacttttcacaaaaacataacatcgaatctttggacacatgtatggagcattaaatatagataaaaagaaaaactaattacacaatttacatgaaacgagacaaatcttttgagcctaattagtccatgattagctataagtgttacagtaacccacatgtgctaatgacggcttaattaggctcaaaagatccgtctcgcggtttgcaggcgagttatgaaattagttttttcattcgtgtacgaaaacccctttcgacatccggtcaaacgtccgatgtgacaccaaaaattttcatttcaccaactaaacatgcccctaaaattgcacacttgtagatctagggatgaaaaattttgacatgtcaaattggatatacgaacacacatttgaagtattaaacgtagactaataacaaaataaattacatattccacctgtaaattgcgagacgaatttattaagcctaattaatctatcattagcaaatgtttactgtagcaccgaattatcaaatcatggcgcatttaggcttaaaagatttgtctcgcaatttacacgcaatctgtgtaattagttattttcttatatttaatactctatatatgtgtccaaacatttaatgtgaaatggcgaaaaaatttgctagaggatctaaaacaggcccttatgtagagagagagaaaagagatactttagacatgctagacaacgtgtttttctggcagatctacgcgtaaaatgagaaacatggttaacatgtggtgattgagtattaacttaaaaacttaaaaaatagatttatttgattttctttaaacgcaaattctatatcacaaccacgtaagtttagtagattgaaaaatgtgataacgaaaaaacaagaagtagctatggtcaaatagcactttagaacagaccccgaatatagttccggtattgaaatatagaatgaattgcgcatcttttctatcagcttaggcgcttttggactgtaaagaatgtataaacagttagtactactccaaatcgtgttccacatttctattttgcacatttgcaggcaggcgccgggttgatgagtccatcttgatttgccgctgcggcggcggcggttgcgagttgggacgaacaggccaggcggactgcagggcataggcatggccgcccgccccccggacccggagctcatcgaggtaagtttcggattgggagttcgtgcttgcttgctttattggcttaatttcgagcactatgctatgcaatgctatgcttggtcaactaccgatcgatgatcaattgcagcggctgctcaatttttttttttttgcctcttccggtcctcccccttctctattgtttgggtgccttgagctgttgcacgccacctgtttgtatgaatgccatgccctcgtgcttgaagattctgcaaccaaatgttgcattcgtgctaatattgcttcacatgtactgctcatcctacccatggatcgcaaggagagccttcatttttcaccaatatataattccactaaaaccatgactcagtcatgtagttgtggcgcttatttcgcctcattgaaaaagctgctcatgaggcttatcaactaaagctacggcgaattaatcatctttttgttgttaaactatctagggcctgcattccatgaaaattacctagggcagtaaactcatgcttcacatgtctctttcaaggttagaggtgctagagggatggagggttgttaaggaatacacaatcacatatcgagttaaattattgcacagactaagccaatatcaaatggatatacgcaatttggaggaaagtcatgaacaaataaaagtctgtaccttccccctttctggttgaataagcttaagtttttctttttctcaaacagtatgactccaagccaacagtgacctctccctttccttttttcctgtttgaaactagaacttcaatgctccagtgtttgtgaattatcatcagttttattttttgaaagtccggcagggggatcctatatctccgatgatcttcatccttgccatggattctctgaactcccttttcgtcaaagcggaagagttggggctcctccaaccattggggatcccccaccgggtctccctctacgccgacgatgtggtcgccttcgtcaagccgacagtcggtgagctgcagtaagggttgcaattgtgtcaaatccccgcctgctagccctcccaactttaaggcaggaattgcagagccagagatagaaagaatagggtcttcaattctcagcaaaggccttggtcagagatagcccgagctttggcggcggaagcgactctctggtggttggcacacgcggcgctgccggtgctaaccatttaggtcttgttctaggtcatcccctttctgttgccacgagaataggcttaagctagctgttgatcccttgtatcccgtcccccttctatttttcatttttggctcggtttgtacatacacttaatacaaagatgcgctccttgcgtattcccccaaaagaaaaaacataaggatgaggaaatcccatacaatatccctttcctaaaagcagcttatttgacagttcagggcagtcgagcaacaaccttttcatattagtgcagcatgttattcccttatcttcttcttgaagggcaggagaaatagaaagtgtaacaaaactatcatgccataccagtagttttaactgaaaaatcgcacatacattgttaatttctgaactgcccacactactataaactatccatgctcatggatttttactgcttaccatctgcactttttttttacgataataaccatctgaccttttgaatgatcgtgttgtagttttgcttccatgctgtaacgaacttctaactttgcaaaaggcagagataaaataggcatccattgacaggtggatctagtatccttttctgggtactacatcttcttggttaggttacgttgcaagtaagttcatcctaaacgtgtgagcctcctcaaatatgtacatcacttctatccatggactccaaaattttgagaaagtattagctgcttcagttaaaatgtaattccctacactatacaatttaaactattttcttaaactttagatacacgataaaatacaaaccaaataaaaggtcatagttgctgtttcatttgccactcttgaatggcaaaacgaagggcattattgggaatcagctcgtagtgtgtgaaactgaggtaggtcatgggggacgtcttatgccccctttgaagccagtcttttatagcctcaccttcatatgtgaatccatcagcagcaatatgtggatccttcatgatttcctgaaatattcaaaagatgctagattatttcaaattaaaagtaaaaacataaattcaggagaaggtgatgatgatactgataatagatttggcgaacgcgaagagttgttggtttggcataagccatcacacgatttgagtgcttaatttctttgatttgttatccatgttgaccatcaatagagtaatttctcatgtgctctatttgtgctggtgcttaatattgtttatgcaatagatatacagtggtagagatgctttgaaatttctattaatctactgtctcatgatgtaactgacctgtgtcattgggcagatgaaaaatgatggtatcttgcatttgttgtctggatagttcaccatggcttgtaaaacaccccaggcctccttggcaagatcagggcgctcctttctgtcataccggcaacatctcagtgctaggattgccaactttttactatactcaggtggccattcccctgcagaagcatcaactacctgttgcagcatttcattgttcagggctgcctctacctcactaggaaggcctagtggactcttgccagttagcaatcttagcagcactactccaaatgaatagacatcatactgtgctgtgagctcccctgaagcaatgtatcctggatccatgtatcccaatgtgcctttaatttggtttgtttggtggtaaggtgtgatggtggtgtttgtcagattcaacgaacgagatatcccaaagtcccctagcttgcctacaaagttgtctccaaggagaatattatcaggcttcagatcaccatgggcaatgccttttggtttgttggaatgaaggaagataagtgctgtgcagatgtcagcagcaattttgatcctcattctccatggaagtggatctgtttggtgtttacattgcaaacggtcctctaggctcccgtttggcaagaactcatagaccaaagctttggcctcc

SEQ ID NO: 28310 - DNA, 8607 bp, Oryza sativa
aaatacctcatcatcgaactctttctctcctgttatgcctttacggttgaatttctttatagccacaggggtatgacggagaaaacctttgtagacacttccacatccaccatgtccgatcattttggattcatcaaagtcgttagtcgcttctttaatctctgtgtaggtgaactctgtcaaggcaacagcactagtagaacaagatacattgttgcagtttatttggctcatcttttcagcttctttcacagcattgtctttctgacgttgcaactctccttgcacagtctggagctcttccattagagaattggcatgcataagctttctctccagttccattatttgctcatttgccttctgcagctcattgtagatctggaggtgctccttttcaagactgaccttttctctggttagtctttcctctaccgcaattttttctttacagagtgaattctcccgtgctctaaactgcgaaaaaaaaggtttgcaatttcgatataaagttgagagactcatctatcatgtagtaaaaactgtatgtacgtatttcactaacacatttgtgcatctttcaaaatacgacgtattttgaggcccaaaggtactaaaatcagtagattaagcataaattcttcatgatgagagggatatggggataacaaacaccataccatcttagacgcttcaaacagctctttctcggctttctgtcggctctagaggatcccgatgcttcctttcttgaccgttctagctcattgcgaacttgctgccattgttcaaacatttcattctgcatgttagcttccacctgtaaattattaaggtttgatctgaattcagtagttgtcctttccttacttaaaaaaaaggtgcatccatgaaggtatccctagagatttgtttcagtacaatatagcttaccatgaaatgctgatgctcttcggagcttgagcttgaaacaggtactgataatccatccacagtgtccaaatctgtcagagttggtgaggaacctttgctttgatggctggaattcggggagcaaccttttggtgctacgtcgactgagtttggccttataggtgatatattttccacgccgttctctaattgtcttgaaaagggaaagggatgactaatggaattggaccgccgaggtagcgattgctgatctggagagcctaagaaacctgaataccatgacggcaacgacactgatcttggagggaattcagacttatctgacagagaactcccggagctgcttctgggggaatctcctttgtcagcaaactgactggcttccctaaaatggtaaacaatcacaataacgttgttttacaatcacaataagtttgtcaaaatggtaaattcaatgtggaattggatttatgttggagactaggtaggactgcatgaacattcatacctagtgcaagcaagagcttctttgcaaatatataagatctggcaatatggtttggcctgttgatgtacaattgctgcaacttttgattttggtacttgcctcttcctgttcatgaaagattcatgcccatggtcaacattgaaattttcagattatacactaattagaggatctggtctctagtttagacaagaagatgatagccattaaaacctagcttgttaacagtagtttaacgtcatattatgcttgccatttgctaagtaagaaatatacaagaaaggtaaattgctgagttgtattaggaaggggaaaatgcattgttcaagaagtgtttgcttgttggtcctgacgcctttgtcatcaatacttgttagaatgagcgacacaaacatgacaaataataaaatcacatctacggactacaatatgctcagtctagagatatctcagtggttgtgattcatgatgaggcctcagtacaatggaataagggcatcttggcatacactgagaaggaagatgttcccataacaagctttgtaatgtgatgttgatcaataagctcaacaatgccatttgcaacactgttcttctcaatcaccaatttttcagcttgcacctgcaaatttggtgattttgctgagatgacatagaatgggaagcaacttctgattagcataaaggatataaaatattgcatagatttctgtaatttgatggtcttattcaatccacttcatcagaacaattagtcataaagcttaatttgtctaggcctggtacaaaatgtggttaaaatattgattgttatctttccataaattgatcctcaagctgaccatagttcactttgttgaaaaataaaattcccatttcatatgacttgagtgagagtgcttatctgacctttggaaatgctctgcagtaactcaggtactgttctaaaagtttattcatatcgtccttctcaatctttctgtatgctctgagctccttttcttctagctgttttgcaggaaccttacacaagcctgcaaggatggcatcatcgcaggaaaccatgagcaccggcgtggacttcttttttttttttggcagagcaacatgtaacactaaaacaagtattatttcctttttctgtgggaaatatagaagattttctgattattaagaaaatagatgtctggtagcaacttgggttaatgcataacatctaattgacagaacaccactttggttattttcaggttcattgtttgtatgatagctgcggtacagtctcttgagaagcagggcatatggaaaagaaaaaatgtgtgtgctgctgctttcccaattgaacagaccaaaggtgtctttcccagaagttgcagagaaaaacaacaatttgtggaaatggaaatacaaccgttgttgcctgctacgtggtactagttatcatactagtaatattgttagtgttgttgatatgctactacttactaataataacagaagaaaagggcaagtagaaggaaagaaattatataccgctcatgattctgtctgcaggctggtggacatgcagcagcacaagaagcttgttgacatcaccctgctgaggctggagtttcctagctgcccactggatgttggccttgccgtccttgaggtccttgccgaccgacacgtaagtctttcctccgtcatcgtcgtcgtcatcttcctcctcgtcaatctctctgaggctgcgggttcctccgcctgcgcgcaccaacatccgctcaacgcctgcaggtactaccggctgaggagacaagggcggcaatggtgacgacgacgacgacggcaacgaagaacgagcacttgccacggccatgcagcgcaaacaacttaaattaactgccctgccaccacacaaccgacagaataagaagcaaacaactgggagtagctagctaggcaggagaaagaacaagtacctactatatctttgcttgctttattatagtttctgctgctgctgctgctggaggcgacggcaacaacaaagcaaacaaaaggatcgaatctctcacaaaggggacttttggcttcgcttgtatgtcgtctggcaacttttataaactcatctgcttcagttattcgacaaaagaaagaaaaatctctgttaaatctatcttacatactccgtactagatagataggatattattgattgtgagatgaagacatttgggagccggggaagtttcctgcaggtatcatccttcatttttcattcatattccttcttccttaattctttttttgtcttcggtcaacaataggagggcgtggatttgtcctgcacagctgttaacttggaatatactgcctgcctagcttgcttttggtcttgggctagctgtacctgtactcccttttaaaagatcctgcatacaaccatgaccatgaaggaaactctcactcttaccaagtcttgcttctactgtttgccttccatcattggttaaaggttagtaatatgaaaatggaagacttattgtgcttaatcctatgttgggtgaggtcaaccttattagctgcgtaatggagtattattgtagtatactatatacaggtctgtgaatgtatatgattctcggatgtataatttatttgtgcttgttcggtgtcatcattctctcttactccatatatgtatatataagtagaagtaacacaagtagtagcagggtacattgacattgaaacggaacacttccttttgttgttgtatcacgttaatccaacatgaattacttaatcttttctagtcgttggatctgcattactagttcaactgacaaattaaggcggcacatacaaggttgcttgctagggaccctgctggtatatccaagatgtatcaggtatattccgccaagtcgtcagtcatcagacgaagaaatgagagaaaaattcttttgtttgaataaattaattggatggttggtttaagctatgcgattggtcagtcactcatacgcatttcctatatagaatatagctcaagtatactcactctgtcctattttaaatgtaactatgattttccgtgcacaactttaaccattcgtctcatttattttttttaaaaaaaacatgtactattcatattttatcatctcataacaataaaaatactaattataaacaactttaaataagatggataattaaagttgggcacagaaaattatgattgtatttaaaaaatgggacgggggagtactaggtgcatgtgtccttgttattgttaacaagttgtaattaatgtaacacgtaagtagtgcaacgaattcaattactaatacggccctgtttagttcacatcaaacttccctcaaactcctaacttttcatcacattacatcacatctaaaactttcctactcacataaattctcaacttattttccaaactaccaacttttcctaagcttcttcctaatttcaaaaattaaacacagcctacatttcagaggcagtctagctggctatcgagaagtgcaggccttgggcggcggtgtcgcctcttcctgcgcggatatatggagatggcgtctcacatattccaacagttctgtcagcacccacaaaatcaattggttgttgaatcaccccattcctcaagtcaatgggtaggatccatgccttgtgagcaaggtggtcgatgtgcaagctgagcacgggatgacccacatggagcttctccaagataggaaagtagttgggcagcttaggcatcaaatttgagacgtccgaagcatggagctggcagtcgttgcgccagcaaccagattatgtgttccaactctatttagcgagttatgaaattagttttttcattcatatccgaaaattcctttcgatatttggtcaaacgttcgatatgacacccaaaaaattttatttcaccaactaaacatgttctaagtggtggaggcagctggatgtagcttggggcaggttcctcttgaaggagattgacaagcacgatgcccagccaaaggtcaacgaaacccatcagtccaggagcttgggcggcgatactctctctccccaatctcacttccagggaagccaaaccaaaaaaaagaaaagaaaagaaagcgcccctcttctactcctcggttatgggcttatgggctaggtgcctaggtacttgggatgggcctttgcgacaagtgtgatccagtggaaaaagtacaccaaagatccctcaacttatcgtaagatacaaaatcgtcctcgaaccgcaaaaccagatatacggggtccctcaattatacaaaaccggtcacccaatgtctttggtggttttgaccctggttttggtccggtcactaagccaatgatgcaggaaatgcacgctaggagaagtttggcatgcttagttagtgggagcacttgaggaagactaaagcttgaaaggggcttcacttctaggacttcttggctaagaggatgcttgctataagaagtataagtaggcgggtaacgtttcatttcttccatagaatctcaatatggcgagaatgaagcagggcaattaaagtttgaattcaattcaatagtcaaggtagagtagaaagggggggcgtgctacttaacgcaactgcacttggctaagaaaataggatagagcagagagagcctaatctcccgcttggtcattgagcagtgagccgaggtgcgatgagcggttgagtcacgcactacaagatggctgaaggttggcggcttagtcctcgtgggacccacatagtccccacatgtcaggtgtccacgtcaccctctctttttcccctcctctctctcacttctctgcaagctaaccggggcgagacgggagggcagcgccgtgacggccgccggcggaggcagcgtgcgagcgcgacggcttctccgctttctccgcctcctcgtcccgctcggccgacgtgggcgcgctcgccggcgaacgcgtcggccctgtcagcggcgccggcgacgcgtacgcgcggtgggacgcggcggtggggtgccgggcgctcgcggagaactaccggccgtggtcgcccgacccagcggcgctgcagcacgacagcacgtacgtggttggttggttggcttcttttcggtttgttcgttccttgtggttgagagtgagtgaggtggaggagagagaggaggaagaggaggggattcattcacgtggtttccggagagagcaggagccaacgtgcggcttgactctggagatctctctctctctctctcaagcccaaatcagaagtgagtgagtgagtgattgattgattcctcctccgtgttcctgtccggcatttatgattttctctcctacgttcttgtcgccgtgatgtgcgtgtgccaccgatgaaggcgtcgaggtcgtgagagggagaggaatcgacggagagagagaggcggcggcaggaaaaggtggagaagtcaagaaacaagaacccaatcaccattgagattgggttcgttttccaccctcctctgcgccgatgcgtgtttcttggtgttcttctctgtattgttcgtttcttttttgtgtggatggaatcatggaaatggaataaagatttgcatctttaccatctgcatgcgtggggctccaggttgcagggtatcaggatatatagcatctggctagcgtcgattttctttttcttttgtgtgtctcgaaatgataggaatcgtagtactgatcatttctcccttcgtcggcaagaataattcctctctttatcttggcgcaagaatctaatttgcagtagaagaacatgcatggtttgagtagtaatatcctgtattatgaatctggctgcagaacgcctcatcactgcagcaatgccatcatcagccatggccgtcgacaccactgctcctgagcattggctcgactggaggttcatgctctgcgcggtctggccgtctgagtctactcctgcatggtcctggcatgcttcttgatctggaagtacgaggggccgagctcgcaggacggcaatggcgatggcggcggggacagtgaggatgcacggccgccccgggccgcatccggggtcgatcgcccggcaccccaccgccgcgtcccaccgcgcgtacgcgtcgccggcgccgctgatagggccgacgtgttcgccggcgagcgcgcccacgtcggccgagcgggacgaggaggcggagaaagccgcctccaccggccgccgtcgcggcgccgccctcccgcatcgtcccggccagcttgcagagtagagagagagatgaggaagggagagaagagggaaaagagagagggtgacgtggacacctgacattgtggggccacgtgggtcctatgctgacttaaccccacgtagactaaaaccgaggtcaaaaccaccaaagaatctcgggtgaccgattttgtatagctaaggactagcatatttggtttttggttttggggttggaggacgattttatacccaacgactggttgagggaccatcggtgtactttttccgtgatccagtcaattgaaaaaaggtccacctgacgtccttcaactctagcttaagtttataactagtaaacgtgcacgttcgcacatcatgtcacactaattaattattatgtacaatcaccccaagataataatcttgcaaacaaccaaagttcaagaattatatatattctagtgtaaattggtaactcgtttttagacactttctattaaaaaataaatacaaagcagagaacggtatgaaatgtatacaatggtgccatagctttgatatacacgcactaattaaactcagctctacctagctacatctaatcggaaaaaaaagcctcccttatctacataatagcttcccttcatccacaataagttcaaatgcgctacaaaacaatctgcaataaaaatatcatttaaatgatctccaataaataactcctgtcgtatcaccagtaatgaaaaccacaagccctttagtgttgtactgttgttgtatactccatccgtttcgaaatgtttgatgccgttgactttttagcacatgtttgtccgtttgtcttatttaaaaaatttaagtaattattaattcttttcctatcatttgattcattactaaatatat

SEQ ID NO: 28311 - DNA, 10276 bp, Oryza sativa
  unsure (1)..(10276): unsure at all n locations
cggtgtcaaacatttcgaaacggaatgagtacttacaaatgtttacttatcgatactgatattcagacataagctcgctgaatactccagctacgcggtcggtcagtaagtcatgtgcatgtgtccttgttatggttaacaagctgtaattaatgtaacatgcgtacgtagtgcaatgaattcaattataaagtacatttcacttaggcagtctagctagttatctagaacggcaggcactattgcattattactgttccccgtcctccggcggtgtcgcctcttcctgcgcggatatctggagatggtcgtttggacatacgtctcacttattccaaacgttctgtcagcaccagcaaaatctgatggttgttgaatgacccagttcctcaggtcaataggtaggatccatgcctacctattgatcttggccatgaggtgaacaagatgggcgtcgtgcaagctgagcacgggatgacccacatggagcttttgcaagcttggttgaggacgacgggcagtgtcgtagtttggcagggtaggcatcatatgatgtgagatttgagaggaacgtaggcggcagtccatgcgccagcaaccaactccatttagcggccgtccagccatcagcaatgtgtctctctgcgggtgtggaaggcctttgaactcaaactcaacatagttgatgcaaccctctaagtcgatggcaatgtcacgaacatcgcttgcgttgccctcgtcaatgcctatgcctgattcgtggaggcaatgggatgtagcttggcgcaggttggtcatgaagcacattgacaagcacgacgccacgccaaaggtcagcgaaacccatgaggccaggagcttggcgggagaggttgatgaccttgtcggtgtgatggaagaagaaagttaggggaggcgagctttggttggtggtggagtggtagaggtggaggcggtattctccccctggcttcctgatgggagtgagcgcggcgacgatatgatgtagtgctgctgtttggcgtacgtgcggaattagcgggtggtggccacggaggatgccgacgtggttgtcaagaaagaggctgtcgaggtcgccgctgggatgggggatgcgcgtgagcgatggcgagctaccatcggagaggaataaattgtgacggttaccatggccgagggtgaggcggaagaggaggaggtcgtcgtgagcggcgatgatcttgggctcacgggcaaagtcatccgagggatttcatggccctcccttgttttggaggtggcgttgcagatatcggcaaagtaggcggtcttgtcgaggagtgcccagggtggcggccgcccccgccggcttttcttgtgaacgtctcggccgtgcgcaggaggtcgcagggaggagtccttgatgggcttgccaacctccatctctgatctctctctaagacgacttaattagcttgattgatctttcaaggaagaggaagaagagcaccacagaagctggacatacttatatgctggggggccggcctgggcactgggcagcagtgagtagcaatcggagtcggagatagtgtgtttcctctctctctctctccaatctctcttcggccggtgcacaggacaacaaaaaccgccatctttgctcttcgctgtgttctcaagggtgagaagaaaccatccgtgtttttgggagaaattttcaactctaggaatgacttattttgtaatattctcttctctttctctttgcatcacaaatccacaggttaacaatattagtaacagttcaagaatatgaataaataaccttcttatagttcaattgaaaaatattagtatcaaacaaacaataatctcctagttagtaaaacatccgagggcaactacttctcacagctgataatatcattataccataccaattcgttatgtatggatgatggataagatcctatgaacagagagccaatttgaaacttccaatggatttatggaacaatccggttcgaatagaaataatgtgctccacaagcacgtaaggaggatagatgcccaatttatagcggccaagttgatacctccagcaagcagctagctacaatgtttttcacacacactccaaaaacaattgagagtccagaataagctgattatctaccaaaaaaaatctcaaactacacagggcttctttctgttaacttccaacatctaaagctcctgtcaaattcatgccttctaaagctaccttttcctgcgcttggaagacttcactgtcaacgtccttggcgcttcatcagacatcttaaattcaacatactgctcctgcacaaccgaccaaggaagagcaggattcgtgttacatatgttccgtttgaaaataatgcgaggaatgtaaatcacgggattatctgccattttggagaaggacagatacagacctcctcccactttttctggagctgcaaaagctctttacagcatgccacacactcagcatggtaagcagcagccagttctttaatcaaggccttccttttgattattcctatcacttcaaaacaccatggcattatatacaagcacaagaatgctggcaactattttacaaatgaaaaatgttttttagattttgcaagcaatgcatcaacagaactcaatatatctctaatactataatgaggccagtgtaccatgtgaaaatcatggagagataaagctttgacatttcataactcactcatgacaatatactagcaaggtagctagtacatgcataacaattgtacttctattcagtatctggtaggataggatacctgctccaatcatttatatagagtcaaattttttgcaacatactagacttactccatcccgaataaactgagatgttggttcaagaattaccatcctatgcacatctctcagaaagctttataagtgaactgaattatggaccaagggctacgaaaattgaggccatggccatggcatttgataggatctttgtgcattcctagttgtgcagcagatgtttatttcgtgtgactgtgagatttccaatttgattcgtggcgaattgttagttagcaatactagtttacaaaacctgaaccctctaaagcaaatcagtatgagtcgtgatttgttatactctagtaccgaataggagtaaccaaatctagagcacgaacacaaaaggtaacaaaaattaaaggtgcgtgagaaagagagagacccttacttcggctgggatcgaagtgttgctcgtcgggcttcttctccccgttggccgtcggctccccgctgccgctcgcgccgtccatgggatgggaggcggaagatcgccgcggttaggcctttgcttagatccaaccaaacaagccaacacccaggaaaggggaaggcgacagagccgagccggttctctggatgtgtatttgttgggatttctcgcttctaggtcgccggcgaaaaggggctcgctggccggagacgaagacggagacgcagatggagacgagagtgacaatggcggcggcggacgcaacgctccgtcggcctcgagtaggaaagtgaaggaaaccaacacaaaagaggaagtatatgggcctcagcccggcccatgtacagtttttctgcataagcctctcgagcggcccaactactacacttggactctttctctctcattccacttcttgctcgccgccgacgccgccgccggcggcggcgaaggggatcgatcggatggggacgtcggtgcaggtgactccgttgagtggcgcgtacggtgagggacccctctgctacctgctcgccgtcgatggcttccgcttcttcctcgactgcggctggaccgacctctgcgacccttcccaccttcaaccccttgcaaagtacgcttccaccattttcgccctaactctcctcttgcctagtcggagtcagctgctttggtgctagtctttctcctttgccgcatgctgcgatgagttcggatgggatggggatggggttgccatgcgcgccacctgctcgttcaattgcctacacttggagacagtgaagggttctccggctctgctgtgattttgtcatcttagggttatctgtgttgctatgtaacgaatgagatcgtcggtttaggagattgatttgcctcaactgaattgctgagtccgacaggtgttcgggtgtgcttgtgcatagtcaggcttggtgcatgttatgcacttgtgttggtgggtccgtgtgcacgaacgcatatgcacttctacattgtgcccatgatcctgcatacataccatatggactacttactgatgtgttgtttatgtatgaccttaattgttaattagtatgtgccaaagatgtagctcgagtttctaaaccgtgcttaatattgcttctcaagcttgtcttactgggcgttgcccctcaacatttcatgtggtttttacatggaaccttcagtaattgctttcatttgcttaaatggtgaatatctatcttaaggcaattatagagtggcatgatcaaggcaattttttgcctccctgtaatagatagcctgctttcaggttgaactctgactcatatttatatttatttttctatgctgaataaacttattcttgttcgtcttccttgattgttgagtaatcatggcatagatttagtagcaattatctcaccagcttggtactagtagcctcaaaatcatgcaaaagttccattttaagctcccatgatctttgttgttcaattattcaaattacacatctgtaaagattgaagggaacacttgaacatgtttcagtatttttatggattatgaatttgatcagtatttttttttcagggttgcaccaacaatagatgcagttcttttgtctcatgccgataccatgcatctaggagctttgccatatgctatgaaacatctcggactatctgcaccagtatatgccacagaacctgtatttagacttggcattttaaccttgtatgattactttatatcacgacggttaagctttctagtgtccattttaacctcttgtttgtttcattgcatatagtggatctaaccattctttattttcctttgcagcaagtttcagattttgacttgtttactttggacgatattgatgctgcattccaaaatgttgttagattgaagtactcacagaaccaccttttgaatggtcagtaagcatgctgttgatgtatatcctttgctaaattacatccccttacatactattgattggcagataaaggtgaaggaatagttattgctccacatgttgctgggcatgatttgggtggcacggtatggaagataacaaaagatggggaggatgttgtttatgctgttgacttcaaccatcgtaaagagaggttaaatccttcctttgtcatttacttgtcattttagttttctctttattagcaaataataacagcaatgtgcttttccaggcatttgaatggtactgctcttggatcatttgtacggccagctgttctgataactgatgcatacaatgccttgaacaaccatgtctacaaaaggcagcaggatcaagatttcattggtacaacactggacatgttattatcatagctctctatctctatctctttttcaaatgctttcagctctagcattactactatacccacacagccatggttgcaggtaacagctcatgataattttgttggaagctgttttttacttatgttttctccatcaaagtagcactgatgaatatatcttctattttccaaatttgcaacttggacacaactttttttatttctcaattattttttagtgctacacattgttgagttcaataataaactattaatattttagactccaaatatatgttatcgtgtatatggtttgttttagttactgtatgggaatcctcttgtgatgtctaattgacatcctgtttcatgcagatgcattagtgaaagttctaactggtggtggtagtgtgttactgccgattgatacagctggtagagttcttgaaattcttttgatattggagcaggtgaaatcttgaaggtcttgttctcgtactgttttattttgttatgtcaataatatgttcaccttttgtcttgatttattgcagtactgggctcaacggcatttgatctaccctatctactttctgacaaatgtttctacgagtactgttgattatgtcaagagttttcttgaatggatgaatgattcaatctcaaagtcttttgaacacactagagacaatgccttcctattaaagtacgaatgattcttgttactttcctttttttcagttcatcgttttgttttattctgtgcatattgacaattgctatgcattgcaagcctgaagattcatgatgagcttattattttacatttcaacagcccaatagacatgtttcctctattactttctccttatggagtcatatttatattttatctcattgggctgtcctgttattacaatactgtattatcagagccaattcaactgcctcttttcctgaatcagcgctatactattatttgtttataaacttcatatataactttcttaagaacgatatttgtatgattgttttgtttagtttctacaacttttgttttttctgtgttgcagatgtgttacacagataataaacaaagatgagcttgaaaagctgggagatgcaccaaaggttagagtaacatttatttcctccatactgtcggaaacgtgaatttaacaaacatttagcaggtggttctagcatccatggcaagcttggaggttggcttttctcatgacatatttgttgatatggcaaatgaagcaaagaatctagtactttttactgagaagggacaggtaaatccatgtactcaatatatctggatggtttatttctttctcagcacatacattcaataactagctacatacaaaccattatagcttcaaacctgtaagtgacaagtagtccaacaccttgaaggggccttagcaaattgattgctacaacctacatgaaacttttaaaatttgtgtaaacaacatgaatcttgatgatgaatccaaacttacgtcacgttaaccatatcctctctgccttcatgttccatagatttctgtatttgcaaaaactgatcaaacatttgtgttgttctcactcagcaaaagaattctagcatcatatatctatgttctacagctatctaattacaaagtatcccattccagtttgggacactagctcgcatgctccaagtagatccacctccaaaagctgtaaaggtcactatgagcaagcgaattcctttagttggtgatgagctgaaagcttacgaagaagaacaagaacggataaaaaaggaggaagcgctaaaggccagtctaaacaaagaggaggaaaagaaggcgtctcttggatcaaacgcaaaggcttctgatcccatggttattgatgccagcacatctcgcaaaccatccaacggtatagctaggctgcgtttgtaagacctttacgatctgatgcaatatattatatgtggttaacaacccttcttggctctgtggttccatcagctggttcaaagtttggcgggaatgtggatattctcattgatggatttgtccctccatcatcaagtgttgctccaatgtttcctttctttgaaaatacttctgaatgggatgacttcggtgaggttatcaaccctgaagactatctgatgaagcaagaagaaatggataatactttgatgcccgtaagtttgcttatgtactttttttcttttttttacaatcggaaccctgtggccagatggtttaattttgcctggagcatatcagccaactatgtttagggttttctttcttggaacctgaaaaaacttgaaatgccaacaaaataaacttgaatgtcaatgttttcatgaattgttttcagggtgctggggatggtatggatagtatgcttgatgagggctcagcacgcctactccttgattctacaccctcaaaagttatttccaacgagatgactgtaagttttttttcccatttacttcattttgtctgtctgtttatttatttctagaaaaatctttacttctatttaattatgatcaacatttttaggtgcaagtcaagtgttcattagcatatatggactttgaaggtcggtctgatgggcgctctgtaaaatctgttattgctcatgtggccccattaaaacttgtaagtgctggaaatacccttcttttagcatccatgatttaggatttagaatttatactttttgacacatgattatctccttcttggaacatatatttttctcacgtatatagcttgtcccttttcaacaagaaattagtttgaaattccctaaacctatttactgattattattgatgcccttgagctatggaaaccatttacaaatacaattatttacatttccgtttatttcttgagggtaaacatgccatcacatactgaagctcctgttacattttcaggttttggttcatggatcagcagaagctactgagcatttaaaaatgcattgttcgaagaactcagacttgcatgtttatgctcctcagatagaagaaactattgatgtgacatcagatttatgtgcttacaaggtctgtataacgtttatgttaacagccaaactcttattatgtgtgacgggcaggcgttgcctgatgctggtgtccaattcttatccgatgacttaaacaacatgaggcaaaactgaatagttgccatttaccaatcatttttactgcactatcactgtatcatatatttccatacatacacaaacttattcactatctttgtaatttcaggtacaactttcggagaagttaatgagtaatgttatttctaagaaggtaagagcattggtttcctccttcactattaatgtattttatccttcaactggtgctaataaatctccttgatgtggacgctatcagatgatataaacttgaaccaaattaagctatcaaactgatttttttgcttataaagtgagccagattcccaggaccattcatgtttcagtagtaataagattataaccagaaaaggcagaacttcttctattgttgcaaaaatgttacttcatatgcaatatgtatatgaatgaccgaggtccttccaatgcagttttgagaaatgattgattccatactggttactggatggtccattctgttgccctagtcagtcgaatgtttttcagcataagaagcctttcatgacaaaattgtctgtgaaccagataccacaagcctgtgattatttctttttttttttgcccatacaagaatatgaatgaccgaggtccttccaatacagttttgagaaatgattgattccatactgcttactggatggtccattctgttgccctactcagttgaatgtttttcagcataagtagcctttcatgacaaaattatctgtgaacctgataccacaagcctgtgattatttttttttttgcccatacaagtatacaacctttgggggctaacctgaaactgcactttgttgttatggattagcagtaagaaagcactaacactggcactctgtgcagttgggtgagcatgaaattgcatgggtagatgcagaggttgnaaaaacagatgacaagcttactttgttgcccccgtcgtcaactccagcagcccacaagtcagttcttgtgggtgatttgaaattggctgattttaagcaattcctggcaaataaaggtttgcaggtaagttttcattttcaaatatgttagtactgtataatattaagttcttggatatactggcccttcacgtttcagtgttgagagagagagagagagagagagcatgtcctgacagttacaactgttactcctgctcccatacagaaccagttgttagatggctcctcttaggagtacacttaatattgtttgcataacttactagtagctggaataccaaaatcgattaacaaaactgtaataggctaacttggaagcagatgttaaccaggctgtaagcatgagtaattatagctgttgatacattctgaaaccattgaaattcagggctaagagatttcttgcaggttgaatttgctggtggtgctttacggtgtggtgaatacatcacactgcgcaagattggtgatgctggccaaaaggtaagtagtggtgaagtagc

SEQ ID NO: 28312 - DNA, 641 bp, Oryza sativa
cgatcacggcgcggatcctggcggggctccgcgggcacggctactacaacctgggagtgcgcgccgacatcaacgaggtcatcgcggcgctcgcccgcgaggccggttgggtcgtcctccccgacggaaccaccttcccctcctcctcctcctccgtttcccagccgccacccacgcagcagcagcttcaggtatggaatcgaacgaatgcagcagcagatgtgttcctgtctgttcccctccctcccactcttctcttctccttgtccgctctgctctgctatgtttaaagctggctggcaggcagctgagcctgagctcagtgagctggaagccaagtaccggagagttatttaccctgttcctttcattattttatttatttttgacgtcataaataggtcgcatccggtactgtaggagatatgttttcaagtgatgatgacaaaagcacccctcataactcatttatgagcccttttcgcctcacggagagtagatatatattcattattattttaaatcaggcttccgtatccaacttacggagaagcatatgtttgtctggaaggacatataacgctgaaattatagagacggggtatttcatattatggtaattttgaattaaataggtacat

SEQ ID NO: 28313 - DNA, 15813 bp, Oryza sativa
ttccccgtgataaattgaccttctcagagttgacctgtacaaggtagggaatttaggcagcaccgttacatttcgatgtatcaaggatagttcactatattcataattatgttagagggaattctttgcatcagtgctttagtggttttagtgtctgggctcgtcagtgtggaagctggtaatttgttatcaagccatcattgaggaacccgcagcctgctctttgctaatatcccatttttgttctcacaatagattcgcatatggagcatgaaatcagtggccaaagacaatgacagtgatgattccagccaaaggttgctggctacaattcgagaccattttggaacagtaaactgtgtgagatgggcccatcatggccgctatcttgcttcaggatcggacgatcaagttatccaaattcatgaaagaaaagctggcactggaacatctgaatttggaagtggagaacctccagatgtagaaaactggaaggttgttatgaccttaagagggcatactgccgatgtggtaattatctgccaaaatctcagtcatgtcatgcttaacataattagattttaatctgtcacctgttacttagatctcttactaaaactgtcatgatccttatcgattcattgttgaacacagttatatttcttatgtgtaaagtaggttgaccttaattggtcccctgatgactcgacattggctagcggcagtttggataatactgttcacatatggagcatggccaatggcatatgcactgctgtcttgcgagggcattccagtttagttaaaggcgttacatgggatcctatcggttctttcatcgcaagccaatcagatgacaagactgttatcatatggcgtacgagtgactggagtcttgctcacaggacagaaggccattggtcaaaatcggtatgtttttgttatattgttgtgaatttggacttggtcattacatttctgtggttcacatatcttgtttgcagaaagcctccttactgaaaaatattttctatgtgtgtgtgtgtgtttgcagcttggttcgacattttttaggcgacttgcttggtctccctgtggccacttcataaccacaactcatggttttcagaaacctaggcactcagcccctgtgcttgaacggggtgaatggtcagcaacctttgattttctggggcataacgcacctgttgtagtggttaagtttaaccactcaatgttccgtaagcatttatcttctggccaagacgcaaaggctgcaccagctggatgggccaatggagcatcaaaagcatcatctaaagaacatcaaccatataatgttattgctattgggagtcaggaccgaactattactgtctggacgacagcgagtgcccggccattgtttgttgccaagcatttcttcactcaaagtgtggttgatttatcttggtatgtgaatttgaccatataacatattctataattagtatcccgtgtatgtgcaagctcaatagcaactgctctttttccctgacaggagtcctgatggctattcactttttgcctgctctttggatggttcagttgctacctttcactttgaagcaaaggagcttggatacaggttaagggatgctgaactggatgaattgaagaagaatagatatggcgatgttagagggaggcaatcaaatatagctgaaagccctgctcagttactgctagaagaagcatcggccaaacaatctgcaagcaaaaggttttccagtgtccagcaatttcaatcacccccaaagtttttacagatgcacctaacccgtctacaagcgttccaaatcagaaagctcctgaagctttacctgaagatgagaagaaaactgcaggttccactgctgatgacataaataaagcacctcgtttatctagtccagtgaaacaaagagaataccggcgtcctgatggccggaaaaggattattccagaggcagttggatttccttccaaccaggacatgtccaaccgttctcagaatcaaggtgtggatttttcatccctggatcagcgaatgatccttggagagaatggaacaagaccatcttatagtgctagcggtaactgtaataattgtggagttaggggacgctctggcattactgcaagaactaacattagtgagagtcttgtaatccaaaaagcttcagctggtgctggcagtgatggaaggttgagcatagaacagtctggatctgtagttccaggctcattggcctcttgctcttcactttctatccatgtattcaataagaaagacaatgaggattctttaccggtccgccttgaagcaaagcctgtagaacgttctgcaggagacatgattgggcttggtggtgctttttcaacaaaagaaactgagattacatgtacaagaggaacagaaactctttggtcagatcgcatctctgccaaggtgactgtcttggctggtaatgcgaatttctgggcagttggctgtgaagatggttgcctgcaggtatctaatatccctttagtggaattccttgtagatttatttcatgttttagtttggaatagttacaaaatctatcaataattgctggaatatgattttatttattccttcatgtgcattcatttttctgacaatctggtagcctaaacactcgaatcaactggtctaattgttcaggtttacacaaaatgtggaaggcgagcaatgccagcgatgatgatgggatcagcagctgtttttatagactgtgatgagtgttggaaattgcttcttgtaacaaggaggggtttgatgtacatatgggacctctataccaggacttgcgttttgcatgattctttggcttctttggtaacatctccagatgaggcagctggaaaagataccggtaaatatttcatatgtagtgttaatctgaacttttgtgcatctaaattgatgttgaccaaaatggcttgttcttgcaagttgatcttgctttgttatatgacaggtacagtaaaggttatatctgctaaattttcaagatgtggctcgcccttagttgtgcttgccagtcgccatgcttttctttatgacaccagcctgaaatgctggctaaggatagctgatgattgctttccagcatcaaattttgctagctcatttagttctactcaaggtggagagctaggcaagttgcagatcgatataggaaaattcatggctagaaagcctatttggagcaggtttgcacacttccattgttgctcttgtcttatgagcgtttgaaactagaatcatgacatgctagtgtactaacatagcagaatttgctctaaatgtatacttgtttgactgttggcactacagggttaccgatgatggggtgcagacacgctcccatttagagacccagctggcagcttcattggctttgaagtctccacaggaatatcgccaatgcctcttatcctacataagatttctggcaaggttagtttgtttatcaattcaatacaatggctacagagtctccttttctgaggcttagcaacatttcttttttgcaacctcagctctatatgtttaattggctgagaaagtttgtgattcttttatatctgatgagaacagtctatgatgctgtgcggaaatgattatattgcttgttctttgtttcgttcagagaggcagatgaatctcgtctacgtgaagtttgtgagagctttcttggtcctccgatgggcatggttgacgctgcatcatctgctgatttgaaaaatccatcatgggatcctgatgttcttgtaaggctctctgtctgatagatggcctgataattctatgttttcttggacgtgatgtttatttaccactttgagcctgtgaactcaagtatggtaaatctgcagggaatgaagaaacacaaactcctaagggaagatatactaccttccatggctacgaaccgcaaggtccaacggctgttaaacgaattcatggacctcctttcggagtacgaggctgctgagacaaacgtcgagcaaatggacgtgacaccaacaccaccaccaccaccaccagcagcagcaacagaaggcaacaataatggtgcctcatagcagttgggattgctggagaattattactgacacccccttgggtaagcataggacaatcaagtgcatacaacatagaactatcatgtgttttgagaattgcccatggttgattaaatttatgtagctgctagagcctttgtgttcatcttcttcttaatagcaaagggtgagacctcagccaaacaacccgttagttgtaacgcgagcagagtgtaacagtagaaagaaagcgagcgagggaggcctcctggtgatcgattgtgtaacagtaaatctgtagaaggtcagacgattaacttaatgtcctttttgcttatgggttccaaaaggcaatgtttttggggtttttttatagggttctttaattggttgaagtattccggcatcagtattactgctttctgtagactggtagatactttttcatttctattaatggaaatggagggctctcgccctttgctcaaaaaaaaaaatcagtaatactgctatccagttgcaacaaatcatcatccaaaggtaataataaattagataggccccaaaaaaagttgttcaagaagacgaagaagaagaagaagaagaagtgcaaggagcaaatctactgaatttcgatcaaatctactgtttaaccttcgaaattcgaatcgaaacttaattccgagccatatagaaacgtcgaaatttcgcggaatttcgtcggaaatgagaaagctggttggtgagtattcattcgttcgttcaggtggagaggaagcggtggatggcgggggtgaaggcttgggcgacggcggcccaggcggcctgcgtggggtgcacgtcgtcccagtagaagtgccgctccgggtcgtcgcacaccgtgtactgcttgttgccggcttcgtcctcctgcccgcagtggccgtccgccgtgaacgtctcgcagcacggccgcagccgcaccgggaacttgtcgtcggcggcggcggtgatgaggttgaggaagggggtgtggaggtcgaggaggaggaaggtggtgttggcggggtcgaggtcgtggaggacggagcggagggcggcgttgtgctggtcggacccggcgttggccagcgtgtcgcagccggagtagttgagcagccgcgtgaagtacggggtgcagcccatggggtggaggttggtcaccaccaccttcttcatccctacctcgtcgcgcagccgccggagttgctcccgcagccccctcaccaccgtcgggatgtacgcgatcgccgcctcctgttcatacatgcatgttcagagaggagatatgatatatagatcgagatggccggtgtggttgtattgcaattgcagcttacgcttgtgccgttgttcttgtctacgacggcggagtagtcgttgccggagacgacgacgagcgcgacgccggtggggccgcagccgcgcagctgcttctggaacaggtcgatctgcgagctgatgttgcgctggaagtagcccgtgtccagcacgcccgacccgcccaccgcgaagttcatcccgcgcgacgccacctcgccgccgtgcccgccgcgccgccgcagcttgtacgccaccggcgtcgcgatgccaacggccgaagctgcacccgccaatattttaaattcaaccatactacgtaccagttaaaaccttattactattatctctgttataaaaacaaacaaataaacactgcaaaatactttaatggttaaggttagctttcagccagataattgtatggcacattatctgacatgatagatgcacgcacgcgcgcgtgctgtttaattactctctacaaatgtgcaggatacattagcttttactagttgttgagagagtgattaaaaataaataaaatactgccggcacatgagatgcggtatggaacatacgcacgtcagtagagcaggtgagagcgaattcagcttttagtttagtttgcctccaatagctaggctgcaactaaacatgaatgctgctcaacctcttaaactagtctgaagaacactaggaaggaacttacctctaaaaacaagtgctacttgtatagaaaaagagagagttcatcaaatactagccagtttaattttagtacatcttttaagacaacaattaattagataaaactgataaatgctgaatgcaaattaaacacagaggatctatatatcatctcttcagaaacggcgcgcgacaggactgttactgatatacagttaggctgtgtttagatctaaagtttggatccaaacttcagtccttttccatcacatcaacctgtcatacacacacaacttttcaatcacatcatcttcaatttcaaccaaaatccaaactttgcgctgaaaaacacagccttagttattgttttgaagggcagggtacagttgattgtgacgcctcaccataacttgcttagttgttcactagatttgcaaccaaaatgtcggttcgattgataaatgtgttttatgttttggacatgtacatgtcaagcctaattaagcgaggagtgagagcaataacagtaacaataggacagggcgtgctaatttggagacctattatagggtaggtaaaaagaaagagaataatacagacgtcgtcactatgcagtgcaggcatggactagctgcagcctgaggcttttatgcatgtgcggtcagttaagtcggcatgaaaaaacaaacaaagaatgaatgaatgatgaatgaattatccagatgcgatgaactgagtcaatttccatccgcgaaaaagagccaatataatgcaaagattcttcttttagttagttactcctatttgcctatcattgtgatttttgtgatcacctatatatattttggttagaaacgaaaatgatgtacagtctgcctatgaaaaattttgagtggtaaatttccattgtgcaggttgtaaaatgagtgactagtagtagtctgtctgtataaaaggcacgtactccagtacatatatgggcctgtttagttgatgaaatgaaaattttagatgtcacatcggatgtttgatcatatgtcggaaagggttttcggacacgaatgaaaaaaactaatttcataactcgtatggaaaccgcgagaagaatcttttgagcctaattaagccgttattagcacatgtgggttgttgtagcacttatgactaatcatggattaattaggtttaaaagattcatttcgtgatttacatataaactgtgcaattagtttttctttttatctatatttaatattctatacctatgtacagagatttgatataatgtttttgcgaaaagttttttaaggaactagacagggccatatgttcactttggtcttgggaggctggccgggctggcgcagcagcagcggaggatggaattaaattcggttagcagccactggcccaacgaacccgggcgacatcaatgcaatattgccatcctccacctagcatagcagcagcttgatcgatagtgatactccttgtatgaacattaattatagtttatacccctacatgaacatgaggttgtatgtattttgttgattggtttttcagagagcgtttagtttaattttggtcgtaggtacgatatatgggatatggcgctgtaatatgcatgaccaagagaatgtacagatcgatataatgtagcatgacatgtacagtacgtatgacagtaggagtaattaattagcatagcatgaagatatatagagagagatggcgaaggcgtgggcgtaccaacgaagtcggtgaggacgcggccgtcgaaaaaccggccggtggggtgtcgcgggaaggtgatgccgtaggggtagtaccaggcgtgggtcagctccctcccaaggttacccaggtttcccgtgtccgcgtacgagtcgccaaacacccacagctgcttcctgtacccttcgccgtcgccgtcgccgccggggcaactgccatgatcacttcctcctttgccgaccggcgccggagacgactcatcagccgtagccaccaccacctcgacaccacctatacgtcacattatgggagttgaggtttcagcagtaaatgaatttgagtagtagatagctagaatttaatactagtaaaagtgggggagcagatatggagggcagagcatgcagcttacagttacagcagaggaggaggaggaggaccaccatcatcaccgtggtcgccggcaaactagtccggcgccgtatgagcgtgctgctctcctcctccatgcccgatagatctctcacagagtcacattgtctgtgtgcacttgctagctagtacgtgtgtgtgagagtgagagagagatcggaggaggcagctggcgcagcggcaggcagatcagagatgacaagagcaattgatagtgtgagaggagagggggtggtggcgcgatcgatttgcgttggtgtggaggtgtaaatataggcagcccagccgccagctcgggatgtcaatgtcactgtcactctgcacccaaagcgcaaagaaaacaaaatcgatcgctgcccccatttccccgtcttgctgggaatgggttcttagtttttctttttatctatatttaatattctatacctatgtccaaagatttgatatgatgtttttgcgaaaagttttttaaggaactagacagggccatatgttcactttggtcttgggaggctgaccgggctggcgcagcagcagcggaggatggaattaaattcggttagcagccactggcccaacgaacccgggcgacatcaatgcaatattgccatcctccacctagcatagcagcagcttgatcgataacatgatagtgatactccttgtatgaacattaattatagtttatacccctacatgaacatgaggttgtatgtattttgttgattggtttttcagagagcgtttagtttaattttggtcgtaggtacgatatataggatatggcgctgtaatatgcatgaccaagagaatgtacagatcgatataatgtagcatgacatgtacagtacgtatgacagtagtcgtattaatcgcctggatgtgctagcgtctaacagtcaccaaccctactggcccatctcctccattacccactgtcggattccaattaagcactgcattcacaccggccactctttcagtttgcagatgcattcaaccatccagaaaatcaccatcaataaacttaataatatcatatactacatcctaaaatacatgaagaatttaatttggactagtgcattactagcactctagcaccaagcaagcaacacataacaacgtggtggttggtttaatttggactctcccctgcagcctctttctctagctagctgcttcaattcctgacctctcattctccaaaacgagagtacggtctggtcaagaacagaacagagatgcaatgcatcagtagatcatgcatacaattagtgatgagggattagtaacggccggcacgcgtggcagattggggtatatgctctggttgcagaagcgagagagaagaagcgtccaagcccaaagagtcaggcctagcagcagcacaccgttttccagtttccctccttcccatgaaatatactatgtgtttcatccacctaaacaaaattcagaatgtacactttggtcgcagaatcttgcctttcaggaatgcatgctcgccatatgcatttgctcatgcgttccactcataataaagcggcttaattccccatctttgctcctactaaccttgctgcttctagctagtgttgttatcaggcgcccatgcttcattcttgagctacttgtagatagcatctccagcaaataaatgatgtctagctaaatcgatcagtgtgtgatgctacatatttatatataattcggaacttaatttgaaagctatatttcgagccggacgcttctaggatgtttctaatatccaacgaatgaatggcaaattactctgcctgcatggccactttgctgcgccttcccagggtaaaaccaaaaggatattagtactagtagtcggcccaatgcagaaacttgtaaaattacactgccaattcctgctgtaaagctggtgcatgtatgttcagaatctgtgagttatgagtatttgtttgttttgcaatattcatgcgctaggcatattggtacactccaagtctgtttggtgcgcaaataattcagtaaaggctgcctagtgcttactgttctttttgccggaatgccgaagaaggtcattcaatgtaattaagataggaagaaaatgttacaagaaaagttttacatcgatagctggctgtcgagtagtaaggatgtgcaccagagcacacgccccaaaccatgtgccaaccatccaaacgcatactaatgagatggaagtgcttactgtacttaatcgacaagactgaaataggtaacggcaataccaaagttttggcaccaccgaagttatttatctaccaagacaggcacagctcgacccacgaggaacacaattaatcagcatggtgattcagcaaggatatcatcatgtcaccagcaagtactactagcagatgctgctgaacatttatcaataatttgcaattcatcagaataaatgatatgatacaatttctgcagtacacaacaatgccaagatatctctgcttgtgcccaaaaaaaaagatatatttgcatgccaattctgacacaatcacatcagagttcagagagagagagagagagagatgacactgatccggttacattttcattgtgcgttgaagagtagctccttggcatatgccagaaccttaggaacatcaacagtccaagcaaccgagatcggagagtaaccagtccacgggttgtctgaattccacctgcatacaccaatgcaacagttaagcagatgatcaattgcaaatgcatatatatccagcctctctgaataaatagacagtaacaatctctgcatcttcttacttcttcagtcccatgtccatggaagtatgccccttgcagatgccctgggtctcaaccctcaccacgcccttcttgaacgtgaagtactcggggtgaactagcgcggtgaaactcacaggatcatggagaaaaagagctgaagaaatcacacaaatgtgagctggaacgttaatttcccaaagcctgaacttgtaagaaggaaaggagagatgtttcatgtgcggaccatcgacgccgtaggagtggacatgccagtctctgtagaacttgcagatgtcacaaaggaattgtgcgtgcttccctttcgagttccttagctccaacatatccttgtctgcaattttttgtacatgtttaatgcatgtcacctggtgagttggttatccagcactactgtcaaagttcacactgaaggtgcaaagttgaaatgataggctgatcatgaacctgtgaagtagacttgggttgttatgttaaggccaactacgtagatatctgccccagaagtgaaaactatgtcagctgcttctgggtcgctatggatctgtggataacagaggaagtaaatatttcgtcagttttatgacggctttcttctcaccgaaattcagagtttggtaattaatagtaaaattaaacgatagtgtcctttcagacttttagtacagattctcgagtataagaacagatgtaaaggcaaccatcttaattgcaaggaaatctttttgtaattgtgctgttggctataagaaactatttgaagctaatggataaactttaggcaatgcaagagggggaaaaaatgcagaaacagagcaacattatagacaaaaccgaagttgatttgcagaagcagacaagtgtagtagtaacaaaattacatttgcttcagctgaaggggtggcattcccagctgcaaagaaagctccacccagcacaactatcctcttaaccttgcttgcaaaggaggagtctttcttcatggcctgagaaagaaataaagcaaaagtgttactgccagaaataaggttttggtcctagtaagtagagtattaattaagaggcgttagagaaagcacatattacataccaatgcgatattagtgagagggcccaaggcgagtacagagatctctcctggagattctgataccttatcaaccagaaactctgcagctgactgctcaactttgttggtggtggtaggatcaggaaaggacgtgttaccaagtccatccgatccatgaacaaaatcagcaacgtgaggtttccctccctgcaacacacaaaggttggctttatttatacagaaatccactgcatagctgaataaacaaggcaacttgaggaaaaggcgatggattgtgaatattcgcgaagtggtataccagagctttttcagcaaatgctctgaagatttgcacagcactaactaacttaatttgtcaaaagaaaaaaaagagaagtgcacttttgcatgtaaaacaggcacaaatatagaagctgcaggagatgtaaaagtgcaggaaaggttcgagcttgactagaatgattcagtcagtaaaagcgttgatgatataatatggcaattaattaaccactgatgcatatacatatgtgcgaaatgatagaatgaagaaataattagcaattagagtggagtagtagtaagtgaaatggagtacaacatgtaaataccttaccttgagaggctcagcgctgccctctgctaccggcacctcaggacggcctgctctgtcgcactgtacatgaacaattttcagttgagtaatctcattaatttgataaagcaggtaaggcgaggcaaagggggcatggtgaaagaaagaaaagaaaataagcttgccaggatgagggcattgcgggtggcgtgggaggtagtgcagttgccgaagatggtggtgagtccgacgaccttcacgccgggagcttcgaacgccatcatgatcgccacgctgtcatctgggaattgatatgaattagtaattgtcaagatggatggatggatcacagtcacagatgcaggtaggagaagtggagaaatcagaattagtgtaccgatccctggatccgtgtcgatgatgaccttctcctccgtcggcgggatccgatggccgttcctggcttccatcgccgcctcctgcagatccatggtcgatcgatgggttggttcctgatgagttggatggaggcagcagggcggggatgaattggcgatcacaacaactgggggagacgacgacgatgacgatgatttgacagatggtataatactagtagagtaggggggcggcgcgcagggaggaaagggtggcgctgactgtgccgtccgatctgtaactggaacagcaaggaagacgggatagatagctaagctgtcgtctttccctacctaacgtaggtgcgtatacgtacgttacgtctcgggtctggatggtgcacattcacatggatggatctcatcacagaatatactgcacgctccgtcttattaatcttattaatctgccatgccacacatcacacggggattaaggtaagattaatagcaatcctatattagcccataccagctacaatcggaagtaatgcacaccttatccaaccttctttctttttttttcttttgagaaaataatacatacccaggtgtccacaccacgcgcacgcacacgcaccccacacatatgagcacctccaaaaatttgtaccggcatatcttgagattgacaaagtcatcataaacgcctcactgtcgatggatacgttgcctaccactgaaaaaataattagccataaatgtgagcacccaaattcgaactcgggtggactagttccaccacaaagaactaaccagttcagctaatcttctttctcttttcccatttaaaacttttaactgaggatttggaagatttgaaaactttttaagtttagatttgaaacttccaacttagaattaaaaacttccaactcaaggtatgaaaacattcaactcacattttgaaacatttaactcagatttaaaaactttcaacttaaattttaactttcaattcaaaattttaaaaatcagctcaaaattaatagttttatttatttttttaccactcacctattttatgatttttatcatagaaaattaaacataagggggcttgccgcagctagcgctgagacacgtcagttgcatccctggcatagctaataggaaaccccaagattaacattctataggtgtaaacatgtgccgtgtcattgacgaactttcacttgtctttttaatacttattcctactatatatacctgagtaagttttagtgatttttgctaccgttttcttccacaaccatggagcccggggttggctccaagggtgagctcgacaaccatgaattgacctagaaggccttgaggatgccaagatgcaccaatctcgacggtgacttgggcaggcgagcatgagatggctatagttgagctcggggaaaaggtgatagagaaaaggagattagagggcatcaaggtcatttcctacctgtcttgctgacagcgaagagcctaagaatggcaaaaccgaaaacaacctagtgggtctggatggcaaataatcaaatatgatgaagagaatgacatttgggaatgcacacttaaagaggatggcaaatagtttaaaaaaaaccccaactttcagaggggggggggttgtgaataatttttggttggtttgatcttttagattatataggggctgttcgacaggctgactgcgagagctgcagctgcgcacagtgagtgcggcactgttcgtgccggctacggcgtagccgcagccctggcatccaaacaggccctaggtttttttatttagagtttatatagttttcacaaggtcttcaacaagatttaggataagcttgtctactgggttgctgatgatccaattagccgtgccaattctatggtttggggcactagtttgtttggtgataccggtttgttgatatttagggtgatgaagatggtggccgatactcgttcctagtattttttttggcgtgcgtcggagttgtttagtgttatacataacaagaagaagattataatttattttttatttaatataatctgccttgcctagaaaaagaaaataatcactacactagttagagcatgtatggtgtagagaatctactacttagttgaggggagggcaaaaccaaatcctgagcaggaagttaagtaaggctgaatcattccttccttcgcatgcaggcccaaaatatcccgtccgtttgctccatcagcacggccacagcccaaggccattactgggctgggcttgaccttcacaatccgagatgcagtactaagactgaattgcccctggacggagcgcggagacattgaaaacgtgtgagggtaataaagtaagttcgcgtgcggagaaggggagcacgcgacgcgaccactccccttctccgcctcgtcttcagattccttcccttttccgacccaaattactttttcctcccttccgattccgacctcaatatccaccttccctatctaccccgaccaccgcaaccgcaaatccaatccaaaccatagctcgcctcgcctctccgcctccgctccccagatctttccctctcgcacgcgtctcatgg

SEQ ID NO: 28314 - DNA, 868 bp, Oryza sativa
cttattagcagcagatatactcctagtcctagttaacagtgagtgaagtacagttggagttgatccccatttcgtccatagaagctctcctaaaagagacaacaagagcgagtgagcgagcgaaatacccactgccattcattctaccaaaccaaatcaaattctcgcttcttcttggacgccgggaacaccaaaccaacgaacaaacggcgaatccaagtttcgattcgattcggttcggttccaactccaatccgcggcgccggcggcaacaatggcggcgctccacgcactccagcgatctcagtggagaatgaggactgaggagtagtgatctcgaatcgtgcagagcagggctccgcctccagggcagaggcatgtctctcgcctgcgggctcccgctgctggaatgcgtctactgcctgggatgcgcgcggtgggcgtggaagcggtgccttcactccggcgaccgcgacagcgccacctggggcctcgcctccgccgatgacttcgcccccgtcccgcgcctctgccgcctcatcatggccaactacgaccaccacccctgccaccccctcgacgcccgctgcgtcgtccgccgccgcacctacgccgacacccgcgggcgcgtcaccccctacctcctctacctcgaccaccccaacttcgacatcgtcttcgccctccgcggcctcaacctcgccagggagaccgactacgcccttctcctcgacaaccgcctcggcaagcgccgcttccatggcggctacgtccacaacggcctcctccgcgccgccgcttgggttctcgacgccgagtgcgacctcctccgggacctcctcgccgaccaccccgactacaccctcac

SEQ ID NO: 28315 - DNA, 18411 bp, Oryza sativa
caagtgagcccagcgttggtcccccttttcaattcctgctatacttgcttattcctcctcaccattcctaccacatcacacttgatctgcattcttcatcttctgtctcaacaaaataattatagctccttattgacaggatgatttcttgcctcggacagccactcctttagaagacattttcaagtcaatcctatggtacatatatgcccatgcccaccaatcttttacaaaagtagcgttacacaattctacactggtcatacaaggcagcactatcacatatatgattccagtcacatttaattttccttttacagtaaataccatcactacctttctgcttgttaattccaattgtcgagatggcttccataggcagatcggtaacatatgtgctcatccattgtttcatttgctaactgatgtagttattacttaagctggcttgtgtggctaataattgcctgaaacttatgcgattgcacaatatttcttgttggatgtctatgtaagagctttgtagggacctaaagaagttgatgccgtttacttgtgattttcaaagttatagaaagtttctctgtttatacttcagtaatcacagctagtatctgacttgacccaagcaattagcagctaatagctgatatgtatagtatgacttgaggaaggaaatagaggatctgatggacagtgcaaatgcaccagtgagttagaaaagtggagatagaaaatgacatttagtttgggatggggtggttgatccgattttttctgtttctctgcttgtagcaatgctatgcagtaagttggatgtagcttcatttctccttccagcttattgggttcaaacaagtttaaacttggatcatctcctctttttgggcagcttgccctgcctgctgtgtatcagatgtttgagggacacttgcatacctgaagatgctatgttaaaagatccaagaggctttatgcaccaggtcggatatatcacattgtagagagaaaaatgttcaggtactcccttttttcttgtttgtttggtgttttacaactcaaaaatatcttgaggcccctcttgaaatatataatttgctgactgtactgatattaaaaggttaatggcttgtttggtaggattttgatagtagtcaggtctattagacatagaagagatgctatgctagtagctttgattgttgaactttattgtgccaagaggacgtgcaaataacatatcattccatttatgctgtccgtattaaattactaattcagctatttcaaactaacaccgctagccatgcagtcaatactagaatacactgatgtcccatgatatcaagtataccaattaatttgatctggtttttcttgataatttattaatgttttgtcttgttcagattactactcttttgttacaatagagatttccaagcatgatcataaacgaacttgttcctgaattccaggtgtggaagataccccccagtggtgaaaacagctgtgcctgtggatggtagatttgagcatatagttctttcctgcaatgccacaatggaccatgccattatttggatcgagagggaagcacaaaaggcgttggatgtaagaaaccgtatattgccaacctttgtttctgtggattacaacttacaagcatgtagcacaggcgtttttacatcccattgtggttgagacggcgtcgttagattcatcttgcaagttgcttgttaaatgtctgatggtgaccatggctgtgcatatgaacagttgatgcttgagaaggagaagacaatggaggtgccatcggagcagaggatggagaggaacgagagcctgcagagggagcacgtagaggagcacaaggcagctctgcgcagggctgtgacgctctcggtgccggacgctcggtcgccgtcggcttacggcaccttcggcgagcagccggagagaagcgagagcttcccgccggtgtcagcgatggccaggcagcgtatgagctggaacgacctcatcgagcgggtcttcgacagggacgagtcaggccacattgtgctgcgcagctcaccttctccctagctgtgcctgtacattccattccatcctctttcttcttcctttccttaccctggtatgcaccttttcatcatctctttttatttttttatgtatatgcaacttcaacttctgctgttattttttcttccttattattcattcatggtatctaccgacgcattttttgctgcccatatttctcttgtatgtatatctgcctaggggggggtacgcttttccttttggtttacatctttttgtgcccaacttgtatgctcacactagaaagaagaaaacattgttttctagaggaattgtaagccgttgttataaaatattcatgtaaaatatggggaaaactcagagaaattctcggtactgatgagcaatgcaatgttttgacagtaagaaacatgcatttctcatacactgtagaaaagacccaaaaaaaagcacatgtatgtattgtatacagccaagatcctcgagtgacattccaccaacaaatacaaacacatacaccgcgagaacctttgctaactccattaatgtcgcttgctccatgataaacatgcatcagcacattctcttcaatacagcctcaaatctttcagaaggataccacctgctcacccaatcctcatctcatgacaaatcaaatatgtctgccgcatcgaaagaaatacacctgcttccaacctcattccgaatgaaaccatcaattttctgcatgacaactctttgccaagggtatgctttacaccatggagccaaaccctctatagttcaaaaatctgctgatggtatactacaacaacctacgaaacaaaaatggcatctctgttcccccatcataagccataaggcctatgccaattacaatggcatgtatatatatgtatgtatgtaagaaccctgaacacaacttatacctgtagatcgagaactgcttcacctgcaaacaaacatgacaagattcataagtctgaggtttacgtcaggtggaaccactgtcagtaaacatggtctgctaagccttaccatgcattctcttaacgaaacgctcaaattccaaaaaattagctctctcgaagaggactttggtgagcctcaggtacgtgaatcctagtaaatgcctcccatctggatcattcagtggctttgcattctccaaaattttgttaaagccatctctatcgtagcaaggcagagcattctcactagctactggtatgccagcatcccatgcagcatttagcacctgaaaatcgatacgtccaattgataaggcattgacataacaacaagatagctggtctcagctaaacagaaaaaaaatacattagcctactaagctgctaccaggtagatgagaaagcaaaacagcaaccatggctaggatgatggaaagttccctacctgccatacaaggccctctggatctgcaaaggcctcaggaaatacctcatgctgatccatagtgcgcagttcaacacatgtaaagttcaaagctgcaccatgttttttcaggacagcagcaattgaggcataaccatcacggttgcatgggttataaaacccagcagtcaattcagcagcatgactggcagttttgtaccaccagtgtacacctgaaacctgtcataccacaaagtgtaaaccaagcttgatgtcaaacctataggattaggatgctggaaacagggatacgtgcccccagaagaatggtcaaatactgaaaacagttgtgcacttcattcattaacaacaagaagttaactgaccttaacagcaatatctgaaccttcaaaagccaacctggctaacatcaatacacggtcagcatgatccaccaacacctgggaataccaattgaggaaaaaacgaccatagtagctatcataatctcctccgtcagagaaaaatccagtcagatttggctcagaattataatggcctgcactgtctggcgctcttgcccatatggtatgtcctcgtgcttctgcagctcttcttaaacttttctgtaagtatctgtcgtagcactgcagcaaaatacattctcaagtgaaccctcttgttgtataagaaaactttacaagggtaaatagaaaactttacaagggtaaatagcctgaatctggtgctcttgcccagatcattaagtgacggttgtcaattcatcaatgagtagatattgaacccaaaaattgctgggtcgacggaaggattaggccgaccaaatttcattaagataggatattgaacccaaaaaagaacgcaggagaagaacagagtgtgaagggtgaagttttacctgaaattctccaatgccagggtatttccacccatgttttgctggataagatggatacctcaactctccacaagcccctagcccaatctcaatttctgaaatgataccatcctcaaaatattcatcaaattctactcggaagcttctcatgtagtcaaagtatacctaaatcaataagggatgaaacagataaacacataaacacaacggattgtgatcttcccattaagaattagtggattgcgtaattagagaagtgggtagaatacctcgacccctgtccgtccttgaagaaccctttctttatcaatgccccatgaaaggcactccgtgttacgcctgccagccctgtcggtgaagtagatatctggattgcttcttccgatctctgttacccaatgtgggagaggaatagacacatcatctccaacattgcctccacactcatggaatgacatgaccacctaagtaagtattttgacaagaaattaaaagaaacaccatgaaagaaagggtaaaattggagaggataaatgaatagatcctgtattagcacggtactgaaatctgaaatgcgcataaacaccaaaacatgattaacaacaaagggtgacatgcatgacaatataatgtggagtggaggaataacctgcagcttgagcttgagctccctgatcatatggaagagtcgcttgtaaccggtccaattgtactcctgcggcctgtgggcctcgacattcccccaccagcaatcgaccatgaccccatcgacgccggcagccttgagtacccgaagctggcccaccaagacgtcggcgtcgaccacctcgccattaccattgaccactccaagctacagacagcaacatacatacataagagcgagcggcgtggtgcgaggaaaagaatggaaggagagatgtacctaccgggagcatgacatagacggggacgtatggcgttccggcgaagtcgcgctccggtgggcgcgggggcagcagatcgggcacctgcagtgaagccagctaggttgaatgcccgtacgtaacgtactagtagtagctgatagaagaagaagaagaagaagaagaggtacctcttgggggtccatggacgggagggagaggagcgggtcggggagggcgtgcggcggcaagatgatcctgatggaggaggaggagcggagggaggagatggggcgggcggcgacgggggagatggagatgccgcggaggggaggcgccggcgaggaggggagcggcggcgcggcgatggaggggcggcctggctggaggaggaagaagagcgcaggagaagaaatcatgattattatgattagcccaagcgaggggaggcgctcgatcgttggaactcgtaaatataacgattagacagagagagagagagttgggagtgtgcgcgcgcgtttccagggaagggaagcctacggaggccacgagagaaggactggacgtttcccaaccacctttcccctttgcctcgcgcccttgcccttggccgtgcgtcaatgaatttgccacttttctcttttcggtctcatgtgcaaaccgacggtcaccaaactttcaattttaatttctaaataaatcatttctaataaacgatctttatatattgtgtgcttaatttggacggtggtagccctttaatttcggcctgtctttttacttgcaagctgtaatgctccgtctttttttatgtacctatttaattcaaaattaccataatatgaaataccccgtctctataatttcagcgttatatgtccttccagacaaacatatgcttctccgtaagttggatacggaagcctgatttaaaataataatgaatatatatctactctccgtgaggcgaaaagggctcataaatgagttatgaggggtgcttttgtcatcatcacttgaaaacatatctcctacagtaccggatgcgacctatttatgacgtcaaaaataaataaaataatgaaaggaacagggtaaataactctccggtacttggcttccagctcactgagctcaggctcagctgcctgccagccagctttaaacatagcagagcagaccgcctaagataaattaaaagtggaaggtagggtaccagacagtacccatttgatgatgatttgttgggttcatccataaagtgcagaggatgttttccctgttggaaaccgtataagcaatatgagctcattttggtcctgtgttttatcttgccacacttgacctgaggtttaaggactagcttatctggtttaaggcatccgaacacaagcaggttgtagttgctgtaccgccggagctccgccaggatccgctcagtgatcgcccgccgttgccgctcccgcagcttagtccgctcgttctcctcctgtgccagcccccgcagccccaaccccacctggtgctgatgattaagcgggggccgagtctcctcctccccctcgtcctcctcctccaagtagtactcctcttcttcctccttcaccccatcctcctccatcgcctgctgctgctgctgcatcgggatctcgctcgcgcgtgtgggtgtgtgtgtggatccaaatgcctagctagctaggggtcgactcgcgcgtgcgaccgtcatatggctggcacgctcgcgcgtgggagccacacgtgcctcccctcccctccccgtgggaggaaatgccgaaatggatagacggccaggatacgatgaggaggagccttttcctcctgcatccatcctcacaccaccattccttcattattcgcacgcacgcacacgggcggccagactaaccaatacacaaaccgcttcattactcaataataatcattgtacatgttgtaattcctaatcgtatacggagaattcagtattgttttgctcaatcaaagagtaggcacatcaagctggccgtaaatacaacacgatccaataggtacatgccatcccaaactgactcattacgtatatagctctaagccctgtttagtttataccaaacttcccccaaactcccaactttccataacatttaaaactttcctactcatataaactcccaactttttttttaaactacaaactttccctaaacttctcctcaatttcagaaactaaacacagttcgatggcaaatttctcgacaaacatgcctaaaaatgcatcattattgccttgtgcacgaaatttcctactaccatattataatcttattaggcaaaaaatggcacaattgtaagccttatattaaccttataagtataaaataacacaaaaatgcttaaattgcccttcgagaaaagaacacacacaacaccaaatttcacgagtaggaaactcaagcctaacaaattgactaatttgactattagtcctctgtttaaaatttttagtcaaagccttttttaataaaagtattatactcgaaggacaaaaaaaaatcatgacttttagccttcggattacgtgagttatagttttcggtgaaaatgaatgagtattaacattttggatatttagctttaccctatacttcacaattattagccttgggccattctaaaattcgtgaatagtaagttttgggaaagaaatgattttttgccttcggcctataattttctcatttgtagccttttggtcgaaattcatgagtactagcctttgaaaaaaaaagtatgaatatttttcagtccaaaatttcacaagtatttgcccggggatcatttggaacaaattcatggatattaaccttaggttttttttttaccttcgcctatacttacataagttatagctttcgtccaaaattacctttggaaacacatgattatttttcttcgacccaaaattttgtgactaatcgcattgggtttgtttcaagaaaattcatgaatattatctgtagtacctttttttgtgatttttggcttcgaccgataatttcttgagttatagcctctagccaaaattcattagtatgaactttggaataaaatacatgaatattttctatggcctaaaatttcattagtattttgtattgggattgttgtgcacaaaattcgtgaatattaaccttggaaacatttttttgttgtgttttagcctttggcctataattatgtgttatacccttgtgccgaaattcatgaatattaacctcttgaaaaaaaagcatgaatattttttgtggtccaaattttcatgggtattagccttgggattattaggcagaaaagtcgtgaatattaaccataggacaagaaactcatgatttttcccccaaaatttcataactattagccttgggtccgttcggaagaaaattattaaatagtaatcataggacgaaaacttttgtgatttttagccttgggcctgacattttggaaaagaatgcatgaatgtttatgtccagcccaaaactttatgactgtaattagctttgaacctgttcagaacaatattcctaaatattaacctgtctcaaaagtcaaactttcattagtacaacattgaacccaattacgtgattaaccttgggttaaaaatgcttgaatattcgcatatggtcaaaagtttcatgggtattaactttgggcgccaaaacacaaagatattagccttctaatacatggattttaatcattcagtcaaaacacatgtaataattcttcgctttgggctcgtgttaaggagtgataattcttgacgataaactaattgttgcccaaaatcaaacaaaaaactttcctttccatcaagtgtaaaacaagactgcttcaggaaaagagcatgtatgtagcatagtatattattatggaatcctctaattttgcaaccaaattgttgcccaaaatccaaacaaaaaatttccctttcatcaagtgtaaaacaagactgcttcaggaaaagagcatgtaagtagcatagtatgttattatggaatcctcgaattttgcaatcgaattggtgcccaaaatccaaacaaaaaacttccctttcatcaaaaggtaaaacaatactgcctcaagaaaagagcatggtagtagcatagtatattatatggaatcctctaagtttgcaactgactaacatcccagttatacatttgttaggaactgcagtttggtttatattccatcaagtattcagacagttcccccttatctgtgaggtacagtgtatatacagtgtaagttctaaagaaacatttacatatcacagtctacggacggattgattagaaggaatatatggcccttcctgatcattgctattgactgacaatcgtacacatgtgcaggagcggaatcaatcaaatttacaatctggcttccttaccagaacaaatcatctacaccaactgaagttgacggggacgaatcttcgtcctcctcctcctccatctctggctcaggctccatgccaaactctggagactcaatgtcagcaaggttcttcaggtcaaccacagagagctcatcaagctgcttcaccacaaggtccgcggcattaagctcgtagatcgggtgcttgcttgcaacagccacacacttcattctggcatcatgtgcagcctccactgctgaattggagttaccaaaaacgatgcacctctcagggatgaaactcaggagctgcgctgcatagagaaacatttcagggtcaggcttcccccggtacacatcctctgctgccacaactgcatcaaagaagcttcgcacgccaacagcgtcaattgcttcttcgataaccttccttggccgcgtggtggccacggcaagagggatcttatagttggcaagcgtgctcataaactccctcgaaccattcctcatttgataaaaggcagttccacgtagggtgcagcgtatctcctctttccgtgaggacaatctccttaactcagatgggtcccgagaccagcagagaccctcagatatcgcttgctcgcttttcattccttcaatcctcttcaatacaaacgccaggggtggagacttgccctcttcttgcgcgagggtaaaccatgcctgcctttccaattcagcgtcatcctcaacaatcacgccttgccactcaaagatcacttcgagccaaccacagcccatgcgcttaagccggagcagcgggttgtgcagcttgggatcaatcggcctggtccggggagggccacgttgttttgggattggtgatcccaatattggccatggaaacgccttcccccggggaccccccggactccctgtgagggctggccttcttggtgacccccatggcgagcgccttgacgggccactcccggaggcgaggttgatgctgcctgtgcgcccctgccacaaggcggcgaacggcgaaatgagtgggcagggggcgggaggagaccacatggagagtcccgcggaggtggtggtttgccttggacctttggtcgaacaggtggtgggcaacgagggaagtgctggcgctgaccgtatcaaccaccatcatgggtggatccgacgccttcgccccacctagcgctcaagaattaaactcggtccgggaaccaaaattgttggagaggcctagccaatcaatcaatcgatcaatcaatgaatcgaaggggtggtttccttgatccaagctgcaagaaattaaatcgcacgttgagaagattgcacgataacgcaaagaatcaaaaggccctagggatcgtcctaatcacggaaagaaatcggaaaggttgaatcgaatttgattcgacgggcgtctggaacagtagaggtccgattggagggggagagaaggagaggataaggtacctgaggagggaggcggcggcgactggtcgggatcggagtcgaacggcgaccggaggaggaggaggagatttcttcgggaagccgcctaccgtgccccgcctctcgtgtctagcttcttctcgctccgcccttcctaatttctttcctttgtttttgtagaaataaataaatgaaataaaaattttgtgctattatttttatcagcgaccgctcgctcgatcgttggagacgagccgtcgtggaaggcgaaacgaatctggccccgctgcgtgacgcgtggcgcaacctgaggcgtccgatggggattccgcggaacgtgaggcggaggttgcattggaatcactccatcctacgcaactctcctcgcctcctccatcttatctgcctgtgcttttcttttttccttttcttctgtgtgttccttcattgtttatctgctacacatacactacacttattacttagtccattgatattacataaaaataataatattaattgttatttaacttctacccctccgtttaaaaagagcattgttccatccgtttcgtattaaagtttgaccaattttatagaataatatagcaacacttatagcacttatttagtttaattacatctaacattgagcatattttggtagtttatatgttttgtgttgagcaacacttattgcttttttttccctgttagttcgagagcatatgcatgaagtcagtaattaagttccctgcaaaagaagagagagagagaaatcagtaattaagtggttaagaaaaagaaatgaaaattaaggaagccgcctcgcgttgctactagttgcaaacgtgtggtaaatattaaagtcagagagtggaaactgcagaaacaaaggcaggaaaggccgtcagtgtcgtcgattcgtcggtactggcagattcagacgaccacatgcatgtaattaaggacgaactatatttactaataatttgattatctacctataggggtatagtacatggttgccggtcacctctaaagaattcaactgtgtgggatgaaggcagcatatgcaggaatcacgtcctagcaatgactagattggagtaagttttgttttttaaaagcgtactcgatcgatcaaataataaaataattagtattagtaagagcaagtttaatagtatagccaactactagctccaattcatttttagccaatctaatagctcattcatacagaagtttcatactacactattaatacatggtcccacctatcatacacacactgtgtcttggagttcgtgctatagctgcctataaatctgtagcccgctactgttctctttccttatttatctcgttaaaatatatttgcagctggcttataatctgctattgtacctgctgtaaaaaagggctgggccgctttaatttgtttcgtttgggccggggccatgcgcccacgagcccacgaggcaggcaggcaatgtcaccagccggaggtgatcgggatcgatcgctggccttgactcctcgtgatcgatcacctcaaccgcccgctaaaactcaagtcttttccctgcctggagcaccggctccacggcgctcatgcggccatcgatcctagcttatctagatggagtaattagtttgaactgcagttaagctcactatttgcggttattattatctcatcgatagcggtttgataattttcatatggtagcggttttaattgtggcccttatgaaacaataccacagagctacttctgctgctgtgggatttgtgcaatatagagatgcgtggccaaaatatacttgcatattgcatccaccgctcgtagatgatctaaacgatgatttgtttgacacaatactagctccttcaacgcctgatgatggccataaacatgctcttcatgccttccatttactagtaacacgaaccatagctttgtaaagtcctactaggcagcatatctgaaacgactaccgagtcgctgtctgcacgagtagtcacagccatctaatttggtacaaaaacctggtccacgcaccatatcactgtcaatccgataaacacgagtaattttgaggcgcaaacgactcaatgatcattcagtaaaacaagaaaaagaaataaaaccatcacttgctgaaatttaaaacaacacttggttcaaacaaggactagaaacaacgggatttcatgtactatcttgtatccgaattcctcttcaatcaaaaggatgcagcatcagagaacagtgccaacagtcaaaacagggcatgaagaactgagaacatatctcgggtgcatacttgaaagttttagtgatgctataggaaactcagtgcagtgtgttcagcatttatttctaaacaagtaaaacagggtgaaactcaatgacagaccgtctaggatctcattaaccaccttcagtccactatatcttcagacttcttaggctttgacaagagataccaccccaggccactcaaagcagcaacagtgcctgccaggacagcatagttcctgtttttgtcagttgacacaccagcagatcttgactccgttgagccgcttccagtcttcacagcgttagccgcagcacctgcggttgaagcttgctctcctgggttggggccctgaaagtagctcacatctattgtaagcgcaagaactagaacagtttcatttccctcgcccactcaaagcagatactagcttgtattaagttcaaaacatgaatatccaacgaaaacaaattttataaatgtatgacaacatataaaagaatgcataatctcttgtgcatgacaaaaaaaaaaagctgagaggacttatgagagtgagccattaaaggcactgcccaatcaagttttaagagaggcaatatgtttgcataccttgtgggccaacttctccagcttctcgtgttccattttctgcagtaagtcaccatgcatgttgttagcatagcgtcaagatacattctaaaacagaagttcgcaacgattaagaaagcgggtaatttcggaaaaggtttctatttgaaagaaacaatgattgattctaaaagaacatctacatctgtctgcagagttacaaaattccgagcatcaaatgtacttttagatatacatttgcggtccttaaaggcaatcaaagaacaaaaggaactaaaaaaaggccatgccttaaaaagaagaaactaatatcacaaagcataagcatcaacagtcagtcctgagataagactgtattcacacttccacagaaagccaagcaaaatatgggatgccagcaacgatccaattgaaacagcagtagtacaaatacataatggagaaaacaaatcagtgccagcagtacgtttgtgaggatcactagaataacatcaggccagctactgcagtgcttcaaaagagtataattgagcaaccggcatagaagatcacagatatagataattaaaacaagaacagcttgactattgtacaaaatgttgaatgagtaatatttgaacgatcttttttataaaaccaggagaacaaccctgctctgcttctcatgaagaaaaaaaaaacccacataaaactgaccttaaaccaattgttttaagctatttgttaagttcatttctcaaaatatttaatttgtccctataatcaagtagataatcggtggcaacaatctactcaataatgtaaatcaaacagggtatgttcaagtagcaagcaagaatctgtctcaattaggccaaaaaaaatgcaagaataatctaacaggaaagaattttgatgcaacattgcaaccgcaatagcatatgtgaagcaaggcacagggtgaacatatatcagtcataaattgctgtgctaatggatgagggacgcaggcaggacgacagccaactcaactgtattccagatcagtaaacaggcagacgtataatatattcctaggcgtgcactgcaacaatgcaggccgaaaatatttggggatcccagagctgagtgcggtgcgggcagggggactcgtacaggaaagaaagagagaccgcgtcgcgactctctctctctcaagtcccagatttgcggaactaggtgaaatccacacaccgctcaacccgagcccacagatcacagcgcatacgcatctcagacaggaatcgcgcgcccgcacccgagagggagagagatggaaggaagataccttgatgtagacgttctcggcggccttctcctcctcgccgagcaccttgccgccggaggaaaagagcctgcgctgcacgaacctcgccgccgccctggatggagccctagccgccgcctccatcgccgcgagaaaccctagaacacgagacgagaggatcttcgcttcgttggctccgtgaaactgtctctctctcccaactcccccactgatgatgatgatgactcgattctattccaccgctgctatgactccctgtgctactttgtaatttggccctttcaaatatgcttatttgaaaacattctacgtagtcctcccctcagggatggttaacgagtattagaggtttgtgtgggacttggatgaataatactccggatcagatcaaatccgacggccagaaacgcatcggagcgctgaaaccctagcctccccacctcccaagtcatatacctgcagcctcagcctgctcctcctcgtcgccgccatccttgccttcgcctgcgccttcttccgccgccgcatcgcgtcgtcgaaatggtacgcctcgtttgtctctcccaccatttttgctcgatcgccggctgcgtgctgaccctctcgcttgcttgctgtctcaggccccgaagaaggacaaggccccgccgccgtcgtccaagcccgccaagtccggcggtggcaagcagaagaagaaggtcatctccattcctcctcctgttcggttttattcggatctggcttgttcggttttctcatggtcatggatttgcctccgtttggtttgcagaagtggagcaagggaaagcaaaaggagaaggtgaacaactcggtgctgttcgaccaggccacctacgacaagctgctctccgaggtgcccaagtacaagcagatcaccccctccgtcctctccgagcgcctcagggtaattcattgataaatttagattaccaccaacaatactgtgccatgctggttgcctagctcacattctcaatttcttctttgtttatgcgcgccaattcagattttcactatattttcacagtcatgtagcctagcccacttgatagaattcaggaagataaggaccttgtggttaattttaggctcctgtgctaaatttgtgggttatgatattgatattccatccatgagttaaatgcagaatcaccactgtttggggtattcggtgtcatggttggcatttttgtgtggttgagtgatgccaatgagcaaaggagtaatgatttgttaggcctctgtgcatgtttgtttggtttccatgcgccaaactatatagttgatttgtgaatttttattagtacctgaaactactgttattagtatggcaagtttgatcttgctcttttccccttgcatgtgcaacatatagcatattctcttttggcaatgtaactcttaacgtcatcattgttgttttagccttctgtgtaatttatacctagatgttgtacagctaggtaattttaatcatcttgctcagtatgggtaccaagattttatatatttacctgcagattaatgggtccctggctaggagggctatgaaggatctgatggatagggggcttatcaggatggtgtcggttcattgcagccaacagatttacaccagggcaacgaacacatgatgttgtcttatccattttctagtcttatagacctgatgttgccgttctgttaagtttattcagtgatacatatgtgggtgttcatttgccccagtaatgttgaatgttttgagatttttggcacattgttaaggtgatgttatctcggtatctatcttgattattgcccaattaaattgcaccttatacggtgctactgctgtgtcagtttgtctggtgttttcggttccattatgccaagaattatttctgcgtcaactcagacgcattgtgatctcagtgggctcggccgtgttaagcctcttccaaagtcagctgagttgtgcctgccctggatcatcagaagctagtaaacatgtcattttacgtcttgatttggtggagcatgatagcgtattactagttttcgctagtactgttatcagtttagaagccatttgtttggcgatgaagctattaatagcttttagcttgttgtgtgctgtttatcgcgagatgttgcacacgaaaatcgtcttgcaaagcatcaggaacctggtttcaagggggctgacaaggtagatgtgaagtcgattcgatattgcattctttgtctccatttttagacttgatgttgccattttgtaaactgtggtacaaatagattagactagttcgacgctaaactctacttgtgagatatttttattaaacatccagtatttactcaagtgaaggctttgcgatgcctggcacatgcatgatccttaacttccaagtcagattgtattatgccagctccattctgaaaataattgaatgcaggatatgcaattttgatgctagatgcatccaaggagcaagctgtcaaaagccttgagtgttgccatttcgatcgcacaaaagacagacggcagcattggttcctccaattcctcctggccaagagaaaagcttcttataaattgggttgctcatcatctccatggcacaagcacaagtgcacaacccaagctgcttattagcaagatcatttagcctccaaagcttaatcaagattcaggccatctgacctgatacaataatggcatcctccatcttgctcctggtggtgcttgcagtagtgtcagctccagtggcgctggtcatggccggcgacccaaacattctgacggactacgtcatcccggccggcagcaacgccgagaacatcaccggcgacttttttacgttcaccggcttccgcaacccgctgagcatgaacatgagcatgccgatgcccaacgccaacttcacggtgaccaaagccaccaagggcgagttcccggcgctcaacggccagagcgtcttctacgcc

SEQ ID NO: 28316 - DNA, 16689 bp, Oryza sativa
ttcggcacaaacatcgacgacgccgtgctcgccaagtcgttcaagaccgacgtgcctacgatccagaagctcaaggcaggcctaactcctcccaagaaagcctaagccctccccgttggtgttaattattcttgtttttcatcctgctgctgctgctgcttgaaataagagaccttccaggctaccaactactgaagaaggtaaattatgatttgtgtggtgaataattctgaattgtggttgtattgtcttgtctgaagagctttgaaccatgtatctatcagtattaattaaggcgttgtgggaatatatatagaccagttcagttgtaagtgttgagagtttctctgctgtaacggctttccacaataatgatacatctcttaatactgtgtgtttccacttactacctgttactggcaatagtaaatttgtgttgcaatcttactcaccttcttatatgctaaatctgcatatatccacatatatactcagtcagacagtcaccctcttatatgccagtctgcatatatccacaagacagaaatattgatgatggtcagatggataacatggatctcaatataaacaactgcaatatgcatcaccaactaaaactaagaatttaacatctgttatgtttctcctgaatcctaacatataagccctcaagagtcaagagcaccattctagcaacccatattcagagcagttctgttaaattacagtgggctctcaagttgaattctcttatagtatcaaacaaagttaatttatactagtaatatacatcattgcattgttacatctgtctgaacaatgctcaacaccgagtgtacctaccaacgacgtccatttccattatcaaagcttatccattgtttgtctcagttgtagcatgccttttcccgtttgtggtttctacagttcactgattgcattttacctgttcatctcacatgctttgaatttccactctactacagtagctaaaaagggaaacttccaccatcctcactgccaaacagtagctaaaaagggaaacttccaccatcctcactgccaattggtccatgtatttaccattatgacaaacaacttcaaatcttcttttgaaaccgacgggaggagcactactggatatattaaggaggagcacagaagcctaccagaaggcagtacagacacaaacaacttcaaatcaaaacactgaggacaagcacgcaaaaaacaacaagtcttggtgtgtaagagttaatagacctgcattgtttgataattcagttgaactagaaaggcaactggaccgcacagctgagctgagttatcaatggaagatatgtcattcctgacgaagcagtagtgaattggcaatgagatattcttgcagtgcagctgtaggtgggtaggactttgatgccttgggatgacatttgctttctcccttggtttctcatcatgcatcttccttgctattattcatagtaaacaaccaggggaatgcagaatacgtccaagataactgatggagttaacaatctgacttcctaatttaacaagctaagtagcatggcatcagatacgtattcattctcggaggccagaaatctaatctgttctgttctgttctggacgggcataagttttaacaggaacctctagctggctagtttctttatcttgatgcaccgatctttcggtcgtccaacaacggaagatgaatgattaatttacgcatagtatatgtcaatttcaacctcgatttctccggcttatcgtcagacgcttcttctgcataaatagccaaatcctactgctcactgtctccataacacaagtagattgaagactagaccacatcagtcaaattaaacttcgtcttaactcattacttactgacagtttagcagctgatcgaacgattaaaatagattcaatggcgttgagctactactctttgctactattgctgcttgcagtttgggccccagcactgaccctagtcatggccggcgaccccgacatcctcaccgactatgtcatcccggcgaacggcaaccccatgaacatcaccggcgacttcttcacgttcaccggcttccgcaaggtgttcaacacgagcagcgcgccggaaccgaacagcttcaccgtgaccaaggccaccatggccgagttcccggcgctcaacggccagagcgtctcctacgccacgctcgtcttccccccgagcaccgtcaacccgccgcacacccacccgcgctccgccgagctcctgctcgtcgtcgacggcgcgctctccgtcggcttcatcgacacgaccaacaagctctacacccaggacctggccgccggcgacatgttcgtcttccccaaggggatggtgcacttccaattcaactccgggaaccagccggccatggcgctctcggcgttcggcagcgccgccccgggggtcgtgccggtgccggtcacagtgttcggcaccggcatcgacgacgccgtgctcgccaaatcgttcaagaccgacgtgcccacgatcctgaagctcaaggcgaacctgactccgcccaacaagtcctaattagctactcttccttctctcgccattgtcgtatgtcgtcctgttggctgttactagttgaataacaccaagcaatgcagacatgcagtgcaacgcaaaagcgtgacagatgaaaatgctgcaagctgtagtgtggccgtacgtgggaataatcctcgacctcgagtcgagtgtgctagtatatatttatgtatgttttgacttgagttgtgatcattgaaaacttaattcgattgagatatgtcaaaattgaatttctgtttttccctttcttttttgagtcggcgattgttctattcttgtttcaagtaggcatgaccagctagcgcacacttttttcttttagtatcactttcctacgaaactttccacttaaaaccatgtgactttcaacatatataaatcatacaaaactttcaactgtcgccacgaactttcatttaaatacattcatctcaaactacagattgtatagtttaaatccctaacaacgatgtcctgttggagttcttaacgttgtagtgatgtgattaagttggcgctagttctacgataacttcatcatataatatatttttgtgattctctatcttaaatctatagtttcatgataaattaatttgatgttaaataaatatatatatatagttgtgtgatagtatttgttgttttgtgattttttttaagaaaagaatgactacctagtagttgttgcgcacatgcactttttttttttgaaaatagattaaaatccggcgtctatatctcaatggatatacacagccatgcacttggtagctgcttaattacctctaataatttaattatttgcgtttggaaaccgatggatgatcattcttcttgcatggtgcaatatgctaatggaaaaggctaaggtgtagtgcacacaagagaattaataagaccactaaacccaaatgccttggaaactcgatcgattgttttatgtatagtacacaaatgcaaatgcatattctatacagcaggaaagctaatcagacagcaattaagaccaaatgttgtagttgtttccaaagcgagcaaatatatggcggcacaaggcgccggctaatatactacacatggcagcttgatcaaactggtccagtaattagtatttcaacaatgtttgtacactgggggtctggactgttagctctgttccgaatgacgacgtacgcacgcacgtatgcatatgctctcatatatgaatgtagtaattaatttatttgtgaaacgacctaggaaacgaaggaatcaactttacagtctgatcttttcgcgtaaaccttaacgtttatttgtgataaaaaaaataaaaactttatgcatgtgtgttcctagtgatttaaaagttaatgttgaaaaaataaagtataaaaaatattgaaattatcttcaaaattaaaaattaaaatttaactttgttgattgtggctaattaataagctgatgaagagcaacgatgaagctgtttacatacatgacaagccatgcagcatggtgacagcttttcctaagccgagccggcgattctacgcacataaataccaccgtacgtctcgctcgttcatcaatttgcggctgcctccacctcgatcgatccatcgcacactaactaacagagctaagatacgacgatgatgatgagtagccgcagcagcgtcagcctcggcgtgctgctcctgctggccgtgatcctctccgccggcgccgccgacccggacatcctcaccgacttcgtcgtgcccagcgacaccgacccatccgggatcgacggcgccttcttcacctacaagaacctcgtcaccggcaactccggcgacccggccaagctcaccgtcaccaaggccactcacgccgagttcccggcgctgcttggccagtccgtgtcctacgccgccctcgtcttcggcgccggcaccgtcaacccgccgcacatccaccccagggcgtcggagctgctggtggtcgtgcagggcccgctgctggtggggctcgtcgacgccgcccgcaacggcaccgtgtacacgcagacgctgcagaccggcgacatgttcgtgttccccaagggcatggtgcacttccagttcaacaatggcaccgacgtcgtcgcccgcgccttctccgccttcggcagcgccacccccggcaccatctccctccccgccgcgctcttcggcagcggcatcgacgacaccatcctcgacaagtccatgcacaccgaccaggccaccgtcgaccagctcaagcaagaccaggcgccgccttcgccgaggccctcgccggggtcctcctcctccgccgccgcggctttgctgccgtcgcgctgggccatcaccctgctgctttgcttcgcagcctcctactacttttacttctagtgagttgtgagcgaacctgaacctggagctcatggctgttgtgtgttttcatcaaaccatcgtcaccttcgatctgttggttgcaaataaaatgaaatgaatgtttaattttggcatgttttctgaaatccgaatcatgccttaattcctgctgtaatgtttatgcaatattgtaatgtaagtgctctccaaaataaacgatcgagtactgcttaatttccttctgatcagtgcagattcttcgctcttcaagtcatatcatcaaaagtctatttcaactttccaggacatgagtagtagacactcacataacgaaggaatttgtctgccttgaaattcatcaaacaaaacgacagaggcgttccaatctgcagcctgtaccacaagagctgtgtagccaatcaccacttgacaacacacgaatcacacgtagtaactgagatggcccggttataaacttacaatttgaattcagatcacagcatggtagcaaccacaaacaacaatgaggggcaaacttcgaaggggacaaaaattaaggccgggccatataaccttgactttgtagtcaattatgtcatcaaaataagctggagtactctccagcgtaaccaaggttaacatacaacaggataaacagaaagttcggcatacaacatgaggcattacactacaaaaaaacttaaactctgatcttcctgttgatttcaatgatccgcggaaatgatatctcaaactctagttcttgatcttcttcttgggcctcagctgaaagggtaggaatttgaaagcacgttagatgctacagtagataagacgcatttcggcgaggatatagaatacttgtcaacaagctatactaaacttggttgacatttcaagtgcaatttctcacaacagtattaaaaaaaatcacaaatctaaggctgatgtaaacctaatatgctcaacacactacactacttcaaacataattagagcagcagacttgcaccgctctaaattgcaagggtcaatacaaattctaaaatctaatggtgcccttagctgttgctcctattactaaagaacattggtgccaagtaaacagcaaatctaaatcacttgcttgtatagaacaatgataatcacctggttgctgtggccgcacttcttcttgcggcagttgacagccctggggtgcagccgagcatagcacctgcaagaaaacagtcgaaatgtattcacatgctgaactcagtctaccctaaaagggagcaatatcaggaaaacagatgcagcactactgtgcctataatacatgatggtactactggcataacattagcaaatgacactaactttctggcaaggcatgccagtccaagcatcagagccaaacacagtgaaaaaatgttttgaatgttactagattggcaggtcagaaagtaattatgcctcaaaagttttagatcataaggtgagttcacacatctaattgattcatcatcccagccaatctgctaatttccacatacatactacatggcactgctggacacagcaacaaaatacttgatgatagaacttcacaaactaagagtcagtgagtcactcatacctagcaataagataacacagggtatattaattgaataaaataatacatcctagaagatggttaaaatgaaaaatgtgcctcgataggttagctcacttgaaatttcaagtcgaaaagtagtgtttttatcttcccaaaacatatggtaaagctcacaaacaaatgacaaaaaaaagcaacttgctttgaaacatagatgagctgattggcaggtcagacagaatgtatgcctcaaaagttaagctcacaaggagacttcgcacatctaattgattcatcattcctgccaatcttctacgcagttccatgtggtatgacaacgaatgatttaacatgtcccaccagtgaaaatcaactaccgaaataggctaggcagcagacaaagtataggtgggttgtcaatctctggacccatggggaacccaatgccacgcgtcatagagttacaaaccacagatccaaccctcacaaggcaagcatcatatcataagcataataaactataggaacatataaaggagtatgcataatcaaaagtcgagcattcaaggagaaggaaattagaaggagcgtacttgcggcagatcatcttgtcctgattgtacttgcgggcgagggcctggagggagggctcgatgatgccaccgcggaggcggaggacgaggtggagcgtggactccttctggatgttgtagtcggccagggtgcggccatcctccagctgcttgccggcgaagatgaggcgctgctggtccggagggatgcctgaggccccgcggagcagatcgattcgcaatcaagcaggcaaaagagaccgagcaagaagaagaagaagaagcattgctaaatgctaagcaagcgtaccttccttgtcctggatcttggccttgacattgtcgatggtgtcgctgctctcgacctcgagcgtgatggtcttccccgttagggtcttcacgaagatctgcatcttggctcttcttcttctccttgctgctgctgctgctgcgggtgtggagcaaggtcgggaaatggaggcggcggctgcggctacttatatgccggcgagggaggaggaatcgggtcctgtcctcctgtccatgctagaaagagagctagggtttatggtgggccgggctttgcttttgctttaaacatttgcgtgggctgaaaccggcccgttgctggcatcagtaacactcacccactttttgaccgcgaatccatctgagttacttccaagttgactagttacctcttactacctgtggaaggggaaacacattttgttcttcgtagtagctgttcttactgtttgtaaaatgcttgggtcagttaaatgttccagagacaaaagttcgaatcgggtgtttggtctagtggtatgattctcgcttcgggtgcgagaggtcgcgagttcgattctcgcaacaccccatgttttgtctaattttttttaaaaaataggaattggtctgacatgggctttgtgttcatggccctctcctctttcctggcccatctgattcctctccctttttctgtgtccccgactcaactgtacatgtagtcctggtgactggtcaaagtgatgtgtgcataatctcgacccggaaccggaagtagacaccatcttgctttcacaattgtggtttagatttagatttgttggagtgtgtttttagagtgaaaaatggaactgaaattctttagtgctcgaaatgaaaatggaatggacagttgcttgttttggtagtgcgaactcaagcagaagcaaagcgcgggaagggaggggggaagaagagacaaagcgcgcgcgactcgtcaatttttcactaggctagggtttgccttgtcgaatcgccgctgcaccaccgttcccaacctgagaaagagagagagagggagatggctggggagacgggggaaggtgggggatcccattcccaacctgagaagcagccgggccaagcggcggcggcggcgtccatggcggaggcggaggtggaggagctgcccaaggccatcgtgcggcgcctagtgaaggagaagctcgcccaggtcgccgccggaggggccgaggtcatcgtcaacaaggacgccatgtccgccttcgccgagagcgcccgcatcttcatccactacctctccgccacgtccgtaccccatccccccttcgccttattcttccttctatctatggatatggactatgaatatagatactcatactgatatagtataactttcacgtttttggtcatggatttcatgtttctgtttaatctctaggggtttgggggagaaagctattagtgaatttatttatttcgctgggtaaagctaagtgaatttatgctcatggccagaattgcttgacattactttgggaaaaaaattattgacatttgatggtgcaggtgatccacgatctgcatttgttcataaactttcttaactctagtaatgtacttgagggtacaggcaaactcataagaatcatttttcttcccttcgtgaacattttctttttttaaaaaagaagactttttgtgtagatctattagaatcaaactgcagtaccatacctctttgtaagtattcgtgatgattttatttgcagcgcctttacttatagaaattgtttgcagtgccaatgacatgtgcaaagaatcaaagaggcagacgatcaacgctgatgatgtcctcaaggcactcgatgaaatggagttccctgagtttgtagagccccttaatacttctttgcaaggtcaatattgtctacttccattcagtgtttggtattacaaatgtcaaatgtaggatgaagtgccacatgtttctactcagtgaaatacttagttattttagtcctttgccttaaagatctgagtgtttacaataatataggttactgaactttaatattcgtacaactgagcaattccattagttactatatgtacgtaactgcaatcacttcaattttcttggggtctcacagcattctgtttgatcctttctgatttagagatgatttgttcgtctatcagaacctttaattgtgtctatctatccaccttacacaagcttttttcccccatttgtgccatgcctctttcagaatttaggaacaaaaatgccgcccggagatcagaaacaacccaaaagaaagctgaaaagagaaggaaaatagataaggagtcactgccacaagaacaaaacgatgcagctgatcatggcaagactgatgaggattaacatttctggaaaccgggcagttctatgctgaatctgaaatacgctagcattacgcccctttgcggtgtaaacgctgtgtggtgcttgtttccatatgtcagtttgcagtgaaaaatatttgtagacttgatcagatgctgcataattcatctgtgttagctccttctgtcgatcatagttaaggcacttggcggcttcatcagttgacaaattcctgtttaaaccattcaaaaggggcagacaccgttgaagcggtgttttcaggacaatataagcctgaaaatgcaccactttggctttgatacacaaagggcttgtttggttgcctgtatcagacctggcctgcatctggtgatggtgccagcttccatcccagcagccagcattatcgccatggtggtgttaacatggagaaacgatggctggacaaagccatggatggagacgagagttaatatatggcttgtccaacaacagcatagcgcttggaaattggaatggttttcttagagcagccaaggaggtcggagatttaaactccgaccacccctctgatgctctactgtgttcaatcctaagcttctcataccggatctggtaaagaaaaatcaaataaagttaacaacatatacttacactggccccatcaaaaggaaattaagaaaataccaaccatgaacaagttgctgggtcgaaaactattttgagggcctcacctcacctcattggtaactatggcttgaaatcggatcggaatggaattgcggatgaagagttgttcgctgcgtacgtacttgtaacccccaagacattctctcctagacaacagcggagaaactacaatgaaatttgggcagaggcacatcataactttctttttatcgttttttcttctcaaacaagatcatagaacaagttatggtggtcgcaaagcgctcaacacagcaagaacaaaaattatgcggctcataagacagggtagatctgtgttatacgccattcccccatttccttacaactctctctttcgctgactttccaactctatctttcacaaccacagcggcctgattgccagtgtctagagaaggggatgatcgcctcggagccgaggattgtacgccctgaagaatacactgagctacgaatgacagtgcacgccgaatttgccgcagcacagccagcagtgaatttacaatagctgctaccagcacattgaagtttgcaatcaggaaaaactgcaaagaaattgcacagcagttagaaatacatctaggttgacaactcattcatacaaaaagtgcaggatattaattgtctttaccgcggcgataataccgacgatcgtaagaagagtttgttttgcagcatcccagaaacctccactgctgaaccacctgaaccaaccacctcctccagaccatcctccaccaccggctgaaggaggcagtctttgctgccttctttcaattcgcatacccaattttggaagccccgtcttcttccaccccagggcattttccactgctttcctagcttcatcctgagaggaaaaaatgttgtggtttgttattgtgatattctgttggcctatcaactttgaagaatcaagagtaattttggattctcacacaaaccaacagcagataatcctatgtggaatggcattattgcagtaatgcatgcctatcatcacatgccaaattaagagaaccactgaatcctatgactctatacagttcgacagcaatcggattggtggtttagcacgatattatcgtcatcataccatataagattactacatcaacaatcaccattctaattgtaaatgttcacatgagattttttttgtttttgcggggtaaatgttcatataataagattaatagattatcacatcaacaatcaccatcctggatgtaatgctccccatgaaaaaaaatcaacacatgcggagtatcacataagcccactagttaattttccaagctagataaggggtttggccaagttaatccctcgcccaaatccaatccaggcagggatggctagtcagttctatgattctccttcttcaacaccatcgtatgatttcggcgcaagcaagatagtagctaataggttcaactggcaaggtaatcagtcaatcaatcagaggggggggggggggattggagatgttgtgcaccaacctgcttgctgcggctgcggctgccggcggcggagaaaaggcagcacgcgcgggcgaagccaccgtaggagacggagactagattcctcccgcatcgagatcgagatgtagcgcgagaggactcgccggcggcgaaaaagaggggggcgtcgccatcgcggcggaaagcgcggagttgcggaggaggggcgagcgacatcggcgagtggcttgggcaagcttagcttacgcccatggcttcttcaggccaatccagtctactgggctgggcctggatgggctctccacctacagatcaggcccacaatgctcggtttttttctaaaagaaagaaaaatggaacacaaacaaattgcatacaaagaattgggaatttccagcagaacatgaataaactgagggcagtttcacacctccacataggcaacaaacagtgcagcacacagactggtcgttacccgttagataaacaggcgccaaaatgccaaaacattgtactgctaacacatagagccgtctcaagagtagtaagcgttaggagagctcttggttcatttgcttgtgatgatgcactaaccatattactcctacccagttaacaggacatgtactggagtacctcgcaaaggaaaacacatgcggaatatatgttttattataaaggctaatgacactagttggaagagccacagccaccggcggcgggcttgtcgtcgtctccatgtccatgtccattagcgggaggttggcggtgctggttggagaggagctgggccttgagctcggagagaagcctctgcctctccttgtgtagcagctctgccgctttcttcagcctctggttctgctccatgatgtagcagttctgcagcacaagctccgagttcaccttctccatctcctccctcctcactcgatcttactaaatccatcgcaacatatatacaagcagttcataagatagggagaattatgtaacaaagagcatatatatatattgagatagagaaaacaaaggaaagcagagggcatcttacatcaagtcaagaaaccacctccttcctccttgcgaggctgcgatgtgagcggaatggatgcagctctagctccagctcctgctagtgaagaactgaagattgaagcagcaacagcacaaggtaaggtatttatagaagcaaaaggaaggagcagcagtgcagaattgacataggtaacgtgagcagctcgaatggtcatcatttcacttgatccagccctcggagcgagcctattaatgcaaggcagaggcagtgcaagagcatcatgagagcagcagatatgctggattctgtaggccgtggaaggaaaatgatggcaaaaggttaggcccggccaccacgagattcgctagctatcatgacggcatcgcatcccttccatctccttccctttcccttccttttgttgctttggctttgactcttctgcttgttcgtctctgctggctgcctccctatgaccagaacaaacatggagagggtgtgagtagcaggcaggaaggatggcatcatttcaatacagaacacaaagggacctaataaaatcggcggcataaagctgtagtaatgggttaaagttacgcagctccactgtacaagcagtaactgcgacatcccagtccatacgacaatacatatagtgctactagtacaattggcaatcgagcttagtacattgttttaacttactagagtggagttacaaagttggggttactcaactacaactacaatgatctataacagacactgattaagcctcagcgaggggcttaggttcactgtggggactacagcgctgcatcttcggtccagtcaatctgacgccacttcaggtggaaggcgaaggcgaagcttcagcaagcgacaaggaccaagcagctgcaaatagtcgagaaaaactttcagcgagaaagatgctaataagcaaaacaaatagcagcaagaattgaactaaccacgtcctgaataaatatccacatattagatgttgtgccgattctcttctcatcacccgcgctgagtgcttgacttcaagggggcaatgtgcccctcctgaatctcaaaactgaactgcaaggaacagcagcagaacagcaccgatcatgccagccatgactgctctccccttcatttctcagcttctatgcattggacttgaggtcccgtatgcaacagtctgcaatttacttccaggacgaagaaggtgcctctcctgcacctgaatgtgcagggtgcaacaacaccaagaaccacaagctaacaagatcaagtggattgtttagctcagatatgtagttctcggttcttttatgcctgctaccatctaccagcaagaaatgaatcgggtatgacatccgatttacacattcagggcacgctggcagggtgcaggcatgcccaggcccctcatcggggccgggctaagcgcaaactagcttcaggttgttgttggtgagtctgcacaagtgaaaaaggaacacatcagctgagtgttaatgcataatctataaattgcatcgaagaaatatcagaatagatgttgtatgtgcaataatacatgtgtataaacataataaaagtctcatgtcacaaaaatgtaccttgaaaaaactactaccttccctccaaaaaagagttcacttttagacacaactcaggacaggcaaacttgtctaggttcgtgtataaaagtgaagtcttattgggacagaggtagtaaatcctatgtcaaatgaacaattgaactatcaataacttcacgcacctctacaatgatatttcttgtagtacatcaattcaacttgaacaatgagaaaagcgacaaggatctaaagtacggatacaaacctgtgcaaatggacgcatgggttcctgtggatgtacatatgtgactcctggccgtgaaggcatagcaaattgttggggagtatgcataaaaacagatgacctaatgggagcaccagcatgaccaggactgtaaggtggtggcatggaaccatccggaggtctgtacccaatcgcattaggcgattgagccggtgaccagggcccaggaatatgctgtgctattgactgaggctgctgttcaacaggaactggagacccatgagacccaagctgagggaactcagtgttgtagttaacagcaggggcatacaaaggttgaatagtgtatgaacctccattaaatccaaatccaggatcaaatctttgcatgtacctgtaaagccattcatgatgagttggcttgatacaaaagggcagtccttgtcttcactgacataacaaaaaagtcaacaggtagttttaatagagttacattttggtttgaaagtcagtccccattgttctttgtatctttaacatattatcacatgattacctcctgttgatgtgttttacacaagcttctcttagaattagagtttaaatttgcaatctaatagttatatgaatgaaatgcttatatggatgattgcatagatcacccatgagctactttgatagtttaggatgcacgtgaaatattgagagtactaaatggttcaccaataataaataggaactgtacggtggaatggcaaaacattctatagttaaagagttacaaaaataaagtttattacgttaacgggacctgtcatagcttctgtcataatcaggatccttgcgatctgactcacggtctcgaaatatcgccaccctgttgttttgcctgtttctattaaatgcaggatccttctcagtcttgtttctatttaccctgctgctagacgaggcagtagtcaaactcctttcaagggtaatttcaggcccttcacctagcctgttacctgagcttagctccaaggaactggacctatggagagtatttggcaaagttacttcatcacgtggtcttccatcagcagcattgccgctgctactgttgttattaaatatccgtgcacgtgccttattgtattcctcctttctttcttcaacacttttctgaaggttggctctagaagagtgagcacctgaactggaattgttatggtagtgcttctgaggtctttgcttgatagcaactttggctatagagttgctctcatcttgaggcagattaacttgaatatctgataggcgcacagcaggcaaccggcactcagctgatgttttgcgaaggatgatacgagaaccagatccatcaggaaggccgttatcttgtagagcaattgactggaggaaataatgctgtgccagacgatgtgcagcaagacgcaggtaagaagtaggaagaccatggaagtcaaactctgtctgcgtagggtcatgaatgaacttcaaaatgtcttgctccatccttagcactacaatgagataagactgctgtaaggtacaagccacgaagcatttctcaacttacaacttgtagttagaaaggtagtcaatcatgaagatacaacagtatgatgcatccgctaatgtattaccaagtcgagagtataagattgcaagcagaataaggaaaaaaatacagaagaaattaaccagttaaggtaattgcagatgaagccaattcaactttacaaagtcctagaacatcagtaagtgacaaggcagtaatt

SEQ ID NO: 28317 - DNA, 686 bp, Oryza sativa
  unsure (1)..(686): unsure at all n locations
gggcgaattcgagctcggtacccttaattacaaaagatttgtaaaaatgatgattttagcttaaaaattcaaattgaatagaaacattgatgagattacagtctctcctatgcaacttgtaaaatcatttgcagttgatgatctaaatgaacctgccgtttcgcaaaccaagtatgcagcaggagttagtggctactgaatactgagagggcaaaacaatactgccaagttggaagtggtataatttcctgattggattgcattttgggacccacagcctgatactgctgctggataccatcaagctgttgaaacctcagaccatggtaaacaagctttaaaacccccggctgtctctccccacctttggcccttctttcaactgatactttctagttttaagaataccatgaagttgatggtattgatacagataccaccatgaagtgaagttgatgaaaagtggtgcaccacaataaggtactttagcttccctttcttctggatcaagttcagatatactcttaccttcttcctttcaagccttgcttgcttctgctgctgaaccagatatattgacaagatcagaaccacaatttgattttagttcctgatgtagaagagggcaagannnnnnnnnnnnnnnnnnnnnnnnnnnnnnnnnnnnnnnnnnnnnnnnnnnnnnn

SEQ ID NO: 28318 - DNA, 787 bp, Oryza sativa
  unsure (1)..(787): unsure at all n locations
nnnnnnnnnnnnnnnnnnnnnnnnnnnnnnnnnnnnnnnnnnnnnnnnnnnnnnnnnnttgctcactcacaaaaagcttaccgtcatctagtacaccagtatcaccttcatcgacgaccgactgaatgaactccaggtcgtaaagtgtgctccctccgtcccagaaaagttaaccaacaaatatatccagattcgttgtattacagtacagcccccgctaaccactgtcttctttctgaaatatgaaaccttatattggacgtctcgatctaattgatagtactagcttatatattttgtgatagaagaaatactgtaatagaagcatgcatgtgcatatcttcacttaatttatgaaagcaaatgaaatatctttgcttgaaattatctaagctatatatatataagagcatcctagtcatctactccctccgtagaaaaagccaacctataaggggatccctctagtactataaatttggacaaagagctgtccagattcattgtacttttaagattggattttttttttacggagggactatagtgataaggcttaacttgtcagttactcttgtgcaaaaagctaaaacgcgtggaaaaactaaacagaatgtcggtcactgatgagtcctttgctttgctggattccgattgaaacaatagctccgttcatggttgatttgaatctctagctagccacctcaatttctctgtattttcctttcttctacttttttttgataaagtgaggatggagcgatattaaatgatgctatgcagcata

SEQ ID NO: 28319 - DNA, 270 bp, Oryza sativa
tttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacg

SEQ ID NO: 28320 - DNA, 692 bp, Oryza sativa
aatttgatagagatatttttgttgttttgtcttttgatgtagaaacttactgttggcgggatgccagaaaagattgtaacagcatatcagtcagtgcttgatcaacattttgatgaagacacagctttaaacaaatgcaataatgctgttagtgttttggataggatggataaagatgtagatgatgcttgtactcaaggtaaagcatttttctcacttcaataggtctgttatgttatggatatgtaccgtcgaaagattggcacttaatgcattctgataccttggcctgtattgcatcatgattgttccagcgctattttacttctagttccatcatgtacttgacttgagaaaaaaggaatttacatagtatttccggttttttgttgatctgccatgtaaattctagactaaacaaacatctcaaatacataaatatgatctagcatgttgacaaagaaaattgctgtacataattttataattatgttaaaaaaactataatgatgtgattgtagcatgcattggcatataaagggaagaaaatcaattttctggcatttgttttcataggtggtggtctagcatacatatccttattctgtggagcacatccagcagcttaattattttacattgtgatagttccttgagtcctttatagtgcacactaggcctgtaggccatga

SEQ ID NO: 28321 - DNA, 379 bp, Oryza sativa
cccccagttctggtcgccccagagccaaatgaacccttgctactctacttacggcgaccccgcaagtggttagtgcggcgttggtcgtggaacgcgatgaggacaatcctcattccgcgcacccccaccttgtgccgacttggcccgggagagagcagggaggagaggcccccgagccgaacggtggcccaaggcccccgacgaccggagatggccctctgcccgcttgtcagacggtgctaggagcccccgacccccaggaaggccccgaggcactgcgggaaggccgcacctatcgccctctgaccccgaggctaaccctgtgccgatttggcccgggagagagcagggaggagaggcccccgagcagaacggtggc

SEQ ID NO: 28322 - DNA, 585 bp, Oryza sativa
cgccagctgccccggaagttgtcgcctgagcgtcgcccgagggagtgggcccaagcgatgcgcccgcgacctcgtcgcgagctgcctcggaagaaaccattgcctcgtcctggcgaaatccggctttctcccgagcggcttcctcggcctggtgggctcgggcggcctcctcccgagcggtatcctcagcctggcgagcccgggcggcctcccgggcggcctcttcagcttcccgtaggcgatctgcggcctctcgccggtcagattctcgcctccgtgcctctgcggccgccggatcctcggcctcagattggccagacttggaatgacgggagggacgcgacgggatctcgctaaaacagaagaaaagaccagaagacgaacaaagacgggtgagtgaaaactcgcgttgaagagaatggatacagccacgatgagtgagagatgaacctgcgagggggtcggttgaacgaccactttggaggggagatgaggtttccccgagatggttctgtctcccccatcttgcggagccgtttcttcttgggctccccctcgggctgtgatgttggcgcggccccctcc

SEQ ID NO: 28323 - DNA, 132 bp, Oryza sativa
ctgctgctgttgatggcccagttcacttgtatggatactttgctggccgggatcatttggacccgctacgcaactacatcttcaaccgcaccagggatgaccctttcatcatggggcaagacaatggcgttg

SEQ ID NO: 28324 - DNA, 684 bp, Oryza sativa
aggggaaaaaagggcaaaagagaaataaaagtaagagaattattggaccaacaccatggaccctcaccacataacctgcaccatccaattctctgaagacccactgtagcattattctgaacttgtacacttcatttatcatcttgtcccagactccagttaattaccttcaatcaattactacctttttactagatgtgtcggcagagtagtgcatctcctatcactaacagcagacaagtttaggtgtgatatgatagcaactattgtttgtacctgagttagttagatcgatgcagagctgacttactggaataaactgcagaaacgagacttgccataatctgaatttctaactttactgtagtatgttttctgctgttcatatatacaacactgactaactgaacagtgagctgcactgactgcaaaagagattaaaatgttcagaaacatgcagtcaccgatggtgatcatttcactttaataatatgatgattaggtcgtgatactaacgaacctctctatatctccatctctctctctccttcacgtgaagcctcgcacgagtgcaaagccgacagccagcaccaccgccaaaaacgcgaggcgagttggagttggagctggatccctctcgccattgctctctctctccagcctcattctcttcccctctcgtgc

SEQ ID NO: 28325 - DNA, 704 bp, Oryza sativa
tatgatgatatttgtatggataaattccttctgtgctactggaaggaaatcaattcctttgcacatttcgttgagagaatagttaccgctccctctattggtcagaccgtgctcatcatgactggtcagactgcgccctacctcggccagatcatgcctcttgtggccggtctaaccatctcactaactgtcggtcagaccaagtaccaggctggttagatcgggctacctatagccgtcggtcagaccaagtacctggctggttagatcgggctacctatagccggtcagaccaacaccctggagccttttcctgattttgtatgccacaactaatggtaccgatgttaattgttatttgattttgtatgccacaactaatggtaccgatgttaattgttatttgccacctataatactgttggtcatgttattccatatacacatggtatttgcaccgataattgctataagctaaaccaaaatcatcaagaagatggattggctcaagacgcgtagattactttcaaaactctgttgcgcctttacattttaggccataaatataagaggatgatcaattaagccctaaaggctagtaataattcaatgtcatataataaatgttgatacttgtttgtgatcgttgcgaaacttgtaaagcttgactgcatgcacgcattagtcaattttataaagatgtg

SEQ ID NO: 28326 - DNA, 437 bp, Oryza sativa
tacttagaaccctctcccagatctgacgcacgaaagtgcaatttttgaaaagatgttgggcggtttcaaggttcctatagcatagttggcagaagtagttgtttggccattgtctgacctgtagcctgtccgctgtccaaatcctattttgtaataggagccatgcaaaatgtttgcatttggaaggtgcccaatgcttccaaatcagttttgctgcagctgagcttattctgccattgaactgtgctatgtaggctgactttgcactgtactttccatttctcgtccatctccaagttatggtgtcctcaacaccttctgtaggaacaatgtcttccacacatggtagaacacctcaaagaattcattgacaagctcgactgtgaggctgtgcctgatgtctattatccattggtcatttgctaacccttcttgga

SEQ ID NO: 28327 - DNA, 629 bp, Oryza sativa
ttcctgcagcccgtctatttgtgcatagagtctatttcaagaagaagaaccggaggaggaagaggtagaagcatgagagggccgacttgttccacgacgttatcgcgcccacgctgcagccgatcacgcacgtggagaggacctgggcggctacggcgtgtgcggagaagagaacaccaaccggctgcgcgtgagggaaggagccgcctgccgtggcgcgcgtagacaaaggagctcgccgaccactactccgccggcaaatagagaacgggagaggtgaggaaaaaaaggatgagatgttttttttttcattttgctcttactgatatgtgggtcccataagagccacgtaggataaaaccgcttgaaaaccattgaaggagtttatttgcaccggttttcaaagataagggagatgttatacccggctttacgattaagggagacgattcaacaaagggtaagagatgagggaggcaaaataggcttattccatgacgaatgcttctctccccgtagcagcccaggtgcacatgggcccagcaaccgcagccgcggaggcagcactcgcccgccgcgccgccgacccgctgcccgcgctccgccgccgcgacgcgctcccgctcccg

SEQ ID NO: 28328 - DNA, 507 bp, Oryza sativa
ggtgccagctttcaggtcagcccgcctgcttgcatcctccttttcatccaactgcagtacacggcgccgaagggaatcaaacatcatcaggattccttccaccgattcctttggttgtctgatgaggatgaacacaagttgaactcgttgtccaggctcctccttattgatctgcgcttgatgttggcatcattagatttctcagcttgctggggcctcttggctctctttggcagcgttggttttttctgcctgcaaaagggcttgtaatcttgatctgatgattcatcttcatgttgcggtgttggaaatgccgtagattggtgtagcttttataggaactggtgactttggtaagggcagagaaaatgaagctggggcttcttgaggctgttgtgatgaatggtgtggcataaactaacaatggattggttgattgagtttccacatcatatcccaaaatagtaggaaactttggcgctaatgagcgcaatgggggctgcagga

SEQ ID NO: 28329 - DNA, 562 bp, Oryza sativa
ttcattgtgcttttattaagatgcactctgacatattttttcaggtatataccagtgctgctaatctttttatcatgaagaataagtttgacaggacatcacgcattgggcctaaggtatttttcagtccttgtttggatggtcagggatccgtggccatcacggcccatccaaaatatggactttgtttttgtgatttattctggcaatagatatatcctcgaaatactcctatatgggttggtctttaattgacctatcatcctaactttggtggaatatttttaggacattattttttttccatgttattctacctgaggctggccactggcatgtttatttattaaatttcttcagaaattatattgaagtcataatattatatgtgtaacttccattaatgatagtgttctagtgtcacaacacttcagccggctttgtttctctgtatcattacagttctcttgcatcccgacgccctaggatattggatacacagaaagtacttattaattactatgctatgatcctgttccaggtaattgtcagtgagtacgct

SEQ ID NO: 28330 - DNA, 817 bp, Oryza sativa
aaagagacgacggcggcgcggcgctagggttcgggcggcggccggccggaggtagacgacaggcctgataggtgggccccacttgtcagcggcagcgagcgcacgtgggcggctcggcttgactgggccggcttgggccgaggaggagagagagagggttttgggccgactttcggcccaaagccaaaagaagacttttaaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaattaaacaacaatttatatatttaggatttttagggtgtgacacccttgctgctggggagtgggtatatatacccctaaccaccaaaactaaccgttggaaccgaaatccccaactttgtgctctgtcggtcagaccgccgttgtgaggccggtcagaccggactactttgtaatggctagaaaactagccgttacagggcaatcattgagcccactcaacctggccggtctgaccgcagtgtagtggccggtcagaccgtccacggctcggtcagaccgccgtcggctcggtctgaccggttgcagctctagcggctctgtatcgccaccaaaaaccagaccagtgcaacagaccagtggggctggtcagaccggccttaccacgtcggtcagacctgctaaca

SEQ ID NO: 28331 - DNA, 625 bp, Oryza sativa
tcatgtaaacatcctgtttctctgttgaaactatgcatcattgcttcacatctctgctacgagcttgctgtattgatccagagcgaggtcaaacgaagtgaatgaaaaaggagggagcactgcttccatcacctctgcagcatttggcagctcgctttcaaccggcacgacctgcatgcgtcattcacaaagatacttgtatgttagatgaactcgccaacacctgagaatattgcgtgttagagcatctctaacagactctccaaactaaatttggcaactctatcaaaaaaaggtgcaacttctagaaatacttgtaggaaatgattccagacattgagacataaccaaataaactatttcctggaaaacttacagataaaactgaaagacagaggagagggctcggtgaaaaaaaaagacagaggagaggacatctataagactacaaaagtttatgccttatgtataacatacactacttgattaaataagtcatacggcttgcatatatattggcagactgtaaatttgtaatggtaaggttgccctctgctaaattcagtgcatggttatgaaacaagaaacttgtgatggaaacaatggttgtcttgccttgtttggt

SEQ ID NO: 28332 - DNA, 291 bp, Oryza sativa
taataaagcgcaccatccaagacgtcaggaatcaggaagaaagaagtgcgggcggaggaggcgagcgccaagcaagctgccgcgaggattaggagcaggacggacagagcgcgaggctttggtgttaagtagaggagaggaggagagagagacagtggctttgaagggaagtgtacctcgacctcgtggggaggcacgcaacgcaagcagaggaggtcgcgcggccgcctgatggtgatcggacgccggagacgggcggcggcacgggtagcagttgcttgctgcggcggg

SEQ ID NO: 28333 - DNA, 45785 bp, Oryza sativa
  unsure (1)..(45785): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgaagataataaggcatactttgttaataattaaaattaaacctgacctctccatctatcaggaatgcagaaaaaaagggaagaataggtgcaaaaacctaggatagggatcacaatatcatgccaaacgccaaacactcgaagattccaacgattgaatctgtagcataagtatatatgatgcgtactgtagaacaatgcctttaagaagaaaataatttttgtccactggtatcattcaaaacaacccaaatatcaatcggtgctagattttcatccatgtaaaagttagagaccacattcagcaacgaaacaccaaacatttatcaggcattgtcaaactaaatcagggttttcatgctagagttgagtgccaacattatacaaccgtccatgataggagtttgtgccctcggcaaaagggccaccatctatcagagaagaaaccacacacacaataaatcgtgacctcgaattgtcgactaatctctccgatcacaacgaaagaaaccacccgcatagtccctctcgcattattatgtactccataagatatcccttcacaagtacgcatgttatttttatttcttcacgtgtagattaaatctaactatatatgtctgtgtaaaggggcagacaacgagagagtacatgctctctagtctctagggattaaaatagttaatacatgtccctctgttcatgtcatatttttttcatgcccacattcaaaccttgacagcatagcaacccccacctccaacaacacatccacttctctccctgtaagagccatgcttcctattggaggcttgaatattgtaaaatcaaataaatttgcacgccttttcattcgagtcacgaggagctggatgagaagaagctctcatgcataggtggatctaggggtggtcccggaaccattcaaataaaatcctagcataatgtataatatacatatgtaagaaaaacttttgaaacaaagctcttttattaatatattatatgatgcacatttaatcaatttatttttctaactttgttatatttaggatatttaaaaaatatatatatgttagaccacctatataaagatcctagatatgccactgctctcatgttcggttctatagtaaggatgaaaaaaaagaagagaaaccatcgactataaccccaaaattaaaaaccacattatttcttaacacacatataggagaaataaagggaaaagcctatcgaggcaatcatatttgtttgatattttgtaattatcattttttatgtgagttatgttatcagtaaaagtattttaagcacgatttatatctcatgtatttgcatacagtttttaagtaagacgaatagtcaaacatatgtctaaaagtcaacagcgtcatctattcaaaaatagaggagtatgtaggtcgaaattcggcctttgtatccacgagtagatatacacatgtaatttgtttggttgatatgttatccaagcagtcctcggcacatccactgagattaaatagcgatcatccatgctttccaaagttgaaaaaaatcccttatctttatccacggtcaaagtccatatgaatgcaacaagatgcgcactaagaaaaaaaggataacatcagtagcaaaaagaaagaaagggagatccacactaaccggacaataatatgtacaccgagcagtccatgatcacactcacacacacacacacacaccccacaacacctttagcatctgttccttttctgttttttttttcttcttttcctacacaccaaaagtcaatcaccaactaattctaagccgtttctgacgacaagaaatatcagataaatattcagattaggctactacagctgcagatgacaagacttcgtcaggctgggagagacaggaagccattcatatcttcacatcgcagcttctcgtgtcagtgctcattgctcccaattaacctgcaaacgcgatagtaatcgatccatctcattatctcctccctgaaaacattaattctctaaaattcgcctccatccatctgcactactgtttcatggtgatttgcatgcaataatgccgatcatcaaatgttcagaagtcgatgatctcgtcaggtacgtcagtcataaacctcgccttcttctgccaaggaatcaacacacaagagaaaccaagttcagaacgaaaacatacatttcagaaagattaattcaaagcgcatgaatttaaacattccacagcatctgcttctcctcctaggtgtgttttgatttggtgtcaattagctagaggggattaattcggattgctttcgttcggacaaggacgaatggcttttgtgtggtgtgtgcgctgcttttgcagcctgtgcttgaatcagaagctatccatggatttggatccctttctgaccggccatgattgtgtccgtcaggacagaggacgactaactgcaccgtttgatcgattcgacggcctaaccgacactccaatgccggccataagctggtttcatcgagaggaactgttgaccagttcagataaagttcagatacgtttacatttcttatgtgtgtatagaacaaaaaaagttcagacttcaatttttcccaaaagaacacaggacaggggagcttgtgattttttttcaactactcgtgagaatatagaaaatttgagttttctactttctatgttctgattcatttctagtttttataactatgaactattgaaatcttgtttagaagttagactactttaggaagctgaagattctgaaagaagccgcaagtgtctaaggccctgtttaggggagcttgtcccagctgcagcttttcccaaaagctgcttctgttagaagctgcctcaaacagtccacagctttacagattctgaaaaatgaactaagaagccaaaagctggagaagctgggtttcagagttttttcagattgtcagaagctggctaccaaacagccgcttctcagaatctaaagctcccccaaacaggccctaaacctcttctaacaacgccatagtatttaagcatagattctaaagtagttgcagatagacaaccctgatgttttagaagtacattggagtgtaatctaacttaggtttagttccatcaacttcataaacacgagaggtccaagacctgtccctctaaattaatcactgttctaatgtattcgttaatgatactgtacacaattgacattggagaatggagaatgcattgacagcttccacgtagcagccagctactagctgtacctagtactacatgaagtccactcttgcaattaaaactctctctagaaaaaaaaccaacatgtcatgatcgatcgattcgcgtaaacaacgtggttaatcagtttcagtctaattaaccaagtgccagaatctaagcacgtgtgattagttgtattagtagtactagtactcaattacattagacttacttgctcatcatttgacctcaaattactcttcctagcaactcctctacatgcgaaatttacctatttaaagcaagcactcttctaagttgaccattgccatattgacctttctttagtaggaactcaaccacttgatcaatggaatatataaagttataaacatctcaatgaaccattaactatgttttatcatcttttatatattttttcctgatcagtttaaacttttgcatgaattggttaatacgtgaagcacctaacaacctcatatgcaacaaggtagcacagacactactctgcacactagggctgtgttcggatgcctgagttcccaactctaacagtgcgcacgaaaaacggagcgatccattagcacgtgattaattaagtattagctaatttatttttcaaaaatggatcaatatgtttttttaggcaacttacgtatagaaactttttataaaaaacaatccgtttaacagtttgaaaagcgtgcacgcgaaaaacaagaggagagtattgggaacttggagttccgaacacagcctatgtcactagcaagaaattataagaggacattccactgtaatactaatactttttattagatcatcataaaaatattcataatactcccccatttcagattataagtcattttgactttggtcaaagctaaactactttaaatttaactaagtttgtagataaatatagtaatattacaacaccaaatcagtttcattaagtcgataattaaatatattttcataatgttactatttttttctataattttgattaaatttgaagtagtttagctttcaacagagtcaaaacgacttataatatgaaacggagggagtaatgattaggtgggtttcaaagcccgcttacatccctaaaaaaagatttactaactactgcactgatctctgaacatcaacggccaatatcatgataatgacttgacttactccctcttaactttgggagttggagatcatgatcaatatatgtatgacccctccaattattttcaaaggcctcatttaagtgccacaccaaacttgttcacacaatatatgcttctaactaactaaaccaattaagcccttgcacatggtcctccattgacacatatgcatgtccccttcatccatatcacatgcatggacacatcaacccaactattctaggtcaccatggatatctcttttaattttccctttgtttcaaaactgttcatgagaccatgtttcaaacacagggtgaaggagaggagtaggcaactagaaagaaaagcaagttcattcacttgttgcatgcacagctctgcaccacctaaaccatgtgaaggagtagtgaaattctgacacgaagtggatttggattaggggaagtcaacgaatcatggacaactcattgctaattgttggaaagttgaagtgatggattgagattgtttttttttatttttaataatgggatagtgatttgcacttccgatccatggagtatacatgatcgaatagaaaaaaaaaaattctgaatcattggtctacgagtatatttacggtggtgactactggtagtattaataatagcaccggtattaccactaataggaacaattatatcactagagaacaccgtaaaaattgtcaagacgcgagacatgacttaaagtaatcgtcatcctcttaacaacaagctattagtgttttctaaacagattgcagttctgatagatcctgttatctgctatcatagtcctttttagtaccactgagctgaaaaaaaatattttcaatctaaaagttggtatagtcaggtttaaaaatttcaagctgaaagtgctcggtggttaatctactaatgaacacttcaattacttcaacttctgacctgaaattttgattctttaattgttcttttgccgctgaactcatacatttcgaagaggtttcagagagtatgaaacatggcattgtcgaagatttttgaaaatttccgccatttttgtggtttgaattcgaagcagaggaaacagagcaaagggttagaaaacagagagagtatgttatatgctgttccttacctgcttcttgtcggcgaccttcttcttgtccgacgagacgagcgccgccggcagcggcagcggcagcggcagcggcggcgggcggcggaggacgggggtggccggcgcggagctgtggtccctgtcgacgcagagctgcatgatcttctcggcggcctcggcggcgtcgcggctctccttcacaagccgcgccacctccgccttgggcagccgcatccgcagccgcacggcgccgccctcgccggcctccaccgacgacaccggcgacgccgccacgtccgacgccgaccgccgcgacagcatcatgctctccaacctctccccggcgccgccgacatggacaagcgcgcccgaccacgtccgccgcggcgcgcgggcgaggcgagggagctcgacgaggaagtagagcttgccgggcttgagcggcgcgtcggcgtcgagcggccgcgcgcgcatcccgaggcgcctgacctcctccgactccaggacctggtagcccgggtggtcgcgcagcgccgccgccgccgacgccggcggcctgtacttgtacgtcgtcccgtccaccgtcatcaccctcgccgtccgccgcctcccgccggcgatcgcgttgcccatcgatcgatcaaaagcttagctgcctcactcagctggctgctgctgcttcgccgacgagctcgaattcgagtagttgacgtgagctcgcgaggcaagaggaagaggagagaagagcatataaagggaggcacacgcatgtgatgtggcaaagtcaaatctcacgtctaattgttaaattattcccaattttcaaattactcgtcgctaattttatgctaagttaaaacagttgtttttaaaacgttaataatttaaaattttgtgtggtttaataatatttgaatattatatatttattacgagagcgtgaatctaaaaagattaaccttataatgttgttggcttcatccatcatgattcaaatactgatacacacgaataaaatttagtaagatgtcgttggtttatgtcaggaggcgtgggtatagaagtgtgtgagtatgttgttgcatgtgtaatggtaaaaagatagttaaactatatgatttattttagagttagatggacatatgtacggatttctgattaggaaaatcttaaaacgctgagtaatttaaaactgagggactgtactagtttaattagttacaggtgattagaagcataatcttttcgatacctgcattattcaagggtccaggcgtcgacgtgtcgtggtagctagagatgcatgttctttaattagtacatcgttgtatgggcgtggcaaaataattgcattttggatttacttggacactaataatgatgtacatatctaactattatctctatcctaaaatgtttgacgccgttgacttttttaaaaatatttgaccgttagtcttattcaaaaaatttaagtaattgttaattctttttctatcatttgatttattgttaaatataattttatgtatatatatagttttacacatatcacaaaagtttttgaataaaacgaacagtcaaacatgtttaaaaaagtcaacgatgtcaaacatttaggaaatgagggagtatattactaatatgttgtactagtatatagtgtgcagtactgtactatagtacatacgacgagcaagagggccatgtgagctgtttgtatatgatcgatgttctaggtacggtttaattctatcatctataacaatgccatgcccttaattaaatgtggttgatcatccatgcgtagactagctaacaaaaacagtgattaattgcgcatctaaatgtttaatttgttggttgttagctactctctttaatgtatgacgtttattgtctcttgtacatacatttaacatttaaaaaaagttaaagtaaagatcacaaagcgcaccatgctttgaccacatctatctcaaagttcatatgctcacctgttgtaattgttttgctttgacgaagatagctgaattaatagcgcagaagtgtcgagaatgacatcaatatgcaagttttgcgagaacttgggttatactccctccgtccaaaaaaaagtcaacctctaaagtttgaattttatcccataaaaaaccaacttctaccatccagctaccaaccctcggcacataaaacgagaagttttatttcttaaatacccttcacctatctatcaccattactattttttttaataatgaggactatttttggcatttttactccccactaagtttaaattgggatgctaggattggtcttttttttttaacgaagggagtacttatagcatgatgaactaagtgttaactgagtgaacggatttctaacataaattggtacttgcatagtagagtaattgtattgttgttcatatatattacttcctccgttttatattataagactttttagcattgcccacattcatatatatgttaatgaatctagacatatatgtgtgcctagattcattaacatctatataaatgtggacaatgttataacctgaaacaaagaaattgtttccgtgggattagccaacaaaaagggagaataatagaaaacgtacggaatatgggttctatgatacaatatgccccaagaagtgtggttttatgataaaaactgctaaacctatggttaaatttgagatagatgtgcccaaaaactctcggtgttttacgatatttactgctaatataaatatatagaaaattacaaatcttgtctaaaatacctttggtactccctccgttttaggttataagacgttttaactttagtcaaaattaaactgttttaagttagactaagtttatagaaaaaagtagtaatattttcaaccaagaaaaatttattatgaaaatatattcaattattaatttgatgacactaatttagtattataaatattataatatttatctataaacttagtcaaagttaaaatagtttgactttaaccaaagtcaaaacgttttataatctgaaacggaggaagtaataaatatcacaacaaattaaatacataataattacgcaattttcttaaccatgtgaatgcaaccagatatataaaaattttagtaacatcatacattaaaaactaaaacccagagagagtactagtactacatccttctagacggggcaacgggcaagctacaagtgagaaggggcgtgcgtagacggcaacggaacagagatagaactgcgagtgcgtgtcgttgttaatttttggcggtgtccggtgagaacagggaaaaataaaagtgtggctagctctccatttccgttaaatatctctttcattagtcctaaattcttggcttggttcaagaaaaatgttgagaattagctttggctgtagtacatacgatcgagctgagttaccctcggtgtcaggttacctcatggccggccatccagcgtggattctggagatcttttgagaagaattctgtgaaatgtcagtcgatttcaatttcatgtcggttatgagagaaccttctgtgtcgatcgatatgattccaagcgttttaccgcgggatatatgtgatcgataaatgctgatctctgtcaggtaaattccatacgtgaagaggacaagaggcagctagttagtgtagccttttcttcagcatgtccaaattaaactaatcgtcgtctctttgtcagcacgtacagtacagtatagtaaagtttgtgctttagctaactagctgatgactagtccgtacaaatggcaattaatattatttttgcaagctagtcccctttcatctaaaaaaatcaaattctagttataaatctaaacaactatatttagattcgtagatagaagttaaatttattttgagatggaggtgtactagccagtaattgtgtaatggtagtgctaattacagtgtgtaagtagaattaatgaaccgatcgagtagtcgtgtgatgtatatatactccctccttccaaaataaacttaagttcatgataggatgtgactttatgtttagattcgtttatgttgggacgaacgatcaacggtagtacagatagtactgtcctaatgtccatgctcagttgctcacaattcattcacacctgcgctgcgatggttagtacctttaacttgtagcgtaggacgtaggtgcatacgtaaggctgacgtgtgggtgacagaagttggtcatgggggtgagcgagtgatctatcgatctgtcgacgaacgacgacattaaatattttgtctcgatgtccaccatggtcgatggagacgactatcatatatactacagtgatcatatataggccatgccatgtcgttctctggtgatagatgcacgaggcaaaactaaagacgaagaagaagaaacagcagcagcagcagctaattaaagaagaagactacatgctgacgctgcaggcagatatgccgcgagtcacgggaagaagacgataaaaggggaagacagtaggaaggcctcccgggtttgtcgtacgtctcatttctgacccattactgatatggagtatatacgtatacgtttgtgttctaaaatataccactctaaacatgcgtttggttgaagaaatgatatgaatagggttgagtcgaactcaattttaaaggtgtttggtttgagaatgaatgggataggaatagcatgatcctctagaggaatactcctcttagatctgggtccaagccactcgagaaaatctggcgaacgagctcgacctaccggggttgagcgcacggcgtgagccgtaccgttcttccaccgctcaagctcccacgccgtccatccgcatcgcgccgcgccgctccttgctcgctggccgttgcccatctggtcatgatccagctcctccgctggcagatcttctcctccactccacctgttggattccgtcactactttgtttttgttcggcagctggttgtcatcaacttcctctccgtctctagtcgattgctggcgtgggcttccgctacaatccagtcgccatatatcgagctcctccagcagttgcttgtctcctccacccgttccttcacccgccagattacatcgctccgcccattagctggttgctgtatgtcgggctctaccacactgtcggaactggatatggacttagctgcaaacattacccatcttctaccaaacaaaatgattggatcattccatcctataaacaaaacaggaatcttggttcttaaaccaaacacacattaaggtcccctttggtttggagagtaaaaatatgaatttcagaagattttcatcctataggaaaaattcctatgaatacttttgaatcaaaggattgaatcatatccaatcctttaaaatcccaatgaaatggacaatcctatagagattttgaagaaaacttagcaagagctcaaagctcttggaaaatttcctttgagtctatctctctcatccaattcctgtgttttttctatggtctaatcaaatgttcattcctgtgtttttcctatgttctacaatcctctattttaaattttcattcatgttagaatcatgtattttttctattcctatctattttcattcctacgatttaaaggggctctaagattggaggaacgtttctatttagattttagattaatatattttgggatggagatactaactagtatcaatgctagattaaattaactaggagtgagatgaataataattgaatactacttctatgatcgattgatatggatgtgtggtttagctagggaggcgagagcgaggtacggtgaggccacgtatgcatgtaatgggatcgaccgatagaatctgtcagatcaggttatgttcgagcctgtttagatcccatgtcacgttttttcatcttatcacatcgaatatttggacacatgtataaaatattaaatataaataaaactaattatacagattatgtgtaaattacgagacgaatcttttaagactaattgctctatgatttaacaatatgtagtaaacatttgctaatgatgtattaattaggcttaataaattcgtctcgcagtttacatgcggagtctgtaatttgttttattattaaaccacgtttaatattttaaatgtgtgtccgtatatccgatgtatcgacacggcaaaactttttacactcgatctaaagacagccttagtctttgccttctgtcggctgcctgagcccctgacagtaggttcattatcttatatactactaattaacactccctcatcttaattatatggatcacagtacgtgtttgcacagcacacggcgacacacaccacgagctagcgtacgtgcagctacgcaatcggttacagcagcggaggacggcgggttggcctggctctggcttggcttggttgcatttgcatatacgatcgacgacgcacagttgggcgtggggacgaagaggaggccacagcgaccgaccgaccggacaaatctctgcagctgatgatccccattatcaatctgatgtaatgtaccgaacacaggttaccaaccaggaacatgcattgagctaggtaattaccccgatggcaaactgttgaaatcaaaacatgaaggatggcccttcttttacatgcatggttaataagtattttggtgggactagaatgtctatactacttttaaatattattccctccgtttttaagtatatgattttttaagatacgtttgatcatttgtcttatttaaaaaatttatgtgactatcatttattttattgagacttgatttatcatcaaatgttctttaaacctgacttaaatattttatatttgcataaaaactttaaatagaatgaatggtcaaatattttgttgaaaagttaatagcgtcgtatattaaaaaggtggtagtatatagtagtgatggtggtggtcgaatgtcacttgggttcatgatgttaatcttcattgtatgaatcaaatacacatgggtaatttatattcaattgtttctcactacgagtgactgtgtagctcaacacacatgtacaaaattgtaacaaaccctgttgcatatggatatgatgtttcactatatgtatcgcaggggtatttagctagtttcaaaagaaaccgtatttgaaagaaaggatatggtacaccatttgggaggccaactggatcccctcaagccacaatctcaaagtcaatacttacaccgccagaaggtaaatttctcttatcaaacttaggtaaatgatttgaataatctagtagtttgggatgaatacctggtctaaagtttattttcggcagttaatcgaattttagagataccactggtagaattccaacaccagtttgttcactgttagatatgcataggaaatgctacttaatggagaaggcaacgctgatatttctggtgttcgggatagactctagaagatgaatctgcctgaaaaaaagttaaaatctttggttgaagagctttacatggcatggtgtctcctgctccaggagtactagcagggaataaacacatcaataatcagggaggttgtcttgtgtgccaaactgatggtggagattgtggataccccatacctacacgacatgtatatccgactgggtatggggtgccatgtatagatagaatatctttaaagggactcgggttaaattccaaacttgtatgtcaaggaaatacccgggatcctagttggttacgattgtattttgtatgtaactacctattccattagagatatggactgtacttaggaggggtccgggtgcctcttggggcacgattttgctcctagatcatacgatcaataatacactcggcggatcaatccccggacaggagtagggtattacttcttgttaagaaggcctgaacctgtataaaattccttgtctctcaacccatccacttttccagcttgatagccacccccttttagtattgccgaaatcttgtttcgacagttggcgcgccaggtaggggtagcgtcaagtttttcgccgactagtgcgatgggtttcgtctctggcatcgacgactttgtcttccctctcgggcaggcgttccggttcggcagcctcgacttcatcaccaacgacttcggcaagatttctctcctcgactcggattcgaaccagtcgggaagaggccaggtttccgccccgttcggtatcccgaactcggccgagacctactccaggatcatctcaaccgagcttgcttcaaaccactcagacgagatccaatctactccaacacgacctgatcaagacgatggagcttatccctcaatcctgatgaaactccccgatgacttggctgccgtcttcaccacaagggcgtcctctccccgtaggcctacgcgggatctggcctcgaccccgatccagtctggctcccgggaagttggcgtcatactccagcctctcggcacggtttcgacggaacaataggacggctacctcagctcccccggcgtcgactctcgaccaacggagatcgtagagtacgacgacttcggctaccgctatgactaccgcaaccttgacgacttcaacgaaggctacaaagataactacacgcccctctacttcggcattttcatggccgacaacgagacggaagagcagcgtcaagcctgagaagcagaagaacagcgcgtacgacaagaagccgaacgttgccgactggaggaggaacgccaagcacaagagcgagagcgactgcagcgtgagcaacaggagcgcgaacgggctgcaaaggaggctgagtaccggcgacaacgcgccttggaggccgggcgacgagcacgagagctcatcgggcaacaagacgtcgaggggacgacggtttttcgcacccccccagcagaacacggttgcagcgatcacccttctcgacaccctcctcaaggaagacacacttaattaggccaatcacgtcgtcaacatcttgaactagactaagaccatgatcaccgcttcggtcccggtcaactccgcaagcatccgtacgccgactggcagccgagttccgcctcttcgatctcaagactatcaccaaccaagcctcagcgtcgtcagtgcaggatccagccgcaggagcagggatcacggcgaatgatctgtccactcgcctcctgaccggcacagggagcgtcgggctgaacatccccgctccccacgtcgcatgcatcccatcaatcttcgcgaaactatcaaccagcgccgtgcggcaagaggctacatcccccaccattcaccagattgttacgacgacgacttggatggagatcaatgctgttcagcccgatacgccccaatatcttcggtggtcagagacagttatcaagtttgaccgctcggatcatcccgaccgagtggtccacccggggcggtaccccctggtactagacccagtggttcgcaatgtcaagcttcgaagatccctcatcgacggtggcagcgcactcaatatcctttttgccaagactctggacgacatgcagatccctcgcgcagaattaaagccgagtaatgcgctctttcatggagtcatccccaggctatcttctactccactcggccaaatcactctgccggttactttcggcactcgggagaactttcgcacagaaaatatttgcttcgaagtcgctgatttcgagatagcgtaccatgctatactcggacgcccggcgttagccaagttcatggctgtcccacactatacctacatgatgatgaagatgccaggtccccgaggagtcatatccctgtggagcgacatcaagcaagccgtcacatgcgacaaggaaagctgcgagatggcccagacccgcgagatcacgcttgcccgagaagaaatccgactggctgcgtccacagcaaccgaaggagaagtgcctgcaaccaagatgccaaagagcggagaaggcgatgccaagaccaagaaaattcctctagatccctctgaccttactaagactgctgtaataggcgctgagttagattgtaaataggaaagcacgctcatcacatttcttcaaaataataaagatatctttgcgtggaaaccatctgatatgcctgatattcctagagaggtgattgagcactctttgcatgttaaggaagatgctaaacctatcaagcaatgactccgccgtttcgcacatgataggaaggatgcgattaaggaggaattgaccaagctgttagcagcaggcttcatcaaggaagtcctacatcccgactggctggccaacccagtcctggttcggaagaagacggggcaatggtgtatgtgtgttgattgcaccgacctcaacaaatcttgtcccaaggatcccttcgggttacctcgcattgaccaggtagttgactcaacggccggctgcgagttactcagttttttggattgctactcaggatatcattagatccgactaaaggagtccgactgcttgaagacttcgttcatcacacccttcggggcctactgctacatcaccatgccttttggattaaagaatgcaggagcaacttatcaacacatgatccagagatgcttttcaactcatattggtcacaacgttgaagcttatgttaatgatgtagtcgtcaagaccaagcagaaggataatttgattacggatctagaagagacctttgcgagcatccgcgccttcaggatgaaattaaaccctgaaaagtgcatcttcggagtaccgtcatgaaagttgcttggctttatggtatcccatagaggcatacaagccaacccggagaaaatcaatgccatcctcaacatgaaactgccgagctcccaggaagatgttcaaaagttaactggctgcatggcggcgctcagccggttcgtctcatgactcggcgagcgggggatgcccttcttcaagctgctaaagaaaaccgacaatttccagtggggacccaaagcacaaaaagcctttgaagacttcaagaaacttctcactactctaccggtcttagcttcgccacatccgcaagagccgctgttgttatacgtgtcggcaacttcccaggttgtaagcacggtcctggttgttgagcgtgaggaagaaggccatgttcaaaaagtccaacgaccaatatatttcgtcagcgaggttttggccgactccaagacaagatatcctcaggttcaaaagttgttatatggtgttttgattaccatctggaaattatctcactattttcaaggtcactcggtcacggttgtcacatcgtttccacttggggatatacttcataaccgcgaagtaaatgggcggatcgcaaagtgggccttagagttgatgtctttggatctatctttcaagccgcgaacttcgatcaagtcccaagctttagcagacttcgtcgccaagtggaccgagtgccaggaagacacgtctgcagagaagatggagtattggactatgcattttgacgggtcaaagaggctttcgggcaccggagcaggagtagtcctaatttccccgactggagaaaggttgagttacgtattgtggatacatttttctgcgtcccataacgtggcggaatatgaggcgctcctccacggattaaggctggcgatatctttgggaattcggcgtctgatagttcgcggagattctcagttggttgttaatcaggtcatgaaagagtggtcctgccttgatgataatatgattgcttatcggcaggaggtacgcaagctagaagataagttcgatggcctcgagctaacccatgttcttcgacataacaatgaggcagctgacagactagccaatttcggttcaaaacgagaagcaactccttccgatgtgtttgttgaacacctttatgaaccaaccgtaccaaggaaagaaacagccgagactacggacactcaagtagtagccatgattgaagctgactagagatagcccctcatcaaatttttgaccaagcaagaactccctcaagataaagacgaagccgagcggatttctaagcgcaacagactttatgtcatacatgagaccgatctgtacaagaaaagtccgtaaggaattctgcaacgctgtgtgtctttggaagaaggacggcaattgctaagagatatacactcgggcatctatgacaatcacgctgccgcacgaaccattgttggcaaggcctaccggcagggtttttttctggcctaccgctgtatctgatgctgacaaaatcgtgcgaacatgtgaggattgtcagttttttgaccgacagactcatttaccagctcaggagttgcaaaccatcccattatcctggccgttcgcggtttgggggctcgacatggttggcccgttcaaaaaggctatcggtggttacactcatctctttgtagctgttgacaaattctccaagtggatcgaagccaaacccgtcatcacaatcacaacagacaaggctggagattttttcatcaacattgtgcattggtttggggtacctaatcggatcatcactgacaacggcactcaattcactggcggagtatttaaacatttctgtgaagactttggcatcaaaatttattatgcctccatagtgcatcctatgagcaatggacaagtcgaacgcaccaacggtatggtacttcaaggaataaaagcacgagttttcgaccgactgcatccctgtgctggcaaatgggtagaacagctgccgtctgtactttggtccttgcgtactacacccagtcgggctacgggccagtcaccgttctttctaatctatggtgcggaagcaatgttgccaagtgaggtagaatttgaatctttgcgatttcgtaacttcagcgaggagcgctatggagaagaccgagtggatgatctcaaccgactggaggaagcccgtgaagcagccttaatccattcggctcgatatttacaagggatgcgacgttatcacaaccgcaatgttcgatcacgagctttcttagtcggagacctggttttgagaaaaattcaaaccacacgagatcggcacaagttatctcccttatgggaaggaccgttcataatttccgaagttactcggccaggttcttaccgactcaagcgtgaagacggtactagtgttgacaactcttggaatattgagcatcttcgtcgtttttatgcttaggcattacttttgtactttcctctttgactgctaacatcaagctactccttgagttatcagtcgggggctactataataataatggagtgtgatttttatcaattcaatttgcttacttgatttatcattgctttgttcgattttttggcttagtcaatgagtactgaaagtttttaagaacttttgcgggttttaggctcaataaggtttgacagaaacttttaagaaatccggggctgagtttaaatcatcaagcacaacataaattcatcagtattgtacaaattgtgcctccatcatcatcagaatacaaaatcaatcagattcagttttttcatcatcagagttatcagacccagtcggcttaagatcgttgtcatggaacctctcaactacatcagcggctatcttgtcagcagctttttgcacatcactgatgagatcaagggcggcttcctcacttgtcccatctgcaaagccatcaacagcatcaatatcaatcttcgggtaccaggacttggtcatcgccaatgccagactcacccctatatttccagcttctttgatgttcttaaaataggtatctagagtagatctcagtttgtcgaagatttcgacagcatcaattgaactcggaccattgttattgaaaaacatggcttggaccgagtggcgtagtggcgttggcgacttcgtctctggctccttcaagctttttgattttgctgaccaagacattgaattgagcctgagatttgactttacgatctgcacaaatggttcacattaacgataaagcatgaagacaagaatgctttcgaggtttcagcaacaagtaccttcgacgtcttttagagccgagtctctctgtttggtcagttcactcttgtctgtttccagggccttgattcacttttctagttcggatatcttggcagcttgcactgtatcgttgcccactggtcaatcacatgtgaaaagcggctcagacaagtcagacaagaataaaagttacctttggacgaaccgctccgctcaatgttggaatcttgaagctcggcgattcggtctctaagatcatgttcagtttttctagcaagctccttggcttcacgaagttggtctctggttgcttccagggttccaaggtgggggaccaatctctcgagagttgcggtcttcgccttatttctaagatggattctctgcattgcaatttcatctttattcagtaaagttgccgacagggtgattgaagctatgggtaaagagacatacatttacaagacgagtggcttgactgagtgtctttttcagcagacatacttcctcgtcttccttctgtttatttattacaattccctgcggttgcatttcatcatcccaccacttaactaagatgggtgggcaagaatcttcagctaaccgtatccggaggacctcttcttcatcgccgaccattgggccttacatatttatgaacgatgataaagcaatcgaagaaagtttgtcggatcaaaatggatttggatcttctgtttacctgttatgacttctggtcggggacgagcaggcccttgcaccctaacaggtgagcctaacctcgggtcggcgctggtatcttttcggagagggctgcttgtttgagcctctacttccgggatgtcttcattttgttctatacccgactggtttccagtcgggggctcctgatcagcacctatctcagcttcggccgactggtttccagtcggaggctcgttgctggattgtacattgtcggttgctggttgattattactcgggcgatcttcggcagttggcccggtttcagttgtaggaccagtctccgtgctggtcgtttcagagttctttctagaaggatcgatgtcatatggcttcctgcaaatttgagatatgctatcaacactacttcaatggtgaatgaccagcgatacgagggaaattgctaaatgactcatacctggatgacttcctgatttttggtatgggacgactggatgttttcttctttggattagcttgccttggttgtttctcagtcgcccctttgttgcctaccttttccacatcgtcgccctcatcgtcacttgaaaccaacttcctcttacgagagtctgactggttaattgacttcgaggtgttgggttgaacgtcggactggattttcggccctccactagcctggccagtctgccgacggggtgagcggcgttgagcgatcggaggatccgacttcatcaaggcgaattcctgtgcatgacattccaagttttcaattaaacttgtagaagacaaaaagatgtttttcagagaggccgagatgtttgatacgtaccggaggaggagggttgaaggcattgtatggcacgactggcaacaagtgcgaatagccgaccacgataacattcgagaagattttgtacattctctcctgcatgattttgaactcaagagattctgggtcctctcggttggggtcttgcttgccgtcaaactcgaaggctgtgcgggatctctctttgatttgctccccttgcagaccctgttctttaagcttcagcatgcggtccaacagggcaagtgcttgggcggcctcttctcctatgggaagtgagttccaggtatctcggtatactggaggaagacaggagtacccgggaaatgctggctcggggttttgcacaaagaaccaatttgcatgccaacccttgttcgaggtcttgaagggcatggagaagtatttttggctcaaggttacccttagttgaaaaccggctcccccaacaacgcacagtttgctcttgttcggctggggcttgaggaagaagatgcggcggaatagggcaaaatgcggtctaacacccaaaaaagcctcgcaagcatggatgaaattggcaatatggagtacggaattggggtttagatgatgcaaactaatcccatagaaatccaaaatcccttggaagaatcttgaggttggaagagaaaacccaccgtagaagaaatgggagaacaccacgacctcgtgtgtatcgggggtcggaaatgtttcaccgcacgccagacgccacccgatgatctccttcgccggaagaacactgtgcaccaccatttccttcaagttttcctctgtcacatcggaaggcgcccactgactctcgaagctttctctctcctccgccatggatgcgaattggatgatgcgatttggtttgagaaatggccgggaatggaagggagacagatgcggtggttgcgcagaagatttttgtggagctctagcgaatggattggagggaatttgtgaaccctagctttgccggtgtggtttcgcactgtagcagtgagtggggaaagtggcgagagtttcggcggggaagacgaaacgacgccttgccttcggcgtttatttcgctaggatatcgaaagtgctaatgggcctgggcctaaacagtatttcagcccaattttattatcagcgtggctagttgtgatccttagggacttaggcatttgtttttgctttggcaacacttgctcacgacagtatagcccaatgctgattaaaatcctttttgacgcagttagataattttttggaattactacaatgcacataaaaaggtgcccaacagaaaagtgttatactaattttgtaggccttcttaggctacaaagctgttcgggttttgttgagatgactggttttgaatagtcattctctcagcatgttatatgcttattttaatcatgacgtgagtcatagcttaggctatttagactcatcgtttgtcatgctttataccacatttgatggatctttttgagagtttttactcggatttttatcatatgtgttgatttatagacctttagagtgttttctcactcgggcctctttatatctccttttttgtgtattaaagctaaagcagtcggctggatgttttactaaacgtcgcatatgcttagctatatgatacattgggagactaggttgtaaaaccactcggatggagcccttcacagtctttgattttggtactagggagaccaagacaaaagaagttggagcactcggattattgcttgaattacgagagaagactatcttcgtcgactgtaaaggtctcaggggctactgtggagattgtggataccccatacctacatggcatgtatatccgactgggtatggggtgccatgtatagatagaatatctttaaagggactcgggttaaattccaaacttgtatgtcaaggaaatacccgggatcctagtctgttacgattgtattttatctgtaactacctattccattagggatatggactgtactttgtaatacgaaccccttcccctatataaggaggggttcgggtgcctcttggggcatgattttgctcccagatcatacgatcaataatacactcggcggatcaatccctggacaggagtagggtattacttcttgttaagaaagcctaaacctgtataaaattccttgtctctcaacccatccacttttctagtttgatagccacctccttttagtattgccgaaatcttgtttcgacaccgattgcgaggatatttaacatattcttttcacttgtgacagggctagaaaggtttcgacgaagatgggtatttggaatagaattgagaatatattgaatatggatcgatctggctacgtggtactaccagaaataattatgaggggaggcagttaccacgacttaatgatttgggcttaatttgttaaaattgttttcacatggggtggtatacttggtgagaaaggacacggatggttaatggtgaaagggtccaaaccactgtctgtcctaactctaaagtataattgcaagtaaacacatccaaaatgcaaaaccatgagaaggatggcacaaacccccaagggtttctcaagattaatgttggatgtttcatttgacattgattcaggaatcaggaggaactggggcaattgttcaagacgcaccaggaggtttcatagcaagcgtgtgtatgtataatatttgtatgtatatttgtatacaattaatattcttcgggaaggaccttttctagctaagcaactgaggtgtcatgttgattgtaggatttctatccctgtatggagcaagaaaacggatgcgcaagtttattattagggatgcaagcggaacgggcaagcggacatttttgtcccgcttatcccacttcgtttattttttcttttaaattttgtactaccatgcgaaaaatacacttgcaagtgggtttttacgtgggtagcggaattacccatccctatttattatccaaacttactgcttgtaggtagtggagacgatgcaagatggaggattctcgactacaaaattggctgcaatttttcacgaatgtggtatgttgagatttggtttagagaatatctatatagagcactgtaataagaggcaaactgcacgtaaatccgcctgtgtatctacaatgtagatacggtgctcaaggatcggaaccacgtgtgtgtgtgtatacgatgatgtgtttagcgtcggcgacttccttctcgactccgctcggttgggccagacgttggatcacccggcccatgggccattagccccgtccatttctgggcttcaccgagaaggcgccgtgtggcccatctcttctccacggcccatctcctctacgggtaggaataagttcatctgaggccccttaactcgtcaacgaattcgattttcgtcgctcaaccagaaaaccagacataacaggtccctcaactatcaaaaccggtgcagattagatccctcggcagttctgagggtgttgttgactgatgtggcgcctacgtggctaatttgactcggtctttatttgacgtggcattgacatggcgcttacgtggcaattcgatccggaaaaataataaaacccatgggacccgcatatcaatctcacacagtaaataattaaaaaaaggtaggacccacgtgggccccacttatcagtccaactcacccctcctcttcttcctcctctcttcccatctcccctcttcatctctcttgcgctgggggatgggcagttgggcaccagatgcggccgacgacgacgacggcggcggaaatggagaagagcggccgccggccatctctcttgcgcgcgctcaccggtagaccagggaaaccaccctcaaaaccgctgcgcgacgccgccctttcccgccaccaacccctcgcctccggaggacggaaacctcgcccgcgcacatccccagatccatggccgtctgcccgccgtgcgctacccagttctcccgcgcccgctgtcagaccacctgcgccgccatctgccgagtccgcgggtgaacggcgacagcaacagcatcaagcccgccctcgccgaccacaccgcgcagttgctcgacctagatctgctccccggcgcccatgcacggaagcccccgggtgcctacagtgaggcggcggcggccaaggcctacccgtcctgcgacgccatcccctgcgaccagttcgaggtggccttccaggccgtggagctctggatcgccgaccacgccgtcctgctcgtcaagaactcatcacacgcacatatgcactataatcaaacctactggctataagtagtgatatgcatacaggatccattttgaggcaaccatagttgagagagctacattggtaaatttatgacagaaaccgtagcaagaaactattcgattcaggacaaaaaaagaacaagccaatccagggttcgtgctcgccgacggcatccaggacgacgccgggaacgtgacgcggttcgtgatgctggcgcgggagcccatcatcccgcgaacggaccggctcttccgaagagaggggagatggggggagaggaggaagaagaggaagaggaagagaaagaagaggggtgagggtgacatgtggggcccacgtggccccaccattttttattaatttgtatgtgaaactgacctgtgggtcccacgggttttattatttttccagataggattactatgtaagcgccacgtcaatgccacgtcagatgaagaccgagtcaaattaaccacgtaggcgtcacgtcagccaaaaccaccctcaaaaccgccgagggacctaatctgcaccagttttaatagttgagggacctgttgtatctggtttttgggttgaaggacgaaaatcggattcgttgataagttaagggaccttaaatgtacttattccgtacgggtacggtgctgctgcttgcaacccgtgcggtgggctactctccaaggtgggccgcggtgattgagaaacatttttttttcttttcttttggagcacttggtaaattggcaagtgatctatatataccaaatgaaaaaaaaaaatgcaagcattccggtaagaaatttcgtccgccgtcacctaaatttttttcatccaccactctcgcgtcatgcgctcgtcatcccaagtccgggtcgaatcgaatctgatcgagatttacgtgcatgggattaaatttaaaccagttcgtattacaccaggagaatttacatatacgacaaacaaaaattggttacaaaattttctcaagttacaacccaaatataagaattaacggtagacgaagaaaataaaacccaaatcaagcaaaaatccagccactggaatcacggtttcaccggttctaatcttgggctgcacataacatgactcatcgcatacgctcccaataggcttcgcgctgtcatcggaccttgctggagacacgagcggcatgagtttgccgccaccaccacctcccaatgctagatccagtgaggagggtacgtgcggagtggccgccgggagtagctcaattgagttgtcgctgccgccagccaccgcatcacaagaccagatccggtgaggaaggggcgtggagtggccgttgggggtagcttagttgagttgtcgccgctgccggccaccacatcccaagaccagatccggtgaggaggaggcgtggagtggccactggcggtcgctcggtcaagctgtgcgccaccactagtggcgggatccaacgagcctgaagccggatatagcgaggagccgaggagcagggcagcgacgacgtcccgacgaggaggaaagaggtcgacaatgggggggagggagagtgctagagctggggagggagaccgatacatgcaagcatgccacatccacacattaagcatataaagctcaatatgcaagcatatactctcaccatctttgaatatttgacgccgttgacttttttaaacatgtttgaccgttcgtcttatttaaaaaatttaagtaattattaattcttttcctataatttgattcattattacatatcattttatgtatatatatagttttacatattttacaaaaaattttgaactgtcaaacatgtacaaaaatttcaacggcgtcaaacatttagggaaggagggagtagtaattatatctataatttatttcattctaaaactaaacatacccatactaaatcatcattctcaaatcatttttataatatttcaatccaaatcatctcaccatttttctaatatgtaatataattaccacatcaaattaagcgcggacatcatctagtatatattaaattcccagtacatgcgttgtgcaaaagcgtagtgagtgcctagtatagtagtacacatatgtggccacacttgtcttttccaaaactaaaggcccaaatacgtcagtacatacgtacgtcagactacacagtgatcgatcactgagatgtacactagctacatactagtatatactatactactactagtactatagtataggagtcacgcacatgcaggcaacgtcggaggcgcaacacccggccgcccggttggccggccgccgccgccgagattgctttctaattctaccaaatgcagccgatggagcgagagacgaagctagcagagagcagataaacatccaacgatcgatcgatcagctatttagtcgtcctagctagccttggatcatgacgatgcatgagcatgacgacacaccactagaggcgcacgagctcgcgagaccattcgatcctagctcactactggagaaactatcttttccggtcagccaaaaaccacaatagtcccggttgcaataaaaatcaggactaaagatggtttttaatcccggtttataagcaaaacgggactatatgaactttagtcccggttattaccaccaaccgttcacacgctgtcaagggctgtcagggctctcgggatctttagtcccggttagtaactccaactgggactaaagttcggatatttaatcccggtttatattatcaaccgggactaaagatcccggtgatctttagacccggtgagtaataccaaccgggactaaagtcaggtaccgggactaaagatcaaaacgcactatataatctctagtacttttcctcttctccaatccacacacaaactcctccctcttctcccctctaatccttatctctttccttgctcttaccttatctctttccttgtctttccttccttctcaggaggagtgagcgcaggaggctggaccggctgggtggtggcctgcgcggcggcgtggcggtggccagagaggaggggaggtggcagcggttgcaccggccgtgggcacgagaggacggcgggccggtggatgggagggcggcggcggcggccagcggccgacagtgcccactcgtggatttttgtcctttcttttttttcttttaagaatttgtgattcgattgagataaagaatttgtaattcgttgtatggattgagatatataatttctttttttttgagaatctgtgatctgagatgtataatatgtgatatatttgatttgtgatatttgggatgttactttgatttggggtttgatttggggatatgcatcccacttgattttggggaaaatagttagggagtaagtagtaagtatcaacagaaacaatgaaaaaaaaataaaaaggaaactaaccgggactgtcgacagtcccctctttagagataacgatctgccggattcgaaggcccggttgaaaaaccgggactacaaagggttacgaaccgggagtaaaaatgatctctccaccagtggcttaattaagtttaatttttgtttttaaatttaacttgccacacgcacgctggctcgctccattgctgaatgtccgtgttttgctatggataaaagaaaatgtattaatgtgttcttcattctttttactgtagggaatattcatcttaatctaattttttacatggctatccatttagatttgatcccttttaatattaataagttcaagggggtaacttgtaaaatttacaatggaactagtgaagtggcagattcactaccaccatcactattttcttttataggagcatagatattaattcctgaagtttacataataaaatcgttcaccattgctgtagttttctcaaatacgtacccaaagtgtagtaaaatgtaaaatgatagtttacaataattggttgtagttttttaatataatcatttactattaattgttgcaattttgtgaaacacccagttaaagttgtagtgaagttacagattgtaacaaatggttgcagttttctcataaaaccatttgttgttgttgtaattttgtgaaaagtacctaattaaaattgtagcatatcgatagtattgaatacatggttacagttttgtggaatacacagttaattaaagttgtcacaaaatgattggtttgaataaacggttgaagtttgggggaatctacttttttacaaaaattaagataactattcacatttttctaattttatgtgaagctattttttttaagatcggatttgatatatcactgttcgcttttgattccaatgatatatatagtatacaataggttctataataaaagtcaagttgtataactcttagctagcttgtattagaagatcatatacttgttgtgttgaaccaaatccgtattctcgaaaacagaaagccggaagaacagcaatcgctctaataagttaatttttgaaagaagttaaaattagcttccctaaatataattatattttgcatacagctatatcaattaacctataataatttggatatacgatgatttggactatactttttaaggtaacgtggtgtcctttttcaagctatatatatagtgctcgatcgtgtacttctagtttgatgataattaattatataacctgggtatagaatcatactggtcgtacgtaagtaccacatacgtacgtacgtctatgctagttgaattctatccggcagggcagaggatcatatcatatcgctgactcaatggagtcttgcttggctgccactatagtgtgtgtgtgcgcacatgccgtgcgctcgatattgcactttactgtaccacatgcatgctagcctatcagagagagattaaataaagatgctggggtacatttgcgattgagccaagcccacgtgacgtgagctagctagctaagtaggggtggcaacgggacaaggcggggccaggttgaacatgaacgcccctgccgccccgtgcccagccttgcattgctaaccgggtggaaagcctcacccgtcatcgtccccgcaggggacctcgtgggtgagtgaggccccacaattccgtatagagtcaatacacatcctctaatcaatgcaataaaatgcataacaatattctcaaaccaatacaaacaacaccataaatcaacaaacacatagagtcaactcgttagatctgaactctgaagctgcccgagaacaacctcgtggctccagcgatgaatcgtgttgtggtacaccggtgagatgaccgatggccatgagagacaaggcagagaggcgaggcaacgatcatcggcggtgagaggcgaggcaacaaccatcggtgatgagagacgaggcggcttggtgacgcggcgacaaccgacgagatgataaggtggcacagcgaagacagacggcgatgggagaacaaggaggctcagcgacgatcgccactcggcactgtggcgagaggcgcagcaatgaacagcgctgtggcgagaggaggcgatgagcggcgttgttgcgagaggcacgcgcagtggtgagaggcgccacggcgtggaggtgagggtcacgcggtgagcgacgtgtcgagcggcgactgtgcgttgagtgggagttggggaattatggttttagtttaggggctgtctatataggaatcgaatgatttctgaagctccaatcatgcagattttatctaccataggatgcacatccagcaactcagaaaaagtgatacaaatagatattacacttaaaaacagatatattatttgattatttgaacgccatttttttaaagcccaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtccatatccagatccataaaagcccattagtaaaaagcaggcccaagatacaaaattagaagcaaaacataaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaacatggagctaggagaagagaaagaagagagaaaaagaggatccaaatcgcagatggaaggagagagtacaatgtcagaatcaaagagtagttctagaggaaagaagaaatcaaagacaacttttgaacagaaagttgagatccatacaaaggaaacacagaatctggagaacacaaagaaaaaacaagaggaaggcaaaatcaagagaaacaagaaggctccagttcaaggttagttcaaggttccaattcttatcccctatatacaattcctgaaaaagatcaaagagagagtttaggtcaaatatacaattcaaaagaatacatgaaattgctgaatatgtcaaatgaaacaaggttaacaatccactttgctggataaatacaacaactcagaactgaaaatttcatatgtttgctctgtagatctgaactatgtaatgttaaaagtaaaactacactgcattcagtactacaaaactgcattctggatgattgtattactgtgtactattgatgaataccaaactaactttataaaaaaaacatgacagattgattagtcttccaaccttactgaatttcactctgaagatatcacagttatacagttatacagaaatataacaactaggccatatagcatatcctgaattgtcatacattcaattttatcagcataatcaccatattaaactaatgacaaattcaaatctcaatgtcaaccacttgtctcatccaactcaatattacataaaagttcaatatctcatacagcacaaacaaaagagccaattcatatgaactcacaaatttcttaacatgttacagtaaaaaagtaataaaattacatacaagaatcacagtaattctagtattaactcattgtaaaaagattagttcagtaaacaaaatagtttagctcacacaatcatgcacaaattcaggaacacattcaagatatgttttaaactcaagactatctcagttcaatgtttctctcatcatcagacaacaaaatgaagatttcagataatagatcattgttgatttgttcaatgtctcaaaatagaatataatgaaactagttacagtgaacttgtattacaaatatatagagtgaacactacaatttcaattgaaaatacatgtaactacaaagaaactatgtaaaattcatatgaaatcatgatctaatgcagtttaatctcaatttcaagatgatttcagatttttcgagcaaaaaacagggtatcaaatacttcaaaagtagtacatatgtaaaaaccaaaacaaatcatatctaattgaaatagaaagaaatagaaaagaaaaagtgccatcagatagtttgttccataagtaaattttaactggaattacagtagcattacactctaattgaaatacttatttactgtaatactacttatggaacatactcatacaggtttgaaaaacatttaaagactatcttgaatatttctttacaggtgtcatacaaaaggacaaagaatgcaaaagttctaaggaaatagaaggaaaaaatataggtaaacaagagttacagtaaattttaactggaattatagtagcattacactgtaattgaaatacatacttagtgtaatattaaaattattttgaaagaattatacaaactaattcatttgttcacttcactgtctataatcaagtatcaaattgattgtagttggatttttaagtagttacagtttctgtttactggaattatagtataatttctctgtaatacaaatatatgttcactgtaaatggacttatgaaaaagattgggaaatacactctatgtttcagaacttgctggtttagaaattcaaaagttctttgcaatattaatttattctttctatgcaggtggcatacaaaaggagaaacaaagcaagagttctatggaaatagaagaaaaagaatcaggtgaacaagataatttcaaattttattcacaaataagaagattaaaatgagtctgaaattttttaaaaaaatgccatcagatataaaaaagcacttcaaagctctgacagaaatggatacagagattataagtcaatcaaatctgacagaaattaacacagctatgttgagctcaggtaagaaacaaaaaattatgtagttcaatgtattttttaaaaaatgacaaacatctagatgatctgaactatatactttcaagtgggtactttttaaaatctaaaaacattaaaactagttacagagaagaagtaataaaaatacatgtaacaataactgaaaatacagtatctatcttgacttccttcataatgatttttattttgcaggtatcacaattgaattgtcagaaggagaaagaagtattcagtcaaaacaaattcagaatatgaaacaaagtattttgacagagtataaaacaacttttgtaaactcaggtaagatcttacacaggtattcttattctgtttcagaacaattctttcattacagttaatttgtataaaaattacataaaaaactgtaattccaatactaaaaatttcaaactggaatacaaatttactctaatttttaatgttgaatcaatcaatctattgcaggcataataggtaatgaggtaggaagaagcaatgctctggatgaaccaaacacaggtaacaattcaaaatggaattgaacaaatgcataattcctttagtaaaaaaacacaaaatgcaaaaattacagtcaatttgaaacagaataagaataattttaaacttcaacttgattgttatacagtttgactggaacctatatataatttgatcacaattactttaattgcaaatataacagatcatattggattaggagcagaagatgcaacagtagaaaagcaaagtatggataattcagcaagtatgacagaagcatttgttgattacagcaacaaatattcatatgatgaattatctcttttcggatcaatgaattcagtaagttcatattacaaagtttttgctattaaaggaaaaatttgaaggtggtagtcaaaatactatatgaaaatttatttgcaggttgcaaatatgtcatacacaagcttaatggaacaaatcatatcatcacagcctacgatttctgatatgcaggtaagaaaaacaatatttgaatattatatataatttagttgtaatatttatgtttttattggaatttacaggaacaaaattcagcacactctatttttgttgcgagtccaagtgcatttcaggtatgaaatattaattatttaattgaatctaataattcaaattcaaaagcaaataagtattgatataaaaattttgttttgcagaattcaatgatattaacaacaaatcgtactgatgctaatattgaagaatggaataatgatgcggcaaatgaggcatgttgtcttggatgtattacttcttgttgtagtattaaaaattatgataattttagtaaattttaactttgtaatgtaattcaaattccaggaagatgagagtaatgaagaggatgcaatggataattggaatcttgatatattcaatttgttagatggtgaaaaggtaatttttgttgtttgtacctttttctctagataacaatgattgatgattgaagtttcatagtctgcaaaaaaaagagtacaaacattaatatttcttaaaaaattaaattgaataattcagattagcaatgaataggctagaaaattaatttcagaaactaatggaactgcttttttttttgcaggaaccaagttcaatggataatcatcgatgtacttcagttcaaggaacaagagatgatgacaataatccaaatgataactctgaaacaaatcaacaagagctgatagaagaagacataaatattttcgtagagaatgaacaggaagaagctacaaagggcaataatgcagcaattgatagcagatatataccaagagttggaacacaatttaagaatattacagaagcacatgaattctttaacttctatgctctgttggctggattttctattgtcagggctcacaactaccacacaacaagcaagaaaaggaatggagaagtgactagagtaacgttcagatgtaatagacaaggcaaaccaacttctcaatccaaatcagtaagcgcagaggaaacagtggtttcggaaagaaatacaaatgaaaatgatgcaacagattgcaagtgtgctctggttatttcagagaggaatgagatttggaatatttcaagggtgcaattagaccacaatcatcaactaagtccaagagatgaagtgagatttctcaaatcacacaaacacatgactacagaagaaaaaatgctcataaggaccttgaaggaatgtaatataccaacaaggcacatgattgtgattttatctgttctaagaggaggattgacttctttgccttatacgaagaaagatataagcaatgtgagaaccacaattaacaaggagacaagcagcaatgatataatgaaaactttagaatttttcagaaggaaaaaagaaaaagatccacatttcttttatgagtttgatttggatgagagcaagaaagtgaaaaatctgttttggacagatgggagatcgagggagtggtatgagaaatatggtgatgttgtgagttttgacacaacatatttcaccaacaaatacaacctcccgtttgctccctttgttggaatttatggacatggaaacacaattgtttttggttgtgcatttttgcatgatgagacttcagaaacatttaaatggctgttcagaacttttttgaaagctatgtcacaaaaagaaccaaaaacaatcattactgatcaggatggagcaatgagatcagcaattgctcaagtatttcaaaatgcaaagcacagaaattgcttctttcatattgtaaagaaagctttcaatctatctggaaatttgctcaaagcaaaagaagggttgtatgatgagtatgaagacattataaataactcagttacagaagaagaatttgagtatttatggcaagaaatgattgacagctttgaagttcagcatatcaattttctaaagcacatgtggtcaattagaaaaagatttattccagtgtatttcaagggtgatttctgtccatttataaaaagcacagctctcagtgaagggactaactcaaggtttaagaataatgttggtccacagtacagcattacaaacttcatgatagagtatgaaagagtaatggatacaattcaaaacttggaacagtttgatgatcacatttcaaggacaaagaaaccaagcaaactttggtcccattactacattgagtaccaagcaatgagaatgtacaatcgcaaaatcttcatcaagtttcaagttgagttgaaaagaacaactagatttcaaataaatgaagtagagaagttcaaaacttatgaagtttttttggcattgaatcaaaatattcaagtaatcagaagaaggaagtaccttgttattgtggacttggaaaaggaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgagggaaaaggcaatggaaatatacctttagcacagagctcaatcctgagattcaacattttgtcaaggaaaagtgcagaaatagcatcaaatggatcgaaaagctatgaaactttccagtttgtagtggaagagatggacaaaattgctaaacaattggaattattgtgttcaaataaagatgctgagcaggagatcaatgattcagatccaaatgcagaagacaatttgaactcacatgaaaaaggcaatcaacaatctgaggaaaatatagatgaaatattgttggatctagatattgcaaaatccaaaggcaggccaactcaaagatacaagacaatcagggaagaaatacagcaaaaagaactatatcattgcagtcattgtcagaggacagatcacacatttccaacgtgccctctgaaacacgttgagtttgacttgccaaggaagaagagaagaaaggttaaaaatacaagagaacaggtaacaaaaattacaaatccatatgaattgaatttttttaaaaaagtaataaagaaagatattatttgttgcaggatggtgtagagcagaaaaagaaagatgtttcaaacaaaagaaaagatttgcaacaagatatatcacaggagaagcataattctggggctgaattagaaggcaaaaagaagagaaattcatcttcatcaaaaaggggtggcacaaaagaatagaaatggaaatgactgaaaatagagagaggtttacttgaatacaatggaaatagacatattccataagtttctgtaatattctagaacatgtactctggtttgtacttaaatgtttgtttcttatatcaactacattttatgaactactttgcattttatctaccacatgagtttatgtacagttgtagccctgcaaaagttgccaactgtcatatttgaacaaacaaaatttattccagaatcaatttccctacaaataaaaagagatataaaaatataaggactaaataaaaaacaaaattgtgaaaaaaataatgattctaaaaaaaatttacctgagcaaagtcaatcactagtttctttgttcctgtaccgagaacagaattgtctggatagaagaaaagacggttgacatattgaatcctaatgttttgaatgtctttttgagagaaatggtttgtcagctgaactcttggaccccatagttccatgtattttagagtaaaaactccgcaatcaaaactaggaaaaagaaaaaggacataagtaaccacagttacttatcataaaaaataaaacaaacaaaaaaaaattaaaaaaagctaatgcagttatggtcatactatttactctgtaaatttactaatgaaatctattgcaattctagtccatgttgtactaagaaacaggctcttatcccatctagtaattctgaatgaaacaattgacaaataggaactaaattttttgaatgataatcataacaaacaaactaaaattgtgcattaacagcaaaacaaacaggttatgcaacaattagaaaaacagaatagtcaagaatttctgaatgaccaacagaacatacaagattcctgtcaacaagagaacaattgggcatctgtacaactctaaccaacaaaaacaaacaaataaaaaatattattggactaaaagttacagtaaagaaaaacaacttacagattattttggcgaggtactggtggatatacaattttgaaagcatcaaaattgatttgatattcttccatgatggaattccaagcaagtgcaaaattggatgtctacaaaacataaaaagaaaactctgtaattataaattccaaatcacaaattgaacagtaatacatatatttaaaaatttgaaaataaactgaccaatctattcttaacttcatcttgatattcagaaccttcttcatgtaatgagtcaagaaagacaaacatttcatctttcagatgaacaatgaaaacaaaccagtggcgcttgtagagaattggaaagaagagctgaaacaattaaataaaacaaattataaatgtaaaaggaaatatgaaattaaatatgacaagtaatttacaaattcacaaaccatttggattttgaggggtgagataaatgaaacaaatatcggcagaacacagagacaacaaaattagaaacttcatgtccaaaattaaatgatcctccaaaagaactgaatttgcagtgaacaccatcaatttcaactgcatgtcgtctacattcagaatacaaataaattcaaattacaaatcatacattgaaaatgaagattattagaaaaaaaagtacaaaatagtacttactcttgatatctgcttgttgatagagtgcagacagcattataaatttgtctttcatattgtgagactgtgaagtttgatctttgaggagtataaggatctgtgcaatactttgcgggattgattacccttctaagatcgtgatgaattggttttgttccagaagtacttggattgaaattcttcatgttgcataacaaaactctttctggactagcaaaggttttgaagttttgtttctgagaatccaacataattctattcattttattgtacatcatgttggttttgtttccaatatcagcacatttcttagagaatttcttttcaccaataaaaacaacatcaggtgaatcctgaaatttaacaaataaattaaatagtacagttagaaacatattaaaaaaagaagatcaaaataactagaaataaaaaataataattattagcttataaccagaacagaaaaatgataaataaaagtaaggtatagggcatggaatatttgaaatatcaatatgaaataacagttaagcaaataaactagtgatgttcaacagcaaacttacaaacttgagattataaattgaataaaaagaaatgaataagcagtgagaagaaaaaccttttggaataaaaaaagaaagaatgtatgttattactagaactgaaatacattgtaacctacaagaattacagcaaaactatggagaacaataatgcaaaaatggaattagaaaaatttttaaacaccatttaatttcaaaaagggaacatcaatgaaaataaactatgagattattcatacctttatgatgtgacaacctttttcattttctttgttttcattgagagaagcattaggagaagttgaattttcaagtgtcaccatgtacatcttatcctaaaattttaaaatttaacaaatgaaagtttagtttgtatatacagaagaaataaagaaagaaattaatgtcagaattaccggactgtctgaacagattattaggctttcaacagcagcagcaaaagtttgagacaactttcttggagtgatctgcaagatttgtataaatcaatataatgttctaaaaaagtattccttatgaaatttgaagttacttcacaagtaccttatttcttaaaacatgatttggggagtatgaatcaggaataacttgatatgaatctgcaagatgagcagttgtaatttcttttttgaaatcatcattttcatgatggaggtcatcatcagaaccccagattttaaaagacggttgatcatgaaaaacttgattgtttcgagctacagcaataacataagaattagaaacaaaaaatatggcaacaaaaagtaagaggaccatagtacagtgcactaaaatcacatgacaaaagaaatgaaatattacaataactcaatttttttgatgctagaacaattaaagatatacaagtaaaaacaaatgagattccattaaaaaaaatttaccagtcaaggcagaatttttctctgtttcatctggtggattaataggaacatgaccttcaatgttaaataggcacaaacatcaataattcatatttaattttttaaaaaacagattaacaaatttagaaaaaaaaataacctgttttgttcaactttgtcattatttcatcaatgttgatatgtttaatctgcacagataaaaaatgacagttaaaaactatcaacaattacagttctatatattcagattataatgattgaaataaaaatgaaagaaaaacctcttctgaagaattcaaaatggtagacttattcacaggattaaattcttcatttggaattggcaacttatcatcatctagtactgttttactgtttccctacaaaaaaaaataaaaggacaaaaaaatgcttaatgattcacatgactattagaataaaaaaaattgaaatgagaacagaaaacaatgtacctttggagatgaggtgaaattgttatttttttgcacagcttgattaacatcatcattattttcttcaactggttcatgatctggttcaattccttaatttaaaatttataaaaaaaatcaagacatatgaatggaaaaaaattaaaaataaaataaacaacaaaattcgtaaattaaaagtaataacctgaattttcatgtgtagtaggttgagtaggataattggaactgcaatcagctaacaacaacagaacatctataagaagtttcttagccttgtcttcaaagatttcatcttcttttccaaaatgattacagagcaaatgacaaattttgtcttgaacatcacttggcaacagatcaccaacagaacttttgagcatatcagcaaatgaagatgagctattattcacctaaaaaattaaaacagaattttcaattccaatctaagaaaatttattagaacttgaaaagataaaaaatttgaaaaaaaaactaaacatttaccatttggtaacaagttgaagcaatatcattgactggtctttttccatacactccttcagatattttatcaaatttggaatagtccttaatcatagatcttttccaaactttaattcttggtgtatcaagtaatactttttgtgaaccaaagttgagaaaatccaggtaattaacctatgaaacattgaatatagaaattaaatgaatagtcatttagtacaaaatataaattagcataaatggagggaaaaaaatttaccgctaaatggaataaacaaccaccaaaagttttcgatttctcaatcttgctaatgtgttccatcaaccagtcaaaacctaacttgcaccagtccaaactttcaattaagtccatgtcttcaaaggcacttaggtattttgtacctggaatcaaagaagagtttggacaaaggaagcaattcaaggaaacaatcataaagcagatgagaatttgatcatcaggaaattcttcatttttaattaacttttctccaatgaacttgacagaaggaatagaagttttcccaaaaatctgaagaatcttttgtttgccagaatcaaattttgaatggattgtactaccaccaacagggaggcctagcacaacatggacagattgcttgttcaatggaataagtttttggcccaaaactatatcagaacagttcacatctacttgttttgcaatccagagagcaaaagaattgggaacaaaacacttgtcaaatagcagcatgctttgaaaacaagaattttcaatgactgttttgtgatgtggacttaaagaatcaagaacttttgagaaatatttgactgagaatctagagaatgcatcagacttcaaatcagtgtcaacatttttgtcctgacaaaaagaaaataaaacaatttaatcaataaataaaaaccaaacatagatataaaagggcattgcaaaaaactaaccttaaaattttgatcacctatgttgtgatgaatattaagcttttttttcaaactgttgataatttgatccctttgtatgatatcacgtagaacctgatttatcattacatcattgtccaattcaatagattcagaccatttcatctaaaaaaaattcaaaattaaaaacaagaatgatggaaaaatataaaatgaaaaataacaaacaaaataattaccttaatgttatcatcttcacttcttttagacttactgagtttccttttcaaagttttcagaagttcatttgtagaaatttcatttacatgtggttgtgaaacatccatatcctaaaaaaacatattaaacaattaaaacattgcaaatgtgctatgaaacatggctacaacagagctacaactgcatactaatgaaaaaaataatgaaagaataatggatactattctgaccttggaacaacatgacaattcaagaacaaataaaacaagaaaatattggtcctactattacattggctaccaagcaatgagaatgtataattgcaaactcttcatgaatttacaaatggaaatgaaaagaacaactatattacaaatcaatgaaattgaaatgtaaaataaacttacatgactggctgagttatcatcagaatcacaattgtaatcatcatctttagcaggcaaagactcagaattaatatcatcagattcacttatgggctggctacaattatccaattttgaacgcttttggtgaaccatctattaaaaatagcaataaaaaatcaataaagtttggcagactataaattataaaataagtgaaggtatgcattaaaaaaaagatatatataattcctcagaaattgaccactttattcaggaaaaaaatgaacattacttaaacatggcaaacgaacaaaattaactcccagtacaatatatacgttggttagtactttcaacttgtaagtcaaatgttatagtatatctccatgtcctcacaaatatatgcaaagaggtccacactatgataaaaagtcaaacaatctcacaaacttaagccctgtacacctgattcacactagggaacatgaccattccacagttggtctatgcagaggcacgcaatccaatgaatccagtctactacaaacattagcagtagaaccgacacaaatggcgtctaaatccctaaaggggaagaaatgttagacctaagtacataaacacgagtccaataacaaaaatggggtttgcactagagtgtaatccagtctactacaaacattatgaacagctacaaaaagacatccaaatcccacaaggctaacaaatttgcatagatcataaagttctcaataaactagcgtaacaaaatcaattaacctgcctgcctgccctaacttaacataaattaaattaaggggctgtctatataggaatcgaatgatctatataagttaaaacctatattgatctacacttcagatcaatatctcaggcttcatatttctagcttacatttgagtacacacaaagaactagaaaacaaaatacaacgtggatatagtacttatgtagcaatagtaatacaacacacaactaaatcacacacatcatcatgatgcaaagtttctgaatctgtacaacagttcttttgatgacccatctaataattaaaacaaagggagagagacaaaaaaaaagcacaaggagttattataaggatgcacatattagaagcaatggaaaaaatgaaatgagaaatagaacattgcatagcacacagggaaaatagaaacataatcaatacataaatcacagcaataattcactatcagatctacagctaacaataattcatcagctagcaagctaaacaaatagttgaagactacaaataaagtacaaatagtcagagatacaaaataatgcaacacaaacttctataaatccaaacatgagcaaacttcttcacaaacatcattcaaaacaaatcacacgcatctactaaaatagcaactcgcagattcaacaaatcacaacctaacatccggagaacaagggagcaactatagaatcaactcaaattcccatgggaaaaactagatctaactttacacatcacagatcacatagcacaattcgtaaatcacatatcacatatcacagatcacacatcacacatcacataaacgaaactttctagaacatcgcatagcacaaatttatgaacaaatatatcacaga

SEQ ID NO: 28334 - DNA, 14170 bp, Oryza sativa
aatctagcgcaatcgacggcgcgacacctccgcaacagcagcagacgccgagtcgactcgccgaagagcagcctcgtcgcctcgctaaatcgccaccgcgtcgccggagacgatgagaacgagacgacgaaatcgtcaacctctccttctataactctctctctctctccatcggcaaaagcacaactagcggagcaaaacaacaacgaatcgagcagcaagctaacaaatgaagctagagaagaatcaaaacatactcaccggagaaaaagaggagaaggagctcgaggacaagatggagaagcccacaccgcaaactccagtggaatcaccgccgcgacgtagcctgcatgaatccacaccgcggcgtagcttacgccgcgtcgtcgcttcccggagtcgccgacgaaatctccgccgaaatcgccggacgagacgacgaggaaaaaggcaaaaagcaaaatgaatctctcactctctctctctagtctgattcagacaatctctctctccggtgcggatttcaaaatttgaatagtgtatgtgggtcccaccattaacactctctcacaaaaaaatctctctctgtcggcaacacaaagtgggtcccacaaaaatgtaaaaaaaaaaagaagcccatttagcccacgtatggaagcccgaacttacaataatcaaaagcccacatacaaaagaaaacaaaagtttagatagcacgaatctcaaacaaaatccaagggaccaaaaaacgaatgatacagcccaacaaaaacatgcgacagccatatagcctttccgtttagtttatatatgggctatttaattgggccaagtaagcctacattgttgaaatgggctacttttacaaggaaattcacattgcagggtcccgccagatcacccatggccaggttggttacaacccgttccttccccggaaaattgccacccctactagctatagctagcgatctgctggctgccgtcactacaacgtttgttccctgtgctctaatatatagctattagttacatttttacggtctcttcgattaatctcttaagaaaatgggtgtgatattatgtctttttttctaagaactttattatgtcccttcaaaccctctctcggagactaatcgaacacggctttaaagagactgtaaagtcactccttaatttaagagaagacagccgtgtttatctagtgaaggagctataaactttgcctttcttaagaaaatgactagtcaagaactctattaattatactacatttcagtggccggtcattctgatccaaatgtgtcgtggtcgttaattaattaccactcaaaatcactgtccatagttcggcaggcgactcctaccagataagaataaatacattaaattgccactgtatacgtagtgctgatctatcagttaggaatatttgtacaatcatataggaagccacatggaactcaagtatgtccagctagccactcttaattaggtggattagtacatatatattagctttcctcctcaaaaataaaatgtggataattgtcagctacaattttccttttcattccactttcggaagttaagggaaagaaactgatagtgaaatattaatatataatatgcttgtaagaatacttgccaattgagattcggaaagtaacttttgcgtgtttttgaaaaggaggacaaagggaaccattttgactcgatggttgcatataaattaacaaccaaaactaacaaacggataataataatccataatcgattcctctttcaaggccatcgtgttcctcttacagttggttacataatccatgctttgcccttgatcatatagttaaattgctccgatcatttaatctatggctgataagcctagcaacaatgaactaagcaagcaaaattaatttttgggtaagacatttaaatatatgttttaaagtactttaaaagtctatactagaaaaaaaaaactactaaaaatcaatattattttacgagaacccctataaattgcaggcgggccataagtgtcctttcatgcaaaaatcacttccacaagaggtgattcaggggtcacatgtgacaatttatttttgcatgcgtccccttaagaggtccacctacgagaataggtgcattatcacaggcggaccttttgaggggccgcatgtgaaaatacatttttgcacgtggccaacgtgtgacccacgcaacccactcctcctttgccttttcctcggtgcgcatacttcctttttatcttctccttctcctcctctccacctcttccctttccatcccatcactcatctcccactccctctccccttctcttctccatcaccggtctcacgagcaggtggcgtggagacggtggccacaggggcgggcgggcgctggcgtgcggatccactgctcccaacctaaggaacagtgacggcaggagcgagcggccacagcgaccggctggtagatccgccgtgcacagatcgaggcgccacccccatcctcgggagcgagcggccacgacagctggcgggcggatccgttgcccttgtccatcggagcaacgccggtgggcggatccgccactcccgccctcaggagctacggtggaagcaaacggtcacggtgaccagcaggagaattcgccgcccccgccatcaggagcgactgcggtgcagggatatgctgcccttgtcctcgggagcagcgggctcaggcagtgggacgggagcaggggcgacgatgatggcagtgatggaggctgcgatgatgacaatgacggtaacagctgcacgatgacgatggcagtgatggctgctccaacaacactggtggtggtggctgctccgacgacgacggcagcagtgactagtgtcgacgggagatacccgtagaccggatatagagggtattggggtacgctggtacgaggatctatgtaatacgacatcaagcaaataaaagacaaggattatactggttcaggccccttgataggtaatagccctaatccagttgatatgggattatatggtggaaaccacaaattacaaaggaaatagcagaactcgatgataccgacgagactgtagtcgagttggttcgactagatcatccggcgacttggctcctgtaggctccgactttgtaggctgtggtggttgtgttggcgatgagattcgatgccttaggtcctcccggggggtcccttttataccgcgggtcagttgatctccaagtagaacttggagatatcagaccccacatgatacagtaaagacccagttcagtccgagtaggactccttccgtccgtggattccgtttttgttacacgatgaatttccttaatgcgtacaggaaacatccgtgtacgcacaggtataccgtatcgatatacaacatacatcgaagggtagagggtataccttatccataaccctgacaactagagtttcggtagaatcggggacgctagggttttaggcgactttgttttttgggattttttttaccgaaactattttcacggacgatcagcataggtgacagtgtacgtcaatccctttttcacatgcggttgcgctacccgcatgaaaaaatgttagatttccgcagatacctggatataggcgagccgcttggtcatatacaaaaatcagttttggccatatggaaaaatgatttttgtacttaaaaaaatctcaaaataaactactttctaaatcaagttttagaatttaaattttggtcacgcgcgcagttgataagacaacaagtatacaatgagacgcttaaactagatatctggcgaagaccgaccgttaaaccaggaaagctagagcaatacatgaagtggtttaatccgagtaaaagaccggagatgcatatatgaacccacaaactcaacgattcaaccatttgtccgagtttaacaactgccgctaatttatatggtccaattacctcaaaacttgatgtaagcaaaagagacctaacaggatatgtacatatgcaaattaggtcaggtttgtttggtttgtgaactgtgccaagtgaaattttggcaacattttgctacacttggcgtttaactgttcgctagaggccaaaagtaggattaagtcgcattagttctccttatctatttataaagtagaatttcaccaaattaattatgctgggagctagaaaacgattttggcacatccatatcttggtaaatccaaaactttggctttggctcacacataggacgtatcctagctcctaacctagtccaatataattaattcacttggcatgcagtttactcaaatctagtaaaaaaaatatagcggccgttacccaatgtttcttctccacaatcatttcctaggggcaattgatcaataaagtaggtgcaagcaatccaagcatgcagccagtggaagttagaatcgatcgacaagagaaaaatcactcagagaaaaggatggttgaattgatcaggatgtatcaggccgcgtgagtgtaatgccaatatggcattgcaatctgtatattatattcatgtttactaataattaatggaaaaattaagtcctctgtgagctagagaattttctttagttttgctaactaataggctaattcatattaaaattaatgagtaaagacggataattcactgaatacaacatcacacaatgtcatgccaagcttgtttgtaccatacaagagccaattgccttattgcgagacgagatttaagagcctattaattaatggtgcattcttttcagcgtatgtttcacctaagctctacaggcgcatgaaaaaaatcattaacacgtaattaattaaatattaagtactataaatctaaaaagtagattttttatcaggaaatgtgctaactgaaaacgaagttgccctttataactcaccctaaatcataacctccttgtctcatatacttcccatgcgtattagatttccaagattctcgagcggtcttcaaaactaataaaattaacggacggcacaaataaaaaaaaaagttaaaatggaaaaatatactaccatgtcttacatgggcatgtaaggttccaaacgtcatcaatcaagtaagtaatgaacacctataaaaaagatatgctcccttcattctaaaatacaatcacttctaacatttagaacttattctacaaaataaacactgttaccactattcaaagtacttacttatctcatcaattatttcttatttaaattttttcctgttttaccctaacccttctcacttctaagcagactcaaccattcaccatttatgaagggacgctaaaaattttctttctcaaccttagttaagcaacctatagttcttacatattgacgtgcaattcttttacgcattcggaaataaaaaagttaagcaacctatagctagctatacttacgttttaaaatggactgtggtatacgtccatatgcatgcattatttcatgcaggttttgcacgtatatgtgcacgtatatctgctccagtcttttgtgcaatatgtgcgctggacaacattatattacaaccgaaattcagtggtcggagacagctttgggatggatgtacttgcgtatgctttccactactcatgcatgtccatctgcaaaagatttgtcggagccagctaagaagaaaatattctcacactgttgccggattgcaattggctagctagctacctatatatccgcatatgcctgcacatggattatattcagctagtttcttgtcgattgagaggtagatgcaaattacaaaatatactattataaactcaccaagcgatcgatatttatacgaggagctttgatgtagtgatgtaattatgtatagctgtaaattttatccaccagcaggattcaatttatgttttttttttaattatatggaagacgcacaggtgtacatatttatacacaagtgaatataccctataagaatatactttcaaagaaacagaagccaatggtaaatctatggccttactaaatttttattgatggcacctgagtgtgcataatgtttgtgggcattagaatttgaaatctacacccatgatgtgcgtgtgcacacatatgttaacattagaaattctgggactcgtatactattttagttgaaatctatgtatatgttaaatatgtgtagaagatatacgtatataggagtaattggtaagataactttttaccgttcctaagtaatacctataggtacaaatatttagtgtaaaatttggtaaattctatgtacctaattaattaggtattccttgtactattttttacctaaaatttagtgctcatgtttatgatataaaaacataattataagtaataaatttaaaatacaaatggaatagtatatttcataaaaaaatcatcataaagtaattggtgttcaaagttttattctaatcaaacaaaatatatcttatttttaattggagtaagtatgtatttatgtgataaaaagcataatcataagtaaactttttttcaatattaattaattataccaatctatctatctattatatactaaaagtccattaaacttcctacaaacgctctcgtactgccacatggtactcctagaaacgctcttaaaccgctatgtggcattctaatggattaagaaaatctagccctcgatttttatttaaattggcaggcccattatttcaaaccattagattggattggattagattgaatttagtgccttcttgtcctctctctctcatgtacgtacgtgtccctccccacacacgtatgtacgtaccgtcgtaccctcaccaatttttctttccgtttaccccctttatttttctcacttgagataccttataatatgtgtatattaccttcattttttatgctgttgatttttgcgtatatatttgattttaaagattaaacaaaaatatgtcattataatttattttattgtgattttacattaatgacttatgttggttatgttttagtgcaaaatacattacaactgatgacgttgacatgaaataaataattccataacaaatttttaaaaatatttcacatcagatttatagtttcaaatattgcttaacaaatataaatcgctaattggaatctacatgcaaattaacaatgtatttagtcgtgtgttttttcaagtatatatggtataaattttaactcgggtgagattaagattcacaaatagttttggaattttcctttcttccttgcactcctaccaacgcttctaggctgccacatgtcctactaataaattagaaaaaaatcatacaaatcttaagaaaaaaggaaatcatatatctatatattttcatttaaatcggtggacccattatttttaaccgttagatcaaacttaaaaaagaaccaatactttccacctccacctccctctctgtacatcacagattggatcaaacaataaaaaaaacatatgtaccatgtctcctcaggtacttatatacgtactctccatccattgcatgcgtacaattatatattctactgccataatttttaagcaatatatccgtttttttaatttattggaactattattaaatttattaatgaaccaagaatatgggatatatattgctcatattatcatatataacatttggacatactacctccgttttttaatatatggcactgttaactttttgataaatgtttgaccattcgtcttattcaaaaaattttataaatatataaaaaaattgaagctattcttaaataaattttgacgataaattaagtcataaaaaataaatgataattacataatatttctaataagataaattatcaaacgtataaaaaaacaacagcatgatatattaaaaaaaggaaggagtagaaccctatgctttgcatgccaactaaatatcaatggaacattgtaagaaattggaaataaatttatcattgtaaacatttacatgtataaattagatagatggtgtggaaggaaataaaaattataaattcaatgacagaaaattattgctacacacacaattcaaataccacaagttggtgaccatctataggactcagccaagcacaacaaaaacttgtagaaatggacgccgcgtgccgccgacttgcccaacagcagcaggtagttgccgaggtgtcataggtttgctaatgaagattgaagataataacatcattgctgtccagggagcattgagatgtaaagctcttggagcatggcttagaatcgtgattatcaaagaaaatcttaaaaattgaactcatttaaaccgattgtcctatactttctactttataaccattagattagattgatctaaacaaataaataggatcataagtgatcaagtccgacctctgctcctcctttacaaaccgactctgaatattgttcgatatggctactagcaaaagggtctattgatgtgctggttggtgggaaatgctaagctggactttggtcccatgagaatagtccagcaatggaaagatgttttttctgtgtatgtgctttgcctaaaaaaatataaatatgctttttgtcgactcgcccggggaaatatagatgactcgccctgggagaacgggagataccatgctggcgcactgtcgtcgccacgaggagaggtgagaccaagctgtggggcacgcgccttgacgtggtctgcctaagggcacacgacaccagcatggtgtcaccgacctgccaagcgtccactcactgtttaacctgtcatatctctctatacacgaataatcgtctcactctaattaaaaataaatagattgctatgtctaatacattagatgaaacacctcaaaatttattactgtcctaaaatacgtaaagacatctacagtatagaagaaaaagttttactaagtttgaaaactaaaaaaagatatactaaatattttttaaaaaataaacacatggtagaaaatagataggaatcaacttctttattgtaatatactacctccgtcccaaaatataacaacttttagctatgaatctggacacacagttgtccagattcataactaaaaatacttgtattttaggatggatggagtaatattttttagtttaaaattttatacgatgtaagggtaattagcataaaatcgtagccaatgcccaaacaaatacatattaaaaaaggaatcaaagaatgtttagaaaaaaaatattacctgcaaataaaccatcgtaataaaaatacaagcaatattaaataaggtgtccgtgtatatgcgcgggctacttttctagttttacataaaaggtgtgttcgatagtgtaggtttggagctagtaagtacttaaaaaacgattttttgtgtttgaggacccatatagattgtagccggaccgtaattaatcgcgtctacaaaaatcgaccttcatttttttatacgggtgtcccaaccgcatagaaaattaggtttcgttcgtatggaaaaatgttattcgtgagtagttggagttaataacgtgcgtcactgtaaatggggtcaatctacgataatatttgtgcgtgcatcttctctatgatcgatgataatctgaaaattgttttgtgcatgtaccgtcatcaccgaagctaatactgtgtgctactaattctcttagcttagctagggatgctgcactatcgtgcatgcaagcacacgtcgtttcatggatgcttgctgcaggcctggattaggagaaacaggatagattagtggtttgattattccgaaagctgtcaatctgcaggtgattgatcgattgaaacacggggcactgctgtctgtatgtaggctatagcttaattaagatcgagtacgtacgtagctcattaactccacgttatttcagcttattcatcataaaaaatatttacaccacatttataaaatatgttcttaaaagctttctttcgattacattactcaaattgattattttatactatttgttatatttattccttaatatatttaatttatcattataaccacgggtagataatccgctcaactatataagcctattgctgctagttattactccctccatcttatcacaaaataaaattacttctttatttactctcttatttcaactacttataacaatctctcatttaatcacaaccattttctatttagttttgaataattttacccatcgggagataccacattttctgatataaaatttgttaactctgagtactagataaattgaggaactaaaatttttatacctctgaatactttttacggatcataaaatttatctttagttttatttctctttaatcttcataaaaattctaatccttacatacattttaagacggaaaaattactactgctaggtagtggaagcctacaagtaggggtgaaaacgatacggaaacggacgaaaaccatctttatcattttcattttcatatcttttttgaatcggaatcggaaacctcggatacgaaaacggaatcgaatattatcgaaaccgaaaatggagcgaaaacgaaccagcgcgaatatagtaacgaaaatttatcggaataaaaaaaagcactcaaactgatatatccaattgaataaattatctatatttaagagagtaatttgttgataaatcccaatgcaggaaaaaaatattcttatgtaattttagatttgcataataaatatttttttaaacaataatagccaaacaccatgatattcactattcagtgcttaaaaaaagaattcagggtatttctatcacaaaatttctggtaattctgagaaaatttccggaaagtttccgaccgattccgagttccgacggaaactacccttatcatttccgattccgtttccgagaaaatatttccgaattcatttccgtttccgaaaaaatccgaaaaaaatccgaccgacagattccattttcgaaaatagatccggaatccggaaagttttcgtaccgttttcaccactacctacaaggcaagggaggagactggtctagcaggttgggcttgagcctagacctacctccaaaatcttgtttaaattgtgttgaattatcacgaaaattttgtaaaaaaaccatcactccattagttaattagccctaccgtagccttattatttaaaaatttctggctcggtcaccgccggaagatgatgcatgcgtaacactgtattagcaatatatgggtggtggggtcaggtgcctcgctatcaatcggtaattcgttatccagtggccgcccactcgtgcactccaaaagcaagctatccggtagcttagcaaaagctatatatatatatatatatatatatatatatatatatatatatatatatatatatatgcgctgcacgagtatgagatcagcctgtccggacaaatgctgaaaagattaaggtactgttcactttgataccatttttaaccttatcaaattttgataaagttatcaaaaaaaaaagtggctatatttagtttgctactaaatttttgtaactatataaaaaatcctgctaaaattttaacaagttaccaaaattttgacaaatttactaaaattttgacaataccaaaatttaataaggttttttttggcatcaaagtgaacatgccttaaaggagcttaggcggagctatagttagcggcgctaacatgtttttttaattatcacatactccgtactcttctcgaagctactaattaggctaaactagcgggaggctggacccaggttttctttctttttttttttgtcccggctgtaaaattggagctttttttttattaaactcaaaacacgacagaaagaaattgtagacggcagaaaaaaatgagtacaaatcgttcatctcggatacaacactactacatggaacgctactacaaaacagcacgtaaaaactggtcttatagatgttggtttgtttgaaacgcacctataaagttttttttccaattttttcaatgtaaaattaagagtcggtatctataaccactcattgataccagtttataacaaaaatcgataccaatagtccattaatgtcatatgtcgtcgtttgatgtcacgattaaggtatttggatagtatggggatcgttggtactatgatatatgcaagtttgaggtaaaagagaagagaacggggatttttatataggttcgggccctgaattgtcaggtaataatcatactcctgttagccgaagccggtcattgctcttattcaccataatcacaccaatacaatatttggggtagcctatctaactattgtcgacttagcggactgaagtatcatcacgtagtcaacaacagggtagtcttcctcctcgaatttgtgcccggcgagatcagagacagcgctagatccctacagccggcctctataggtaccggatagggccagtccaggcatatctctgatgtcgatatccggcggcgtgtcttggcgtatattggcttgtatgttgatcttgtatcttgatctattgttccgtgccccctctcctcctagggggccttgtattctaattgtaaaccggcacatatgagctcataattgttttacagttaagaatagtcacatatgtaatgcccatatgtgctggctcatgataaaaaatggtacatatgatattatccttatgggtaccgatttattaacaactggcacttgtgatgttcatatataggtaccgatttattataagaatcaacatatatgatgtcaggttatggataccccatacctaatagaagttgactaaatctcagtaggacccaccacataccatgtcttatacggaaacaaccttcggatataggagaagttccgcataaggaaggatgaatagagttctacatggaaacgacaaagactattcggattgtatccatattgatttccctagttctatttggacaaggggacactgatgacataactcatatatgtgtgtgtgtttttatctaacttatttatataaagtcgaatgaagatacaatttatataaaatttttagagctcgacgagatcaacaaactttgtagttgatgacttttcgatttaaggctgtttggatgtccgaaaatgtgttacaagctctcatatatatttgcataagtgaatatttaaaatttaatgatatcggatggaaacaaaacctatatgaaagttgtagatctagatgtgatctacatttctgtagttgataaacttttcatttgagctcatcaatagtattaaatatggattataagtttggatgacattagtctcaaaagaatagcatttgttttcaagataactgtagttgtaggtaagatggtaaggagactttgtgtaaagagagaggttttgagttcgaatcttgcttgacctatgtcaatcaatatgggtctaaaaaatcatgttccttgtcaaaagggaagtgtgggtataggtgcttaataaaaaataccaaatattttttcggttttttcagcacctgcaaaaaaaaaagtgtgctggttctaaattagaacaaaacctatagtaccacataggtgtcggttcttgaaccgacaccaatgacttgtgttatgggtatcaataataggtgcgggtacctataagttcttaagaaccggcacctataactttttttatagtgaaaattaggagatactaagaaaaatataattgaagtatgaatgtatcgattatctttgaaaaggttggagccataccattatcaaacttgcagcgcaatctatgtactatttttttcgattacatgaaagattcacgtacatactatctatcacacacacattcgtaagtgtgcccccataacacaagctcaaaaagacggggattatagttacatccttggttttactaaattcctattgaaaacacactcacgcatgtgtagtatttgtagtcaccaaaattttaatcctaataagtagattcatacacccatgactttaccccacacaactaatactatcgcaaaaaggcaactattcaccatgtgcgtgtgtgtatatgcgcgc

SEQ ID NO: 28335 - DNA, 38019 bp, Oryza sativa
  unsure (1)..(38019): unsure at all n locations
cacacacacacacacacacacacacacacacatatatatatatatatatatatatatatatatatatatatatatatatatatatatatatatattctcccaaaacaatagaacgaattataataaatatttcgctaaacatatcggtcctttatgtcgatattaaaagtcattctattgtaataatttgatagtcccatgttacatttgtccaagactatcatatcagtcttgggcagaatggagacaacttagttttgttattaaattttataacatgactatgtaactttagaatttcatattttgcatgattgcaaacataagaatcctagcatgcaatctgattaattatagcctagaagtctagaaaaaagttgctagattacctattcttgaaccacttgtcatttctatatccttccaggcaaaagaactttttcctttgctagtatcatgcctccttctttacatttgtgcctctattttttctgcacctttttgctaactaccttttggaattcgaagtacatgatgcaatattttcatgagacaaaagacgacaagataaccagcttagctagctatctatctctcaatctaaacaaagattcactttaatctttgcaacgcagaacacgccttatttcccccccccccccccacatccaaattaatgattgcaattgaagatccatgcgacttaatctaagagaaaaacagaaattaaggtatactcaattgtaaactgattcaaaggaaattcccaaaaattatattgcctagtacgcattatcatggaaagcatatatatgaatgttaggtactaactagaattgcagagaaacgaaaatgaacttccaggcttaattaagtgatcaacttaggctccatttggcacttagcggattgcgaagttgctatgatcttggtacaattagacattgtattgtttaggtatcaatttctctttaatttaaattacaaacaacactattatggcattcgaaaaatatgaaaaaattatgatgtacacaaacactgttggataaattatttcatctaaagataatttgattcatacggtagactaataagggtgtgttcgctattttcagttcccaactagaatagtaaacacggaaaacggagcggtccattagcgcgtgattaattaagtattagctatttttttaaaaaaaggattaatttgatttttttaaaagcaactttcatatataaactttttgcaaaaaacgcaccgtttagcagtttgaaaagcgtgcgcacgaaaaacgagggagaggggttaggaaagagggtgccaaacacaccctaatgatgtatatttgcatatgcttttagagtattgtattttaaaaataagtatagcacaaagcaacacagcaacaacaaattaagcattatatgaacccacccagtgaatcttctaatagtgaatggcagtgctctcgtttcttcccttagaaaaaaaacccaccaaaataaatatttacgcttataactcatgtgctcccttcgtaaaaaaaaatcaaattctaactatatactctttatgtactcgtaaagaaaatcgtttagtaaaatgtttaagtcaaatcttgaaaatataaattataaataattctgtttaaaaatgtaaaaattatatgaataaatttgccttagaaaaatactttcataaaagtatacatatcacttttcaataaatatttttatagaaacaagtcaaagttatattttagagactgtatcgctatctaaaacgactttctttacgagtacggataaagcatttggaaacatactgtgtacaaatatatagctataagtttttttttcggacaaaaggtgtagaagagtcctcgcttgcctgtcgaaaaccgtggtcgagacatgccctattgccgaatccgttgatggattgaacatgccacaccctcataggcacatgacaaacagtgggcttctttctttcttctcaccaaaaacagaggcttcattccgatcgatcgccaggccaaaaggtgtggtcacaacatgagtcagtaccaagtgacaaattgcaacgacctatcctaacaccctatttagatggcactaaaacttttaagtccatgtcacatcgaatgtttgaacactaattataaatattaaacgtagactattaataaaactcatccataatcttggactaattcgcgagacgaatctattgagcctaattaatctatgattagcctatgttatgctacagtaaatattctctaattatagattaattaggcttaaaaattttgtctcgcaaattagctttcatttatgtaattagttttgtaagtagtctatatttaaaattagtgtctaaatatagaaactaaagttaagtctctggatccaaataccacctaagctttaatttgttctactactaatattctactagtgcccatcactcagtcccctctgccatagctagctttatgatgcatatgcacactcgattattttaacaagaagaaacaaagctttggtcgttgatgtaaaaataaaaaaagaagtgcattattttatcacatagagattatgatattctataggttaatcatgaaaatactaaacaatttagtgtgttcatagctttaagagaccattggcatatagttggaaatagtactatggcatatagttggaaatagtactaattaaaaggagcacatagaagggtgaatcagatcaaagttgtaacaaaaccgcggctgcatcaggcaacgatcaaaaacacctacctggaggccttgggagcacatagaaattaatggttggttttgcccaaaaacaaggcacaccgttatgctgattaattatgcccactattaattaggcactaactgagagcaatgctcgttcgctatcagaccataggaatggaaattatgtttgttatttagcgttctgatgattatgtgctgtgagctcatagataagagtaaataatgtaaatcaaatatatggctatgtcatgcaatattggatttcttgcaaaatgttttcaaattttctggtatgttcctacatggtttaaattcaatgtcttgcattagaggctatgtataaaaaatatggttcatacatggttatccatggagctaaatgatctctaaacttctgcatatccctgtaaaacacaaatatacaatattccgtttatattcgtataataaccaattggaccaccctggttccgttgttttcattgataaacaataaggtaatatggtcatctgtacttgatatgatttttttagtgagctaagatcagatcccagcaggtgcatggcagcaaacagacaaagagcactagagggctttttaaaacaatgagttaggtttcgggtgcggtttttcttttatagtgattgctagtagtacttatatttgtaggtcatatagggttttaagccgctaataacggtgttggatgtagaggtaaaatgccatattggaagaaaagaagcagccatagaggtctatactaaatatgctattatgtgcggcattatcggactgctagtatagtatatcacaccagaagaattaaaatatgtgcaagatgggagtcgtgtatgatttcaagccactaacaatggtgttatctatgacagcaacaatcaagtgccatattggaagtaaagaaagagccacaaaggtctaaaatatatatatttattgtgggaaaagtctatacgtactaactttttcttactaaatttttactaacactgacatgtcatgctatgagtctatctagattttttataactttcatctgcttaaattaaacggttgagatgattgttagtacaaatttagtaagaaaaaattagtacgtgtagcagtgctctttattgtgcgtgttactattagtcagttgtatcttggttgactatgggtcctttatcttaatcctagatagttaaatccgcttttattcaatagaaataacaggagaaacaatcaagatcatgaaccatctactcgtaaaaaggaactcattgagatggttacatgcatactccctcaacttctttttaaaagtgtcaaaggggttcaaagaatcggtggtaaccggttagtgagtttgtatcaggattaaaatttatgtttttgcatgtatttgttattatagcctcatttattgttgataccaataattttaattagattattattttcaaaaaactttatctagtaaattccgataatcattttgacccaaaagacatatttttatggatactaatttgaaaccttggtttcccaaaagactttaacctaagaatgaaagagtgaaaacatatagtttcctatatagcattcggggatagttctgttcacccatttcggaaggaggccggaattttattttattccattttctaaaatataaataggactcgagccaagtggttggatacatctcgaataaatttcattatcgaaaaaacaaatactccaatatcctccgtttccatgctcaacattttacatatatgtccatttgaggacactaagattatttactcgttacaaaaacattaattgccgataaaatttacgtactcttccaaagcattgggtaacccgaattaatagaactacaaaattttctctcaactcaaaaaaatgaaaaaaaaagtttccaaaattgtagtccaagaagaacacgccatgcccgcctatgggcgcggcggcggcagcggcaggaggcggacgggcacgccgtggcgtggccggagcgtgagcacgttcaccggcgcgtgccggtactcgtcggagatggcgaagcggaagctggagaggagcatggcgagcgcgaccttggcctccaccatggcgtacgcctgcccgacgcagttgcgcggcccggcggcgaacggcaggaacgcccccgccggcggccgcggccgtcccggcgcgaacctgtccggcctgaactcgtgcgcgtcgcggccccacgcgccctcgtcgtggtggatggcgagcaccgggatccacaccgacgcgccactcggcacccggagcgcgcccccgccgagctcgatgtcctcgaacgccatccgcggcagcagcgtcgccggcgggtacagccgcagcgtctcgttgatcaccatctggagcacggcgagcttcgggaggctgtccggcgacggcgcgccgccgccgcagacggcggcgacctcggcgcgcgccttgtcctgccacgccgggtgcgtggcgagcagcatgatggcccaggtgaggagcagcgccgacgtctcgtggccggcgaagaagaaggtcttgcactcgtcgatcatcatctgggcgtcgtacccgacctcgccgccgccattgccgccggcctccttcttctccatctcggccagcagcatgccgaggaggccacggccgcacggcgacgccgacggcgtccggccctcgtcggcgatctcccggctccggtcgatggactccttgagcagccgctccagctcgccgttcagccgctttatctctctcctgtacttgctcggaaaatacctggagaaaaaaaaaaccatggtattagaactattaaccacgtaaataaaataaaaatgtataccgtagtaaattatttttcacatttctctcgtgaaatacgtcgtcgatcgttgtgcaaaagtttactcctatatatacggacattcaattaaaaaatatatatgtatatgtgcaaagcgtccgcttttaaatagagctggtgacaaaaaagtgtaaccgtcagctctgcttaacgacgaacattctaagaattaaaaaaatattgggttgctactgctccggttttttttttttacttgttggtaaggatatgggttcagtctttttatcattattttataaaattattaaatatatttaatatgaaagttttttatatcaaatttcactgtttttccatgtactcgtgtttttaagatgctgaggctttttgtccagtgcctcctagcttttgctcgtgaatgggaggagcatttcgtcgaatggttgcggtgcagcctccactccaaggaggagcagaggagagcatcaatggcggtgactcactggctgccggggacccagaggtagcggctggagcgggcggtgaggcgctggagctcctcgatgaggaggaagatcctcttgccggtctcgtagctcgtgtcgaactcggtgcgcgcgatcacgtcgccggcgagcctcgccatgtgcgcgccgatctccacctcgttcccggacctcgccaccgcatccctcagcgcccgcaccgtctgcctcgtgcactccaccatgtgccccaccctcccctgtgccaagaaacggcggtggggttagctctgctctgccgccgccgccggcaatggcaccgccgtggcgagacggtgcgttaccttgagccggtcggccatgaacgccggcgcgacgacgtggcgctggtgcgaccaggtggcgccgttggccatgaggaggccacggccgatgaagtgcttggcgccctgccgctgcagccacgacttgccggtgacgtgcgcgtgccgcgacgacaggagctcccgcaccatgccggcctccgtcacgcacacccgcggctcgctcccgtaccagtacacgaaccgcctccctgcaagcgcgcacccatgtcgccggtgtcagtgtcgatccgatcgtcgatcgccggcggcgaaccgcggacgaacactcaccgtacgtgttggaccagaggacgtagtgggggaggaggcgggcgacgatgtcgtggctgagggaggccatgtcggcggcggtggactcggcgacgagcgccgacacgtcgcggaggttgccgacgagcggccgcggcggcgggccgcgcacgccctggctcgccaggacccgccggatcctcgccggcgtgaggtagtagcatgagacggtgacccagacggccttggccaccagcagcagcgccagcgagaccggcaatgcgatggcgacgaggacggcggcggccattgccatcgacctcggacgaacaggaggaggacagagtagaggagaggtgttcttggccttgttccttgcttgcagctgcaatggcggcttgtgtgcactaggcactgccatacatgtgtgtatatatatagggcttgggagtctttgacattgcccagtgaccatgcaactaacacaatggcgcctaccttgttcagccttttcttatttagctttttcttccttcccctggcataagccggtctggctaattgcgtcgtatcactataactcttttcttttaatatattgacgtgcaattcttttgcgtgttcggaaaaaaccttatccagacttttttttaaaaaaaatttctagtattatttttttactttgattggttgtttggttgtgttggcggcaatgccagagccaaaaaaaaaagtttagaggctagctaaatcaaactacgtttgtacttcctccattcagtaataaattcatttttagctcatcctatttacccaaaataagttcacttttagaataatcgtcacatcggagtttgtaaaagcaagaataattatatttaaagtagataaagtgagaaataattgtattgcgatgtgataaagcagagatattctaatctttttttgtttttatatatcagtatgagatggatgaaaaataaacttattttgagacaaatatagtatttgctaaagaaatatatttttaatccttgcaaaagtattaagattctattgagtgatcgatgacgagcctgggcagctgcctagggtcgccgggcaatgactccgccactagttggcgggctagatagtattgaaacttgtctctattgtctattggcaatactgttatcaaacgtaattgaggagcaagaaattaaactcaaaacctatttctgtatcagcgtacatgctctaattaacaattttcggagtatatgccagtgctctctctctctctctctctctctctaccctcgttgtggttatctctacaaaatgtgaggataaacaaggctggagaaaggtgtttgacttgattttgacctaaaggtgaggccatgttggtgaaaacaagattagtttttggggtgttagtgggggagagagagtgaatgatgtggctttggcataaagttgcaaaaccggtacggttgagaattgagataattaactgcaatagttaagtacaattgtgtggcaatcagtatttccactaagtgaaaaggaggtagcatatcttcatacctgacgagattgtttaaggcaaaggtattttagttgggcttatggtttcattgcatttgcaaagtaaggataggcagagagtaagtggagatcatagctcttggatgcaagagaaggtcagaaatattgccatgaagtagcagcggagccagctcccaggcttgtcgggcaatcttctaggcttcgccgttgatatctccactgctaaatgtcattgacgtccttaaaagatggtaagatggttgatcgtcataaaacactattagttggcttggtactatatacccaaccggaccactttgatctagttgtttttctaaaaaaaaaaagaaaaagggaagtattgtgcaaaaatatgatatacgaattctgtgcctggccctactttcgattggaactgtaagctattttgaattttagtgtttaggctttaagaataatattaggtagattttgtaattgccttcttagaaatcataaaagaatatattcgtgcaacggcaatgatgaagagaatcctaaaattaaattcaaaaaattaaaatcagcttcgaattaaatccgaaactcacccaagcatggtctaaatcttaaggtctttttaagggaatagtgggaccaagatggtccaactatttattacattacattatacataaaaatgaattgtgaggttatatgttcaatcctggaaacatgtaaagattattctcagtgtatgtgctagtcaatcccataaagaaaaccttctttctaagtgtctttattctattctcttcactttcagtctttcacaactgatggttaccagaaccagagcctctgctgaggaacattactgcaaggagcatgttatttcacaaggtacttgtctccacttactgcaacttgcagaaaagatgtattggctcattccttcagaagatagatagtctgaatagcatgcatcacagtgctccatataggtcaaaggctaaaagtgtttgtttagtttgctgaatggcatgttgcaaacttgcaatgcacctgaaactaactgtatatggttcggatttcaaggtccattggaccatgaacacatctttggtttcagctggacttaaatcttaagctaaacagatgaatttgcatcctcatttagtcatcattctcatttctgtggaatgttcagtgaaccttgtcacctcccattggcattcagtgcctcgttttgcaggcttactaatttcttgtggtttcttgagtttgttcgtctcgtagacaggaaattcaggataccatagtttatacttccatgatgagaacatttataacatgtcaggcgtctcagggctcctttcgaaccaaaaaaaatatgggttaattagattaggtccagttggtgatgacgatgacatcgttgggaggctatggcgaagatattggatggtatgtgtgttgagagtttgtgtaacatcctgaaaattcaagacaaaaatcacaaaaatttcgaactttttaaaacttttgcatcatgctggttgttatgattgctattgcttgccaaaccgtaaatgatcaccaagaaagtaaagaaaagaactacatttaagcaatagatatgatttacgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctatatatataatagaattatgggagtatttaattcgatatgtagatcgattttgcaccaagttcctaattgcattcagggattgaaatttgatatattaaacccctccatataaaataaactaacatatagataaattgagctaatgtgctattgtgttaataacggtctcattagaaaattatagaatctttaataaaccttaaatattggacaatattaaattttgggcaaattcacatttgaacacttaatacggtcacctaaatgcttgggagtaaatacaaatttaatttgcaacttttctcaatttataaatctaccaaaaccctaaaagaagaaaaataggaaaactttgaaaaatatataataataataagaattaaccctgattaaaaattcaaataaattatataaataaaatatgagtaatattaatctagaataaatccattggttggaatgacacaaatattgggtaacttcatttatacaaaatctaggatttatagaatcaaatttacacaaaaaataggctaaaatagggattaaataggaaaagacactattcatcggccaccaggtgttcgacgtggtcccctaacccagcccctcctctttccccctctctctgtcgcctgccaccgcgccgacgtcgccatcgccgtccctgccccgcgctgccgtcgacgtcactgcctcgcgccgcgcgccgccgctgccacgccgccccgcgcccgcgccccacgccgcgccgcctgcccgtcgcgtcgccgctgccgcgccgcgcgccatcgccgtcactgcctcgcgccgcgcgccaccgctgtcacgctgtcctgcgcccgcgcgtcgcgtccgtcgtgtcgccgtcgtcttgagccccgcgccgccttgtcaccatcgccgcgcgccgagccccgtgccgcgccgcgccgtcccgtcgacactccgccgtcgtcgtcgcgtcgcccgtcgccctcaccgcgcgccgagccccgcgccgccccgagccccgcgccgccgtcgcgtcaccccctcccttctcttccctcttccccttattccctctctcccctataagagccaccgttctcccctctcctcactccatcttcctcctcctctccctcttccccctctccacgcgccgccgcgtcgccgccttcgagccgccgcgccgccgccctcgttctatcgtgccgccgcattcgtgaccgccgcgccgccgcctcagtgtgccgcgccgtgcgccgtcgtcgccgccgccgtcgtcgccaccgccgccgtcggtgagccgctgccccccccccccccttgtttgtcgccgtgccgccgggtagagagggagccaagaaagagagaggaagggagaagccgagggagagaaagaagagggaaggaggagagaaaccggaaagaagagagagagaaaggaaaagaaaagagagagggagaaaggagaagaaaagaaaagagagagaaaggaaaagaaaagaaaagagagagagagaaaggagaggagagattagagtgggccccacgtgtttagtgaatagtaatccccttcttaatctttattagttgagtctattacatgtgggtccgggtggttaaaaatctaattatagaagttttatggtctcgagtttatgacatgtgggccccacttgtcattagctcttcctatttccctttagaaaataattcggtaggaaaaaggaataaacccggggtcctacttgtcaatggatatgtcttggattaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagtgtgccaataaataaaaaaatggatattgtatagtagcataattatctttaatatgtcttgtcactgtagcaaccaaataaattagttataatcaatccttcaaattaatgggtgtaaaggaaaatattagtgccatttactagcctatgtccaaatataactaattccatgacttataaattatttacataaagtttagcctcatattttgtaactaaaatataaacacacatagatgagtctttaacttgtttaggagagtaatcacagagctagttgtatttggaccacttaaaaaaattagttgatacaatgtcatgtgaagtagaatatatatatatatatatatatatatatatatatatatatatatatatatagtcggttgatatccattagttaaccaaatagagccatcttaaaatcaacatgtattgtatagcttacagtaaaaagaaactactcaaatatatgatccaataataagatattgttgcttacacatacactatacatcccattatagttgcatatatgaaattaagagggagtgtatgacaaacatgtatattagataaatactagttataaatcttgacctcatataattataattatagttcaactgtaaattaggattattcattataaaattatgtgatgggataatctgtaaccataatatgattaacctaaacaattctaacatacaaagcaagggtaattgttaacctttataatttattttgacaagtaaaatatgtacataattaaaataaagcctccatcaataaaataataatacaaatgattcacagtaattatttgaccgatccaaatccatctggcaacaaaatctctagtgtataaccgttctatttagatagatgcatgaatagccatttgctagactaaaccacatagtagccagatacgtatctcattcatactacattggctagctcctaaatagaccaccatgataacagaaagattaagaaactttagcccttagcatgttggaacccattagcaagcgcgaataatatgagcaaccttaggttcaacctcaacaaatatattttgtttgtgtatatttgattgttgcttgaatattggtttttctcgcgtattatagactttgtgtattggttagtcgtgaggcaatatcagcaacttccaggaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcccacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgcacttctcgtatgggtatagacctagcggattagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccaaaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacttcccgagaggagggaaggtggacatcctcagaaaaccatgacgattcaatggcgggaagctatccttggaatcacaatggatggtagacagaaccgtcgttgtttaaagtgaacactggtactaaaatttgattagtctatgctaggttttaggcttgtgaaaagaattgtaaaattagctttatgcaaaagaatctgaagccattccttgaaataccctctatcatacgcattgttgttgtggtggcttgctgagtacggttggtactcacccttgctattcatatatcttttaggagagtgttgaagagaagcccttgtcggtacgcttgcgtatccaacaagatgatcggagtgcggtcttgttctaggtctcgttccccggtcgactgcctgtggcatgttaaccgggcccttatattattttgtcttccgctgttgttctctgatagttgttggcctacctggccctaatgtaagtatttaacttttttagcctgaattcattcgtgatatgttgtgattcaactatgtatgtgtgtaccaactactgatctagagattggtacggataaacacagatgatttccgatttccaaaatcgggggtccacagtttgttagccttgcaaggaaacgaaacaaaggtagtcccaagttttggagccacactgttttctgtttggaagatcgtttgtatcatgcgcttcgtgctcttcgtttcctttgcattcatccggtgctcccatcatgctatgagattctcagaaaggttttgaacagatgagaatttacgcgtttgtgaactcgccccgttccttcacactccctccgtcctgaaatataaaagattttggttagataggatatatctcattcaatcagaatcccttatattttggaggagaaattgacaccattagccacaaaactattgcaactttgataaccaataatttttaatgattagattatagtaaataaatgtttagtgcttatgtatagtatgtatacacagataatatgacacttatttttaagtatttagatttttttaaaaaaaatacaatggttaagagtttaaatataaataatgcttggtgacaaattataaagaaacggagggagtaattagcaatctttactgttcttgatatattcaattgagatgccaaggaaaattgttgttatactatcttaatatattctacccctgttcgggaaaaatggtggcaatacaaattcaattgagcacacatcgcgtgacctcaaataaaaccttcaattgagcgcacacgtggactccgagtagcgtttgcaagttgggagaagaaactataatgttcatcaacatttatatgcgttttcatcagcgagaaattttgactgaactttttaaaaaacaaaataagcaagggcactagtttcacggaaacaagtatttgccagccagctgccagcttgagaaggtaaacaaacagagctggctctcatatattccagagacatggatgatcatatgcaatctaactggtacaccaaatggatttgagaatctcttatctgggcacagatagatctgattcgtgcaatccatttagacctcactgacatcttttcaatgacaactagctaatgcaataatgacagtttagacggcccatgagaggaggggcttaacgtctccagcaattttttcatggacatgcttgccgtgccaaaaagcaatacacagatttgcgacaaagttcaggagattctcaccttggtctgcttcaacaaccaacatggcatgtcgatgcgtttcggaaaagctttgtctgaggttttctgaaacagaaaaaggggaattgcaaggcatgtcccacaaatttttgaggcgcaagtcactttattcccatcactagagatttgacagcccaatgttaagactactattacactagaaaaaatatatacgcatacacagaaacctgatagtctataatgctatctcagtgagttcttatatggtatccacggtgcaatctatcttcttttgctaaagttttatatgacaaaagtaacgaaattcaatgtgaaaataaacaggctaaaattcaaggtgaaaacagaagacatagagggtgcgcgtactaccttgatcgccagtcgccagctctctggctcattcaggacagcagcttggagcatctcctcatttgctctttacaggcttactctggttcaactttatccctgcactccaggtaacggctgcaagaatccttgcagggcacaatgagctccgctatctgtttccgcaaacccaaagagaatgcaagaattcattttcagcttgctgtaattcaagttcacgagtttgccatcatggagtactcagatactgatcaggtctagcaatgcaattcctgttgtgttttgcttcagttcaagtgaaaccttcgtctgaggctctgagcacacctgcaatatgaatgaacttagacttgagacaaataatggcaattggcaaaagcaaacaaagtaatttcctgttcagttgtctaagatctgacagttattcttttttatttcaagtctattctgtactaccacctaaaactgtgaattgaaatatatttatggtacattccttgtaagccactagaattttgctcaatgccttatttgccaatttagctcaggtcatatcagtggcaaataagatggtagcgtgaaagcaactctactaaacaagaattggtccacatatattctatgctgttgaaagcataaccctctcagtctcaggtgaaacctccatctgagaaggcctgcaatatgaatgaaattagacttgtgacaaataatgctaattggcaaaaaaaaaaagcaaccaaagtaatttcctgtcaggtgctcgggttgtctaagatctgacaagctcttcttttatgacagactatatagcacatctgaaattgtggaaatatattcacgataaattcctcgtgagccacaaaaattttgctcaatgccttctttgccaatctattctcaggttataatggttatcatgcatgtcttgcccacaataattgctacttctcaaaatgttttttcttaatgtaacaattagtccacagagaatgcaactgcatcctagagataaaagatcttatttgaggacactacagttgtatgaattgtgatgaagataattttgtaggatcaaagtaaatttccaggcttccaaccaaagaaaaagagtgcgttttgaatagtgagcaataaaagcttttccagtttctctatgctccaatatactccatgacaacactagatcaacaggagaaacccaggaaataacagtcaaactcaacatgttctatttcagcctttgttttttacaggaaagggggaattctaatgcataaagtggaaactaacatatcagcttagcatctagggaggcactcgagaattaagacatcctacattgacttctcttctaagtctcaacatatatatgaaaaaattgtgctccctgtattacattgtatcccttatctattacgggctttatggtaacaaccaaaacacatgtccaacagaatatctcgctaacagtctgaaacttgacacccccaaaatgattcaaccatgacaataaagcaatggtaataaaatttataggtggtactgaagtaacatagaatcccttttgcaagaatcagtttatcctgcacgtaacaaataaagatcaccatctagcaacaaggcaaaaagaaaaggcacgatttccaagggaggttaccattctgaagtcggaaacacaagagaaaaaaacaactgtgtcatgtaatttattgaggagtgctgcagcaaatagtgtgtacatcagctgtaaggtgaaacaggctagtgctaaatgtctgagtcagcaatgcactcatcttcacacaagtatctgaaacatcatttgatgtcataaaactaagagaacatgcagttaatgacacctgataagcgatactgcatatggttgcagaaaaaaatgcacatatatacttctgctttaaatactgagttctgacacagtctgagttactacggcaggggtcaactgtttattggactaatggcttcgataaagagatgtcaaaactaaagatgacagtataagaggacagatatagcacagtttttaaatatctttgatccacataacatgatactccaatatattctgtattttctttaaaatcgctcactgaaaatagtggcagtcataccagtagtgtcaagtaatgtgaatccaattaagaggtattccaccacattcatgtcaacatttcttgatgtggtcaacaaccattctgtgctttcatgtttgtttaaatgggaataaaagagcatgggacctgacaccacacaaattgaagctccacacacataactttctgatcacggaaagtgcagtaatacaaacacaaaacgtagttctaattcaaagtttctcttatatctattgaagaggggttatgtccctttaggtatgtcaaagagacatgtccagtggaaagttgacagtaataccaataagcagcaactaccaaatataattgctagaagtaaacccaggagcacaatacctggtacaactaacatgtgcaagggcgctgttccaaactttgtcctgaaaaaaaaatgtgaaagtaaaggttgtgaagaaaggaaaatattaagtagagcgaagaggaaatttcaccgaaaggatgtcatccactgaagtccagagaggttcaaacggccaatccgatacactccactgaactgtgtactgagagtcacgcatttttgtctccaggatgcacaaaccagttaaccacttcgacagaaggcacttggatggtacaaaaatgccaatgaaaggcagaaacataaatagatatccacaagcttcagttcaaaattaattgattgatcatgtttaaatggacctcatacaggcataatgtccattgaaaaaagagtgcaacgaggggggaagtaaatataataaataaaaaaagaacagccataaagctgtaaaacagtgattgtgatctactaccgatataaatatttacaaacgaaaagaagaaaattgtaaagttaatctgcaaatccctcccaagtgcacgatttcagcttttctgtggcttgagcacagatgcagaagcagaacaacaagcaatgctgtcaaggtaatcctgtgtcaaatagcagtgagccttatgattcaattccaggcttccagcatgggtttgctttcccattcaatcatatctgaaaggatttttattatcttctttagttccacgaggcaaatccacacccagctgcctcccgaagcccctgtcaaatctccgagggcttccccttctttggggttctggggatctgggagccgaaatacatggacgaagtttatctcctgtatgatttctgaactgctttgtggcaccattcctgtcatatggcttggcagaatgagtttcatatctatcagcatactccctttgatcatcaccattcccatcatgcctatttcccctccccctttcgaagccataaggaagtcttccctgtgttgggcgatacaactctccagaccttggccgtccatgggagtccacatcaaacctgtcatttcttgaggtaactctcaggggtgggctcctccttgaatatcgctttttatgatcaggaagatcaacagttgagcagttcctcccatcagcccatgtagaagcatgttgagagtaagcacgatctcttgatgaagggctataacgcataactcgatcaccaaatccaggttgtctagaaggcgaagtcattcttcccattctaacttcagtcatgtaattaggcggagatctacttctactatgcctccataaacttgaactaccattcaccataacttcccttctgttcctaggtgatgtccaagcatgcggagatcgagaccttgaaccagaaggggatcggctgtgagcacgtgataggttaagtgaggctctatgttgcgggaacctcctttgtctactggccagtgagcaacgagctgagctcatatttacattagcatgatctttatccatatcaggcccatatctaacagatcgattaccactagtactgaagcgtctttctggggatgcttccctagcatgtgcaggacctctagacaccccacaacctccatctctgtcaattggagaaccacgtccagataaagggcggtatgagctactcaaagtgttgtttctcaccctcctagccattttactagcatttgcagtatcaaccgcctttaccaaggtgccatcaggtgcaacaacaaagccattgctctgcatctttgcaacagcagcttctgcagcattccttggaccaggcagtccgtaattataataatcaggtgatttgcgccaggtagtgcgagaattgtttgaattttccacccactgttccacccggctgctaccttgaatatgtcgtgatgctccacctctttcatgtgatttacgaatatcaatggttctttcagcctttgaacctgagccataaccatcatcagatctggatgaaaaaagaaaaggggtcataagattagtaattggggacatgataatggatcatcagtgtcgaattaccagcaagatgacagctaaaaaagttcaccagtaacttacctgcataactcatttatgtgggctctgtcaaatgatcttggccgatcagctcgtggttgcatatctccacttgataactccatatggcgcaatgattcaccacctccagctgtatctgatgtgctcaaaacacaccggttagatgaatcaactgtgtcccttgaatcatgttgagaatgccgctgatcttcaggtaacatatcccatcctgtgggctttgttctcagacttgaaagatcgtcccctaaaccatcattgaccctttcagactggttgactgttgcggaagatccagctattacatggcctggattcatctcatacattcgagtctccccattaactctcaagtgaacactaagagccttttcaccagtgcttccagcacacatcgttccagatccatcatctatgcaggtagttgaccatgaacacttcaatgcggctggtgaaacatcaccacctccattcctggaatgttttccattgaaattagcaactcgatcacctgtattctttgacatggagccaagagggaagggagaaatgcctggggcatcactcttgcaatctaacacctggtaattggcaggtttaacttcttcataacaatcatctccccaatactcgccagattcccttagttccccatcctcatattgagaatcatcctcttcagcaacaatatttccagtcccagcaagatctttaataatatgaggtgcctccgtttcattacagtgctccataaaattattcgatagaaccttcccgaggtagctttgttctgcagattgtgaatcggcaatgctgtccatgtcagtagttgatggttttatgcattctgaattgatagggggagctacacaggcaccatctatacgacatattaatgcattgctactgtcagtacaggtgagattattactaatagttgcatcagcaccctcttcttcatgggcatgggacataccacgatcagaagaacctgggttgtcattcatatgagaatcggagaggtccaaatcatcatctacatctgcagctttcttggagatgctcaattcattggtgacatgttcaactttgtcgtgacctgactgtccaattttactagttccagaatcaacatccaaaagatcctggttcttcaattcagatatgctttgttgagatgtttgcccaagtttatcattgctccagccaagatcagtagaacttttattgaaaacagttactgttgcaaggtttgtgctttcctcagaaactaacctacttgtgaaaggcttcactctggatcccagttcactcatttgaactgaattgatcccatcacagccatctgtagaaaccatctgggacaaacctacacaatcaagggctgaggcatgtgaaacatcaagtttctcctcaattacggtcaaagcaaaacgttcagtcataggaggcaaagagctgcaatcaggatcagaccctagctgtgattttactttggagatatcattgttatcaggcaactcctttgttcctgcagataaaccatcgcattctagcggtctcgattctaatactggtacattttgcggagacaggctgcacaaaggttgagatgaaccgtcaccagcaaaatcactttcgctctttgtagaagcatcttttggtgcatcaatcacaggagttttgtcctctgaaagatcaggaatgttaccagcaattgttgagtcaaaaggagcttgacacacctgcagcttgttcaacacattttcagcatcactacaactgcttatagcaaaagcaacaggatcaggatcagccgcatcaggaacatcatcaccaccacagtcagtgtcccatgcctccattgcaacattaagatcccagtgcaatcttgagtcacgggtgccattggaatgcttagtttccacaactgcatcctgcaagccgcctacagatttgtctggattacttgcgttgattgacatggtaacacctgaagacttcgtgtcagaagcagttgaagaatcatctgctttgtttgcactgctcaatgcagaaaaagacgcggaacagtccttctgagtgtgtgtagattcaacaagattttcacagttcaatctagtggcaaccacaggcttcgtatcaggaacagattcagacgactccagcagcgggtctgatttgcaatttgaagcatccagactatttagcatgtcctccttgatgttatttaggaaattcaattcagaactaccagtgatattttctggtttcctttcaacacagtgggctgacttcgaacattcgacattcaacgtgtcatcatccaactcgctcgtgcaggcagcagccgcaagtattgatatgccagaaaaatcatctacgccaaaatgctcttttgtttcctccatgtaatcaagtctaggtgttttaaccttatgatgctttccatgtgacgagatacctccacaggatctgctcaacagtttttcatatggatccactagcaatggagtgggtggaggtgatggagaacaatccataagaaatcttctcttttttattggaacatttcccacaggatcactaaagcgccgaccaagaatagataccccaaactgcaaagatgtcattaaatagttcataaaattggcattcaagaattgaattgactcttacttcattgtactctaaaggagaaaaataagaaccttctcagactcagaaacaggagcatcatcttgtgccaattcttgattagtagcattgccacatgcatagaaagatctaatttcatcccttattctgtcttctccagagaaagaggtccttgctctccttgcagctctttgccttctgtttacggtcttccatctcacctcaggatctataggccttggaagctccaagcccatggtgttgagcttgctgctacacgacggcccagctctgtctgttgttgattcaccaccacagcctttgcaggtcattgaaacacctgagttattaagattacgaagtgatgatggccttccagtacaggtgcacaatcgaatctgccaagagaaccaaactagtcaaaagatccatatccagtacagtatcagtaaaaaaaagtttaggcggaacatcaacccatagcaaactgaacacaatgataggctttcaacttggttgggaatacaagcagagcatgaacaacataagcataccatgaaaccaggccttcttcctgttgctcccaaagaaacaagagactgtttcacatcaactgcaccctcaggtccaatagatcccttaaaatcctctggaaaacaaaaacaacataaggttccggttgagcaccacaccaccaaagcgtacgatactgcttgaagaataatagcatcacaatccacatagcatgttcgaaagcaataggaaaaaactaaacgacgcttctgcagccatgccgccaccgcgcgccaattatatcagaaaataacttgaacccctcctgtagcaaaatttttaggaaaaactttgaactcccccgctccaaggctacttgagcacatatgggagtggagcaccagaaataatggaaaaccagaaggcttttacttccaggactgaatcccctatggcatcaacacggaacaacagctcagtcaactgccctcttccatcagcatccgcaccaacgagaacatctccttcctagaaaatcgatccccatgaaaaagaagaaaagcaggcagatctggggagctggacgaattcctggcgagcaccgcacgaccacctccatcccagattccacaacacgcagagagagaaccagattggttgattgaccccgagaagtccaaatccttcagacaaggcagatctgacaaccgaacctgttcctccgtaccccaggcgccaacacggcgaaacacacggcgatctccccagcggcgactggcggcggaggccaagcagagactactaagtcagatttcttaagatctagggttgcgtataccttttgctcctccggccttcctcatcaaaccccaagggcaaaatctctccctcctctcttcccacctgcgcgcgcgccgccgccggggctcagctttttcagtagaaatcgcgccgccccatccgctcttccgcttgcccttctcctcctccccttcctcgacggggattccttgcgtgcgctgctctcctgcgcgaagaaggaattcttcccccccccccccccccccaacacggctgtggctgatgctgctcctgctgctgccttttcccttccccctcgccttttgactcccgccctcgccggggcgggacccgatcggtgggcggcgccgcctccccctgccttccgtccgtccggtcgccgcgagccgcgtcgccgctgccgccgccgccgatttttttttttttttttggttttggaccctttccttgtgctacttcgccgcctgcggaggctgggagggggagaagaccaagaccatatttttccgtgatttttagggtgcgctcgatttacttatatataataatactcctatatatatataagtattttttttctcttctctccatggtggtggtggtgggtgtggagctatatagggacgggaatcaaagcctttggtcgatttacgggattgcccctggtgtgcggtgtgttggggatgagagaggtggaggctggttttgcttttactcctagattgttttagctggggtggatctcggccgtcggatcgcatcgggattgaccataatcagcttcagcggtagtctctcctttccaaattaatcatcatatatgttttttttcgaggaatcattatatatgtttattatgcaccaacaccaagataatttaaataacatcaatcaagatatcatacacatattctcccacaatgaatatatcattctattacatgatgattaatttgggaaagagggagtagttttttaaaagaattaaaacaagggtacctttaatggaattgtaaagttttaggccacttctaaaaataagttgtgaatcggtacttatagtatgagaacatgtatgatgatattagacaatagtgtactctttttgttccataaaaacccggatatgacgcattctagtattacgaatttatagaatggagagagcaacagtgcatgattttctcgatatgggctttgtacttagaccatgataggccaatgaatgaagtttgtggcaaataattgggttggactcaggcttttgaatttatgaacccataaaactttgcctaacctaagagataacatatatgcctcattaataggtcaacatcgaagacccaatgatcttaacataggtggtgtttgaatcttctgaagatgaagataaaaattaagtgtttcatgtaaaacgaggtggtaataatgaattaatatgatattttagagcaactttcatatagaattgtttcgcacaaaacacaccgtttagcagtttgaatagtgtgccatgagtatccaaaatttaatccaacttttgttggagaaaagaagagggcctagtttcttcttaataaatctacttgttgcacggtgctacttgttgtgttctttcccattagttcccaactcatatccatcgttttccgcgtgcacgcttttcaaactgctaaacggtacgcattttacaaaaaggttatggatgtgtttagttccacgccataattggaagtttaaataaattagaacgatatgatggaaaagttggaagtttatgtgtgtaggaaagttcggtgtgacggaaaagttggaagtttgaagaaaaaaattagaatctaaacagggcctatataggaaagttgctttaaaaaatcatattaatttatttttcaagttttttatagctaatacttaattaatcatgtgttaatctatcgcaccgatttgcgtgcataggggaggggttcccaacccctccaaaagcactagcccatggcccactgctctcccaccacatcggccatgccccacgactctcccctgtgtggttctacccatcaactaataacccaacataagcctccgttggctgtagctttgtagcttcttgtacccctactattgggaggatgctacgcgtcggacgtccaatttttcgtaaatatcggacgcccaacccctgactgccgcacgcctacgcatgcatgcacaatctctaccgtttctactctagttgattagcacatgtaaaaagtctatatgcttgcgcatgcatgactgcatggttcagcacttatctcaaccccactttttatttctttaaattaaatttccttctaaattaattatccgatttatgattcgatttcaccattaaactccttgcaattaaatcttcacaacaagatctcgcacggttatattttgatgagaaaaatcgaactttgtttcaccacttataaaaaaaatgtttcaccactaggtcaaaatgttccaactcactctaaaaaatgtttcagagaaatgcaacattcaagtaatactaaatgcaacaccgataatatcggtatgaaacattgactctcaatgagtgagacataaaaatcttgctcaaatgtttcaactcagtctataaaaatatttcagagaaatgtaacattcaagaaatactaactgcaacaccgataatcacaattaaatctttacgacaagatctcacatgattatttttataatttaatcataaggtattaacaattgaaacatcatataatatttgctgaaacatgataccgtgtgcaatatttttaattaattaatgaatacttattgaaacactcaatcaacacatatgcaacatttataaataaactagtgaaacataataaactacttactgaaacatacaaatagcaccatgtgatgcattaaagaaagatatatacattgcgacaataattaaatatgtgcaacataatagaatttcagttgaaacatcttattctcacatgtgaaacattaaatttaattggttgagacatatgtgtgttttttattataatatagtcatgtgagatcttgctgtaaaaatttaattgtaacgaatacaatggtgtaaacatatcgtagattggatgagtaatctggaagaaaaatcattttcaagtttgctaaaagggtgttatgtacatgcaaataatcttgtatcctctctcctccatgcatgccaatgctaagtaagggagcatatgtaacaggtgtgaaaagaaagtatctgacaaaaagaatacgaggctgcatgcagcaaaaccacaatgagacgcgtccgatttttttcaggagattagacaaccgggtggaagcattttccctactattggccacatttgcccatggcttcaccattcaccaactttgcatgtggttgtgtcctaattttttatacttgcaatttgatctctgggatttataaaactaagttatgccaagtttttagtgtagacttcaagcttttggtccattgtgcaagccaggttcacatatagaaaatgcaaccaaaaaaaagcatggctaaagccggtctcaatttggttcaaagatcccattttcttatagaacttgcttggaatttgaacatgtcaacctagcacctaacaataagataggtgaatgtatgatttaaggaggtttgaggatttgagggtgtgaaagtctcatgtattactaacagctatatgttttaaccaagaaactatgacaagtatctatcttgaaaacaagaagagctggatatgttttgatcatctagcttttccttgtatcatagcaaccatgaagagaatgtgtagaagtagaagtgatctatactttttgatttcaaaccatgtcatgtcagtgtattggtaaataacataatttaacaatgagcatggttatttaatcctgtagtagcttgttgccaatttcactagttcaaatttgttgtctcgtaaaatctttgacgatatcaaattagttccacaacttcgttcaaaaatctgttccaaaaccaacgctgactttattggctagccatggatgacaggccaactgtttcgcttatttatatactccctccatttcaaaatatttgacaccgttgactttttagcacatatttgaccgttcgtcttattcaaaaatatttgtgaaatatgtaaaactatatgtgtacatgaaagtatatttaacaatgaatcaaatgatataaaaagaataaataattacttaaattttttgaataagacaaatggtcaaacacgtactaaaaagtcaacggtgtcaaacattttgaaacggagggagtacttatttgaatcgctaattagtaaataaaaatatttataagtaaaacttttatatgcgtattcttagtgactcaagaacaagaacaaatgttataaaataaactatgataaaaaatcaaattataaaatttaaaatttcactatataagcctaatcaccatgagcgaaacaagtttgcggaccaagtggaccgtcgaatgaattttaccgaccaaaatgtacccttaagtacggatgtaactgggtcgatctacgaacccacttgtaaacaaaacttagtgggtaacctattaatttggtatatattacctccttttttaatatatgatgccattgactttttgtcacatgtttgaccatctatcttatttaaaaaaattacataattataatttattttgttgtgagttgtttatcactcaaagtattttaagcatgatttatatcttatacatttgcataaaatttttgaataaaacgaatggtcaaatgtttgtttaaaagtcaactacgtcatctattaaaaaacgaaacgaagggagcaagtggattcacgggttgacccacttatatccttaagtacgacaaaccgggccataacgcgggaaccaacgagttacctacttatttaacctgtaagaacaagttttgtaatagaggtgattgtcacataaaatattatccatatcatcgactaatttatagtgggcatctcatacaccacattacctctaatgtactaaccctaatgcaacataactatttattttatccactctcatgcaatcaacctcattcttttctctttcttccttaaagtttgtgatgagattacccttgcatgatggtggctcatcctgttagtgatatgccctaaaggcaatcatagagatgattgtatcacatactatgtttacatattgatccgactttgttccttgaaatggacaactcattattggttaatgaatatgtgattctttcatgagactctttatgttgtttgttactatttctaaaggatccctgatcaaatatcatatatggaacaaatatgtttaaatgatcaacacatgtattaattgatgatcatgtctcatggatcatggtatatgtcagggttatggatattacatacccaatagtaatcgactaagctcggcagggcccaccacataccatgtcttatacggaaacaaacctcgtatatagagggagttccggataaggaaggacaagaagagttatatatggaaatgataaggactactcggattgtatccatatttatctccctagtcttacttggacaagggggcaactatgagtataaatacaagctcccctaggaggagaggggacacacccaccacaatatacaaagccataagccaatacaagccaatacgccgccgtatattgacatcagagattagcctaggcatacaccatccggcacctataggggccggcaagagggatctagcaccatctctgatctcgccgagtacggattcaaggaggaagactaccttgtcgtcgactatgagttaattatttagtcgtcaagtcgacgacggatagatagattatcccagatattatatttgtgtgatccagatgaataaagagcaacaccggcttcggccaacaggatgtagggctattacctgtaagataaggggcccaaacctgtataaaaatccatgtctccatcttttttatctcaatctcgcatataccctggtaccaatgatccccataccatccaaatatcgtagtcgtgatatcaaacgtcgacagtatagagataccaaattaataatgtggacacatgttggggaacatgttattggatagacccaacatgagacacttcaaaagctatatgtgttgtgtcatcagtgatctcatttagtgctggtgttgaatccttagacctaagattatcatgattcccaacatgtgtagtagcttacctagggactgctaaatgctactccgtaattgggtagttataaaagtagttttcgggtatgttgtgaaacatgtagtgggatatgaataatcaagatgggatgtggtgggccccttgatgttgtagattatggaagtgcatggccatgccaaaggtgattgaggagtcaatcacaagttatataatctatacaggttcgagtgaacgattgagctattagaggatggcacatatctaaccttgagcttaatcgatatcgtgaggcaaaggggttcatacaagtatacactagaggttcagccgatatgatctttatgtatgctcggtgggtcaatacgttctgctaggggccgttgttgacacgtggaccgaaaatgagttttcgggttacagccgagtgtacatgaacctccaggatcgtacgcttaatgggccggaataaggggattggatggagatccaatatgagcttaattcggatagggatccgaataggagtcctatgggccttggaggctcgagtcatagatcctatatattcgtgagaggtgtgattggcggaggtattgcatcacgagcaaaaccctagccgtcactcccctccccgagcaaaaccctagtcacgcacgggtgctagcacatctacgcgtggcgttccgtccctgtacgtgtggataccggtagaggcgccactactttgcggtgctgatcggcgtgggaatacggcgaggggaacgcacgaggaggagaaggtcgagccggtgcgatcgactacttcctctacatcgacgtgcgctacttcgcgggagtttcttcgacttcttagcgcattcttccgctgcgcagcgcgtcgagtggtaacgatctatgatctaatacttgcatggttcctggtttacatgatagaaaattttgatttatgctatcgtagcctacgcgtattccatcacatcccctatcctctattctttcctccaccttatcatttaagcttaagggcccctttgaatcgtaggaatgaaaaaaatgaaggaataggaaaaacacaggatcctaacatgaatgaaagtataaaatagaggattgcaaaacacaggaaaaacatagaaattaccgtttgctcggaccgtaggaaaaaacacaagaatcatatgagggagatatgccccgtttggcacagctctagctcccaactcaacttacctggagccggagttgtgccaaacggtccagatcctctgtttttttggagtggagctagtagaggtactcctaaaaactgaactacgggggtggagctgggtttttctgctccacagctccactccacccccacaaaccactaccctttaattttgtagtctatttacacaaaaataccactcaactacccttcagtcatcctctcatcctgttctctctcctccccatctcctcccgatcccaaccgagctgcgggggcggcggcaggggcagcggcgtcggtggcgtgaggcggcgaaagcggcgggcggtgacgacgggcaggcggcgcgcggccgacgaagcacctagggacggcgaacgttcggtgggctggcggcgcgcggccggcagccgacgacgcgcctgggccgatggctattttttttcttttttttccagatctggagctgaaacgtatccaaacacttttcaacgagtcttcaactccaataggagctagctctcactggagttggagtttggagcccttcaaaaaggaaattttctaagagctttgagctctggctaagttttctccaagatctctataggattccattccataggaatttcaaaggattttatatgatccaatcatttgattcaaagacattcataagaatttttcatatatagtattgtaattcaaaattctctaaaaaaattgtttttcctcgaaatcaagatcctaccaagatgcttgtgcttagatactctctccgtcctagaatataaacatttttagagttggacacggttattaagaaaataggtagaagcgaatggtagagggttgtgattgattaagtagtggaggtaggtgagaaaagtgaatgatagagagttgtgattggttgaaaagagaatgttagtgaataaattgttatattttaggataaatcttatgtgataaaaagttgttatattttgggacgaatggagtatttatcgaccaacttgcattcttgcccaaagccctctctccctgtgtttccttcacatccactctcccatccaaattcccaagcccatctctctctctctctctctctctctctctctctccactccagtcgaggcacggccggctccccccgcgtcgccggcgagcagggcacgggcgtgtcgcgctcgcggacggcctcccctcccctcccctcgtcctagccttctcctccgtgcggcgcacggccggcgaggccacccagggttggtgacccaaggggggcgagagcgcggagacgcggcccccccatccatctccgtctcccccgtccggatcgaatccgaggtatccgctcttctttctctcttgtagcgctcgctcgtcgtcctccgcgcatgccatccccatgagtgagccggcgtgcgcgtgggttggagatccatcagtaattagaatatctagattggtttgtatcatccccaattaacctgtccacgcagcgaaccgtcttccggagaattggtgagcggagtggtgctgctgatatcaaatcatatagttgcgtgtaatttttgtatgtgttgctgcaggattgatgtagaggtgtggaatcaccgtaccatgttggcacatagtatttgtcgatatggccgtatggggtttatttagcgtgaaaccgattggcattacttggatcatgtcaacatagtgtttttttgttcagatatagccttttactgatcggtctgtgattgtgtgcctacctttgaagttacttccttcatttttttttctgctttcatatgctgatgcagcttctcactaaagcaacttctgcaaatattttctgttggatgtaaatgcacacttttttcgtcgaaataaatcttccataaaagaggagcacggtattaggtgtacccctgacactcactacaacttaagtgtgcttctgagattcttccttttctcgcaatttcataatatacataccaactactattgtgctacaaagatctattgtaactctagcattacacggtgggacttgctacctttttctttaacataaacggtatacatcgttggacaattccactaataagggattttctcttcaccttgcataatgtttttggttgtattgacaagcactgttttaatcctaaaactctctctctctctctctctctctctctctctctctggggtcttatatgtcctgctgttttgttgcctgctatagcattaggcatcaagttccttccagttactatgtgctggtccttttgttaggtttgtaaaatcatagttagttaactagccagatggacatattgcacattatctctctttttccccactttctgatatattacagctggtatatgctcatccatgccacacgttattgtataagtaaaacacactgtggtgaacaaaaatgccattctataacgcgcagctgtgaacattttttattggtgattttttttttggaaaatttatacagaaccagagcaagcagaaatatgccatgtttttccttctttattctactgaagaacaggacaaaattgtgtatatatgttctggtcacacaaaattatattgaaatcctttgaacacattggttgcttttcatttgtcaagtctaaggatgatcaagctggtcttttgtttcacaaagtcacttgtatgcttcttccatgagaagtcctttttattagttttatcagttatcacatcacgataaactcataggcagtgaagtcatgtttgtgtggttttgactggccccagatgacacaccctttttgtcatcttggatcgcacgtttgttattgtggacttgtggtattgtctgtgcgtgctacccattattccctttggctctttattttctaaaccaccccaagtttgtgctagcaggctagcattgacttacatatcttttctagcattattattaatataaccatggtgaacaaggtttctgaaaagtttaaatgcaaacatgatgataaaatgccttgttaataaattcagtctaatctaatggctaaagaaattaccttcactgaagatattaagcatgtgaatgtgtgtacatgttctgcagagtgaacacatgaacctatggaaaccaatgacattgccaacaaacaaactttatgaagttccctattgtagtactacctccgtcccaaaatataagcatttttagctatgaatctggacaactgtgtgtccagattcatagccaaaagttgctatatgttgggacggaggtagtatatattatgagaaagtgactatggtacatatgatgtaaaatactacctctgttttttaatatatgacgccgttgacattttgagatacgttttttgtaattatcatttattttttatgacttaatttattattaaaggttatttaagcatgacttatatttttatatgttggcacaaaagttttgaataagacgaatgatcaaacatatgtttaaaagtgaacggcatcatacattaaaaagcggagggtgtatgtgctacatgacctttttcctccatacggtaattatttcttagaagtggaagtggttaggagtggaaaatatcaagtgagagaactttcttttagctgaaaaatgtgtgtaagagccttgtttgcttttctgtgagattttccttaattcacactacgttcctttttttttttgtcaccgtgtatgaatttcaaaagaggggtcctattcatgttctaatgtgtgacattcttgagtaggtctataaatggcaggaagacaccgcatacctcgtgaatactatgatgaacgtcgaggatttcgtgatggccccccacctccacttgctcgagcaaggcccatctctccacgtcgcttggaggaggagctgtctagccgccgtgctgagatgcgcagaatccatgatgacaatcagcgcctagctgatgaaattgttggtctcaggcaggcaatgcctcgtctgaaggaagatctccatgccgcaagtcaagctatacccaagcttcgtgcagaaaaagaacttgagtcaagggagctgactcagaggaatctgaagttggaagctgaactacgttccttagaacccctcaggcaagatgccttacagctacggtccgaggccgggaaactacagtcaataaggcaagagatgactgcaaaggtgcaggggttgttaaaagagcttgagcatcagaattctgagaaccagaaaatacctgtcatgatagctgaacgtgatgctcttcggcaggaactagtccgaatgaggtactgaactattctgcatcatatttcgtgtaaaatgattgcttcttattgcttttcttgatggatcaagtgttagttctaagttgctgcttgaaggagcgcatttaggatcctttcctacagtttcaattctaaagaaaaaaagtggggtacttgagtatcatcttcctcttttcaccaggtggaagatcaaactgattaatatcactgtaggggaacccttgagtacgagaagaaggcaaggcctgatctgacagcacaggtgcaggcaatggagaaggatcttgtttctatggctcaggaatctgagaagctgagggctgagattaagaagagaaatgcacccagtaggtttcttttcttttgctagcttgaaagttatggaaatcaatggcgctgacccacaacaacatactatgtttgattttaggtttcagcggccatggagcttatggaccaccaatggcgactccagggatgggcctgcaaggcgtctatgatgatggctatccttccataggcagccgctatggcactggatcttgggcaccacatgatccccatggttatccacaactgtgactgggcttctgatcgttcttccctgggcagtgctttatcttcgtaatatcgcttgatggttgatactgatcgtgacaaagcttttctcttagtagaacttgtggtgcacagtagatggtcttttgggggtgcacttcaagtgttgttagtttagcatatgtagcaatataccagctatggttgccttggtacctctccaaaaaatgtaatcaatgatgactgtaagagggaattcagtgcaacgaagaagaaaaataggaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28336 - DNA, 3488 bp, Oryza sativa
ctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggatggggattaatacactagcgttcgggaaaaggcaattttcccggtcgcgacaagctggtatcagagccaggttgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagtgtttcgtttgtagtgtgtttccttgcttgtgtgtgtagcgcatggtttgcatcggtgggttgtgatgtgaccatgctaggttgtttgtttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccgcatgttgacccaaaagaagcaagtatcatctgttttatgtgtgatgagcaagggcactacgcaaggaactgtcctcagcagaaaagaaaagcaccaatgcgaatcgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagcgaagattccgatcaagtctcctcagatgatgaagatgagaagtctccccaaggttttaaccagaataaaatggaacgtaaggcatgctctcgttgtggagaaatcggtcatgttgccagctcgtgtgccactacctgctttcattgtgaggaagaccgtccacccggtgaatgccccatgagcaggatcacttgtttcttttgtgaaggaactgatcatgtaccaaaagattgtcaattcagttttctgctgacgaagaagatggccaaccaacccaccagttccaacggagagaagcatcaaggcaacacaaatccccgccaagattaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccagcacgtcagtccacgcaactccctgcaatcagaagcttgctcctcagcgaattgtcatccatgcatcccaaagcagtcctatagcccgcgttgcaacagctccaactccagcgagtgcattaccacaaggtgtcaatgctcaatttcagccccagccatcagttgacaagacagaggccagtatcggcattgtacctttggatgttccagcacagcagccaagaaatcaagtacaggatgaagaacccaagcgtaagaaagttatttacaacggtagtacctgttaaggaagcagacgtgccaatcgccaagtggtcactggagcaaatgcagtacctgttaagcctagcgctagtcagaagcaaccataatactcttatatcagtaatcatatacttatgttttatagttgttccccgtcaatcatgtaataacagagaaacatgagataatgaatgagcttgataagtttattgagggatccatgttagggttgcaagtgctgtgagttgtgtacattttgttgctgattagggagacctagggtctcatttccgtaagctcataatcttttatgaatcaaataacctagcgattgatggcgaagcaaatcaagtgattaacccaagagacatttgtttggactaagagtttcagatgtgtctttttcggatcaaaggcaatgacagtcagtatagcttttggcgaaacacttcaaggtttcactgaaaggtagcagaccaaaggacctcatcgccaccagaagcatccacaactctcggagtgaagagtacttagtgaccaaagtcaaaggatgactgatagaagatatcgaaaaagatgtttattaccaggcaaagaagtaggtcgaaaggtgattgataagagaaatcgggaaagaacacatcaagggcaaaggtgtaaaggaatacgttgaatgctaaatgatgacaagcatggtatcctagtaatgacgagctgatctcgacgcatgacatgaagtgggtaacttgtatgaggttgactccaaagatatgaactatgcaaagttctggaactgaagccccatcttcaagtgccgcaacccagtcgaagtcagctaaaggttcaaccagggacaagtcaggtgaagagaagattccatttgcaacaggagatcgagccaagcagttcggagtggagaagttgtcctaggcaagtttgttacaaaagacggagcggaagaagtcagacaagaagagaggaccgccaacctatcttcttgctagcctcttcgaatctcggggacgagattcttgtaaggggggtggatttgtcacgtcctgataaattcatcccgaaataaaaatcattcgctaaaaggaataatagaattaattaaaattcgaaaagaaattggccaaccctaaaatacgtacaagaaaaatttgaatgtgggccggaggatttttggttaattttccttggtttaaaaggagccttcaaatttaacttgaattttcagagcaccggaa

SEQ ID NO: 28337 - DNA, 26763 bp, Oryza sativa
  unsure (1)..(26763): unsure at all n locations
tggnnnnnnnnnnnnnnnnnnnnnnnnnnnnnnnnnnnnnnnnnnnnnnnnnnnnatcgatcagctgcaagttcttcgaacttataatagcgggaatctggtcattgatccaaagctcacaaagagataacaaaccaaacaattcataggagtcccccactagtgccggtttgacatccactccagcagcgcgccaagagaatcaagtcagtggtagttatataagtcatctccgacgaaacaatcatccactacttcaatactggcttttcgccccaggcctccctctttgggagcagttcgtgtcgtaagatgtcaggttgagtccgccaacgaacgcaatccctagaatctgttttgatcttattatttgctttcaacaagaagcgggagataagccttcatgactgcaatttccagccgggaaagaagatcaaggccactgcttttgagccggtacccaccaaaaatcatatagagtgtagtttgtcaactcaaactttcctggcttcatttcccattgtcatttctttttccaaaaactcatttgctaagtagaatagttaaaattcatgctctgctagagcaaacacacttctcgggattgatgtcgtctccgtctactttttctcttaactcactcagagagagaggccgccaaggataaaaattattaaagagagtaccagacaagaggtagttgtgtggttctattattcgttcagtgtattattcgggaattggtttggaaagccttggtagtagtgcactcaaatcgacattgagattgggacatagccgcccaacgattagaccgactgggggattggaagatctggaactttcctttggccaactacaagcagttgatcaatttcaccatttctttcattcccttttcttcttttcttgagtttattcacgagttgatgtcattgctttatttaatgggtctcagaagttttttcaataagcttatctgagataggcatttcttgagactaggctagtgcattggtatagagagtaacagtagggtaagtaagacagtagtgggagtacttaggattggtattttttcttgggaattcagtaaagtttgttgtagcacttttcaacgaatggatgtcctcttttcttcttgtacggccctgggagaggtctttttttgtaactaggtcagctactcaactcatatagccgtgttttttcctctatttcaactccccttgtaccgagctcccaaagctttccttctgtttttccgcgggcgggtctgactcttcgatacaacctatgatttgtgaagctttccgctctaaggcattttgaagatatgattgcgagagctttctttcggctaaccctatctatctccttaccctgtaagaaaagcaaggcgccctccagtctcgttcgctgggtggtcagagtacagcttcgccttctcctcgggcggcaacttgaaaaactccattccaatccccaacactttcctcagcatctcctctgttatccccttacgatctatgcacattagaaaaaaaagttggaaaaaaagcatgttatctctcatttttcgtcggtaagatacttgtacataacagactagcagtaccataagcagcaggcttttggacacagtattttgagtaaaatagggtaataccccataccagcatgaagccatttacacaaagcccataatttggtatcatgccggtaccagagtcatacataaaggtctgtcttctccttctgctcgaaagagtctaatgctacatcctttcactcatgtagattgtccagcatttcatttgacaaaactccttctgatctgaggacgacgaagtttatgaagctgccaagcaagatattgatggaatctcgacaacgggttcttatgtatgatgtgtccattaggtctcaaattatcaacacggagtgtacacagagttatgtacgagatagtagtccttccacacagccgtcagttaataccatcaatgattctgatgagagtttcctaggtaggaaggattctgactttcacagccatcatttgaattgggtttgaggaaggtgaacaggggtggtcgggtcatctttatttacgccatgcgtaccagttgactaggatagagacaaaagatgtacaaatatgtcctaaaagtgagtcaatggcatgccacatggtgggaagtgtatgtaaacaccgtagggagacaaaagcaagcagagaaggcgccagtggcgcatgacatatttttacaagtgtataaagtctagaagagggcgggggaacatactctcacgttctccgagtgggtactgcaccgagtaaaaagggtactggtcgacacgggtagcccatttcttgcataaagaagttctcgaacgagacgataaaatcttgtcccaggttcgaacttctctcataagctttaccggttaaaccttataagctttgggtaccatcttccagttcagttttggaagtctccgaatgtggccatagcgaccgtcaatggtggtggacgccggcctatcatgcaatattaggacgaggaaggctgaatgcaatcgaagctgtagtttccacctctcacttgatgatgaagtttcccacgggtttaaaaaggacagcaacaggtagcgagggattgttacctagttgcgttaaagggaaaaggggccatgtggttatcgaataaaccatcacccttatcatagagatagccacgaagaggtctgactttatatccaaatatatcagcatatttaagtttctctgaatagtaaactccgataaaccggggaaaataagcaatccagtcttttttatgatcgatatggaaggaatggcttattcattgtttcaggacagtccacatatgcctcgagaaagccatacagttcctctccctgtaaattaccatcccatttagctgcacctatcggcattggggatgatttcattataaacggatacagagagcgaacgtcataatagaaaaaattctcacagcttatacacatccgcatgacctccatagtctcccctacgaagaaactcatcagcagtcctatgaggaattgctataggtgtactcatctcatcataataatccttcctaaagatggttagcgctagagaagacaaggtcatcatccttgtagtaatataaagctcgtaaagactccaatagatattttgatcagcataataccacccaatatgtcttgcttctctaccaattccctcttcctagacgcgaaattatccataactacagacgtatgatctacttcacctttactgccgagctctgggcagagactttgacctaaagaacttaaagaatctgggagtagcttcaatgaatcacgaaacaccatcctcctgagtagtccctttggcgactaaacgcgctttgtaccgctcaatcgtaccgtcggacttgcgtttggttttgtaaacccacaacctaccaattatattgtagttaggactaggtggtaccagtacccaagtgccattatttgcaagagctgaaatctctgaagccatagcagagcgccactgtggatgtttaacagcccctgaataacatgttggtttagtctcttgattggaaggaggcaatggatgcagggtagatgagtaggcaatgaaatcagggaatttctgaggtttcatagtgcgatctgtggttcgagtggtcatagagtgtgtcggttgttgagagtgttaaggacatggggaaggaggaggtggacgagaggaattaagaggagaagcagagactgaggagatgactggaagagttgtatgagaagatgttgaagtggagtaagtagtgggtgtagtttaaggcacagattgaaaaggaaatgtagattcgtcgcagagaacatgccgactgatgtaaatggtattgttggccagattgagacatttgcttcctttcttagtatcacaatatcccactcactcgctttggttagttatagtcaatccataccgccttcctaaggttagatcagatggttctgaataaagaggaggctcgggagagtaactcgtgtcgttcagttggattcctggtcggctttgtccaaacaaatcactccttacagaggcgaggggaaagaaggcagagcgatagggataggcagagcaagagctcttaaagtctacccgggctagcttcttcattcttcgatcaggggcgggcttcttcccttattatatacgatgacatagatagagcctccttctttgatccattcattgataaagtcttcgggggcagtttaccttttgaatcgacagtagagtaggtttgctcttgctttctcaatctttccctatgtagtagatccggctttattcggctaaaaagaggccgtcgtatctgctcgcccccttcttcattcatccaattaggtcagaatggatccagggaacccggctcgggaactgccctgagaaaaacacagtaagagagtccaatctctgaaatatagcattttctctcctaagtacctaagtagtagtagaaggcttagtatctgacttgatccaatagagtcagaacacactgtagatccagattccacaccttgctgtggactggggagagagcagctctgcgaagctgggcgttctgtgtgattatggaggaactgtagtactcgccccaaaatgcaagccgggatagatgcttaaagaaagggggagcggtgggccttcaaaaaggagcgagggagtgatgggcaaccgtagtctatatgttgctcgtgagcccccaagtaccagtctcgcaacagtactggcgttaaaggatcggtccttcacttgcgggtcgttcgcgagtcgaactcgctctcttgccacgcctttgactcacgaactcgagtcggactcattcactgctgactgaggatcgttcgttcttcactctcttgctattacccgcagggagcgcagcaaccgacggtgcatattatcatatagaaagaaaaagaagcgaagcgtagcgattcgtactaccggaaaagtgtcgctaaccgctaggcaatagagtcagcttacggggtggagcgcaagcaagcgtagcgaatcacatagaattgcccctacctgccagcgcgcagatagatagggcgggcgagcgcagggatggatgtctgagcggttgaaagagtcggtcttgaaaaccgaagtattgataggaataccgggggttcgaatccctctccatccgcgaggtcataagttctctcttgccttatctatagataagaacgaatctcctcgactcgactgatatgatggatggtagaaggttgaggttattgtgtgttgatttagttaggactttgtctccctttcgttatcttccgccccgggacctgtgggagctaagtcgaagatctcggtgtcgtcgtgagtggttgataaacagcgattgcagtttgatttagggagtcccaaccctgtgaagcttaacagacaaagaaaacgatagagacttccgggtattgggtgacgaccttaatgaatcaagtattcaggtggcagagttattagctacataagcgctcaaattcctgaatacttattgccctggcttctatgatcaacccctggcacatttaggttttgatctgaggctatcctggtctgcgggacccaacacaagtattcatcctttccaatctgaaaaaggtgttgccgaaagcttaccctcttccacacggatgctacagccgctatcacttttgctgggggggaattacagagttcgcctctcgacatcttgtttggtaaacggaatttggacccaggcgccctagtgttgcctaaccgttcggccggggatgtcggatgcgagatctttagctacttgtatcaatttgccgcagtgtgcttagatacaatgcgctggcagctgaggcttggcaggatgggagttaattagggtcgagggagcaggaaagagtttgttattcgctattggcttagtacggcctatacataatagggccatgacggttttggcaaggccttgaacttcatatatcccttttttactcaatccagaataccgataaagtcagattgaatcattttttcgagcaagaaaacggatgcgcgtgctaacgctttcgcgctagtgcgctcaatccgttgcttgtttggggacagaaaaagttccgtaatcgtcctattttttcgttgcatttccttgtttttaacggaagtgagaaatgcgtaattaatatatagatgtgatgattccatgaatctctgaaaaggtaggggtcaaggaccttatgggactgcaatcgtgcctgccaattggggaaggacgcgggcctggcaaccgctcggctctagtaagggaaacaggtatgtctcacatcattgctcgaagactggaaaaactgcaagttagctcagttggtttaaaacggcatatgtgagtgacgcgaactagcattttgaattgagaaagccagtggccggggtggtctatgttgttatggtatctctctttaaaatcgagattgtgtgggtgttcagtctaccgctcatgttcgacgctattatggaccgagaagaggaatcaacgaaaaacccaggaaagagctgcgaaagaaaagcgtgacgagcaaagtcaagtctccacgactcgacatgttagaaggagctaaatcaataggtgccggagctgctacaattgctttagcgggagctgctgtcggtattggaaacgtcctcagttcttcgattcattccgtggcgcgaaatccttcattggctaaacaattatttggttatgccattttgggctttgctctcaccgaagctattgcattgtttgccccaatgatggcctttctgatttcattcgttttccgatcacatatttcttggtgtagatatctctctttgcaaatagagataccgaggccccccaacctactagttgttggtgggggaaagaagagtgggaacgtgggcttctttcacagtgcgtacctctctttctcttctttctcgctctgttctggaaactaactacttctccagaagcaacgtcaacaacttatgcaagactcctttcgtaactacttttcggtagaaatacggacttcttcctatcaaactgcttttgcccagcaataataggcaagacttgattcaggtcaatacaatactcttcttcgaacttgtaagcttgggacacaagcgtaaactttttcaaaagtaagaccaggtacactgctaaacataagtataaagaggtggaaggccggctgtgcttgtgctcacctacaggtctgtcctagcatacagtatagaaaaagactgtctcttatttgtgatttgtctgaatcagcgtatattaactaatactactttatccagtcaataattaattgaaaggtcgtctttaattaaaaagtgcataagcaagcaaggaacggaaggcatgctaactacactactagagtcaatacactacaaaccaaactacttgagtaagaatctattctttttgcttattcgtaagcgcatgaagaaacttatttcactctagcaatgagcataaatagttgacaacatagttgtattaattcttattttcctcttcctactacatacacggctataatcgttatatattctcttcttttctttagactcttctttctgcatctcttttctttccattgtgagtaaaaggggacagcagtgggtcaagtatgttgattggtatcatactgtggcagtagatcctggtgtctttctctcagctttcagaagcacctttcgtgctctcgtagctgtaaggaaggcaaggagaagatccgcatattgtctttatgggtcctctttatgatgaggttgctaataagggtgggtaaagtagtcccaatgctttttccctcggtaaggaagacttatggcatctaaggtaggcaatttcttgtgttcgcgtttagctccttgaacaactttgtatcattcgataccactaagcagcggttaatcggacattccagagagttccttcgggaaagaagaagcctagcctaacattgaaataaaagtgccgtagagagagatcatttagtgatttgatcgtctaagatgaaatcacatagtatacggcctataatcttgcttcttttgcattcaacaagaaagagaattggtagtccaccatcatagtacctaagtttgattgaatagctctatttgtagtcttcttgtttttgagaaagtgctctagacatcggttcatcccgagcaccacatagtttccagatgcaagctggcggggaagagtttatggttctgagaggacattcttttgttattgaatttaggattgggaaattgatgtatgtcagtgaagaatgcaagttgaccaatagcagctatgaagaacagcacctgtgcagtatgtcatttataacggattgaccttgaataagccattgaaatgctatcaaaagatagctctgttgataagttatttgagttctagatgtctacaacttaccacactcgttttccctttgtcggacaaccggcactagcttgataaacgacaataactcgtatagccgtgcttgtaactaagctgtgaatggaactttccaaaaatagagatttttctgaaatgcagactattcacatcgcccttatgtgctcagaaaacactttattctcaatcgacgggacggatagagtaaagaacgatatagtgtgtgactatctatactcaaaacgcaagagcctgtacagcaaatcgttcagaaggcagcttttttcgaacttacaggggcgctgcgacagctaaataaagcgagcactcggcaacttcaatctcacctctaccccgcactgaggtcaaaaccatctctcgatcggggctatactactgagtcgaccaattcctctccgcccttctctgtctttacccgccgggagaagagtttgaggagcattgtcaccgaacttcactatactatttggtttggcatgacatcttcttctaactgagttcaaaagagtattgaaaagaatgaatccgggttttagcgctccttgaatctggcctatacgtagtgtaagccgcctgcggctgctaaaggcaaggtatgagggtgaaagtaagcgaagcccatcttgatatagtcaattgagtgagcctatcttatttagttctgtttatgcgtctagtgagcattgaactcctttgacaagcgcaatgcttctttatcgatcagttagacgctttatacctggttaaagctgaagtgacgataccagtgcctgccgaacttccaagccctcaaatatcgaggatatggtgtgccccgttaccttatttcaaggtgtaataaaggctctcccccgactagaaggatccagggacaacggctatttcctccaaaaatattggcagtagccgaaacgactggaaacccaggtagcggtccggaaagggcaaaagggcaaggtgagtagtgaaagcaagaacgttctttcgcatatagagcgacagcccagattcagggttacttgtccacaccaactgatcaggtatcggaaaatagggcatatttgtttcagccgggagaccccctgggggtctagttttaaggcgagtaggcctattgagatgcacataactaccttttttcatcttatcaccccgcctagcgactttgcaagcattacaggctaggcacctaacaacggttattcctccaacaggttattctgggttacgctaaaccttcaagccttctaccagcagatgaatacttaatctatcccctctgcgcacggaaagggaaagctactcttcacttcaagagtatatgccgaaaatcctatgtttggagatgaccatgaacacacagcttgagacccttctttcgtgagacagatgtgattccgctttcatgttttggattgagctttgtcactctttctatgcctctttctttttcttggaggaccttcccaacaacacacacgcggcgctaaggttacccgtggcaactgaactaggattcgaagccagaatgagcggatctaccgctccaggtcctttcctattcttatactaatatatgtaagttccttgcgtttagaactagaacgtgaggcatagtaatggcgcatgtgtgatattactattgatacctgtttagactgactttaggaaagcagtcaagcaggaatggaaaaaatgtcttctgctgctatcttatctgctaaaatggacaaaatcttctcttcttctctatgtcactaatcacagtcggagagacccatgagactttcttttctcccggcaggctctagcgctacggcaatgcttatggctgcaatccaaacagcaatggtcctcgcggatttagtgcacccaatccattaggggttcctgatagtgagattcctctagtcaagtctaaggattgagtatgagggatttcatccagtccattgcggaatgtatggtcacagaatagactcatcccccggcttatagtatgcagcttggaaggccttggattcacacgtctggtgctgccccgtcttctccgcatcaaagagtaaagtatgctgttgaggtggtaaaaaatcgactttgtttgtcactaaacctgcagcattcccgtatattgaagccgctgaagaagctattgagacttccttccagtcactcgaaatttggaatgctaattctgtttctgagggcggagctatgcccaaagatgtctgaagcttcgaagatggtagcaagatttatgctgaacagcccatatcagaaaggcaagggattgggcaagaactagcaaggaatattcgccccagtggaactcccttctgctgatgagagattttggataagagttcataaaaggcgctagccagtttcaaggtcaggaagggaaaggaaagagctgggtttctaacaaacacagaaacgtttcctttttcgtttttcgctttgatttcgatagtaaattgtttgtattcatcgcattgatttgaaaagtttgaactttgatttcaggatggttacgggaaatttcactctcttggctaattgtaccgtcctttcctctaggtattgagatccttcgacaagttgttcttcccccgaagaatcgtcaccaaagacattcttccatggtttttttacatgggggggggctcggttttgtaaaagattatgggtttgtgtcgaattattttattcttcttacccagtccttcggtggaatgatgaacatacaaagctcatgaataggattgacttccctagggcaaattgctttttaatgtttttcgggaattctttcaatcattaggttttatacctgtcggtatcggattcataatcttcgcgtggttcaaactgctcttcttcaaagggatagttcaagggcttgttcattatttcgtcgtctgatgaagaaccttcagtgcttgaagtctcctcatccgtttataatccaaagactggaatgggtttaatcatagccacctgtttttggggtgtgttagcagctaggttttttcggaggaggaaccctggtataatcaggagtattgggtttcttggcgttggatgaagtttcagccacctgtgaggaagagggttcagcttttccactccaaccatttttcaaggttgtcatttcttcctttgaaaagaagtattgggcgtctttatggcttatctcgtgtattccaaagggtctcagacccctagctattcttctttgtttaccattctttacatatttgaagcacgggagaaggaaaaagactttccactgtcctaaactaaggacgggaaggaagaaggcgagcatatcctctaaattgattatcctcaaatcagctcttcctggggtggggtattgtctgtcccgataaatagataattccaggagtaataaataggagtaaagtattgatataattggaattgcagaagcaaataccaatttactaaaaaaagaaaaaagtatctaatctaaagggctcattttcttttttaggatttaacaaaagggtttgcaaataaaagcgctagtgccacaactagtccataaattgttaaagcttccataaaagctagactaagcaataaagtacctcgtattttaccttcagcttctggctgtctcgcaataccttctacagcttgtcctgcagcagtaccttgaccaactccaggcccaatagaagcaagccctacggccaatccagcagcaattagtggaatgcctagtttgactagttggttcagtagcagaaacaacttatttccccgaaaaagacctagcttcttggacagctcaatccggtgcggcaggaacgaatgaaacgactagtggtcctcggaaccctacccgagcttatattccttgcttcaacgcccgcgccttccgtggaaaagtactagtgcttcttatggagcaagaaaacggatgcgcgtgctaacgctttcgcgctagtgcgctcaacccgttgcttgttgggcactgaacacttttcaagatccggttttggtaggacgaagatttttcactttcgtgaaggtcgttctgaggtggaatcgaaccactctgttaggatttagagtccaacgcgcaaagctaaagaggatttcaagtcccccgcccgccagaacctaaagattgctttatttttatacgatttattgagttaactaaaaagctggttcgttccatagagatcagacttagaaaaggaagctctgctaaaagctaaatcgctaataagttcaaacatcaaaggtacctgtctacatctacctacccgaagctactaaaacatcatcaacaacaacatcggaaactagatgaataattgaaacaatcgggttgaatggaattatctcgaggctattatgcgcaagcttggtttccaccaggtggaaaaggtgatgaaatgtgtgacgtcgatctctttttcggtgcttttcaatggtggccaactggagaagtttaagccaacgagaggcatccgtcaaggtgaccctatctccccatagtaagccagccaatagtaccctaacttaagaagttctcttagctagcgcatgtccattaatgtgaccaccgcatgctcctgcatgagtttcatgaatggtttgttttcgaatccattcttttttaggtatactatcttgcctcgagaaaggagctcgcaacaaaacgagagctttttgatagcccgttcactcgactaccacgcttagtaagtctgtctgcagggatgggaatggcgtagtctgtctgcccttcttcgtaagcaactggaactatcaaaagtcaatgtcaattggccttctaaaggctatagccctgtttcttttgaaaaaacgaatttcgagtttcgaagaagactggcttccaagaaagccactccgcctaaagagtcctaattcctatccggtctacattcactattcttcataggcactgcgctgggtcggtaggttgctgttttgacttttttcttcttgctttaatccagtcgctcgataggacttcccgtaacccgaaaaggttggttcttcccctacaacccctacccctccaaggcagtactcttcatcggcaaatccgaatgtctcgatccgagttgagacccacctacagaaattgatccatcaacggcttttttctatagtggcaggaagtctccaactcttcgatatgcgctagctaggtaatccctttacttaatctgatatgggatctcttgctaccagaaaggaactgaactggcttgcccggaaagaatggattgctacccttggagagctaatggtactggactgatagcgcactgattgaaccgaccccggacgtaccactggggaacctgtggctggagagaatctctcgcgatggaaagaaataaatcgaatctagaaagacgcgttctacctatgactgccatttgttcgcttttatctatcgtattggatagaattcaagtcccttaccgtattcatctattccctctcctttcagtcgagttgacctcggattctaaagcaacccacgggcataagcaaagaagttatcaagcttttgggatagcaagttatttctagggtaaaggcaaacaagctaacagtctaaggctaagtccctagagttccagttttaatagtcccattcctcctgccttccgccgacctgcggccttatcatagtagcccttctttcttgccagcgagatagttactacgaagtctgcatcgggagaatgggaataacgatcttttatatgatacggaaagcgaagagaatagactgctacatactaagttggttattcgtagatttttaccttcttggaaaataggaatggggattggcagggcatctactatcaactagttacttgggcaccggtgatacaccccaggataccttacctatttagacatttacgcctcgctgcgcgccttcccaacgagccaaaactatgcctaggcctcgggcttaggaactatactacaactagttttgtatagaaaacccagaaatacccatattcctttaaccttcacgaagaagttcgttagctccccctatgtcatactcctaaagaagttgtaataaaatgtgctgatccagatagatcaaatcctgattacgacttcttcattcggtttgtagccataccgtatagagttccaaatgcctttttttggaagtaactagattcaagcaagcatcctagcaaaacgatcttttgacaatgggctctgcccaacactgggactgactgactttatacagagatagaaaaggcagcaatccaagctctttttgaatcggatattggataggctaagctaggtgtagcccgctttctctacggttttgctgaacttgtcaagcccggggggcctttagggaattttggagaatgatagattctaggataacactttctaaggttgaaagggatggcatgggttaagcatctgactttggaccttcgagctaagttatttaataaggtcctactaattaattggaaatcctttttacaaatctcctcctcagagcgccctgtaaccttactttttctgaatggtacaccttatttaagacattcagaatagaagaagagcagtcgtcgattgattgaaagtggattgacggcattcatcagttgattgaaaatggacttttcttttatgatcgagcgaggtcccttttgggcttaaaagtcctttgagccgtggaatcccttttgtcttgatttaggagaataggcgcattgattaggttacgtggtttgagcaatctgcaggaagtttatttttttctttattatatataccattcatatttattattctatataccattcatattaaagtaagacggatagggcatatttgactaggaagcaagcaaagctagtccctccataccagctagcagtcttgtttagggagtctccttctttactgagtaaggttcccgggtgcctatgcgattattaaggcagggtgctactgtaccagtagtagagtggcttgaatcaaatcgtttgtctagagagggtgtagcgataaccaaagctgactgtactagaaactttagatcctgtataggcaactggccttagaatagtgtcttgaactacaggacaggaacgacccataatcattgacgaagaaggcttggaaaaggataaaacatattgaagagaagctttcacaaaggccaatagccgatagctgatgtcactagccttaacttctttatctacttgaaagctgatgagagtacggctttcttaaaggaagtgtccgtccctatgatattatatcatagtaaagagcccttggattcgcctttttccgtaagcctaaaggcaagggaagctcttcgtcgagcttcttatccattgaaaaagacagacttcaactttaagactaaaacctgcccctttattattattagtaagtaagataggttgcttgagccaatccttaaatcgtgggaggaaaaggcaaaaaagtgagcccacccgactaaaggaacggagaaattctgaacttcaataatcgaagagtggtcgtaggtgagcccaccccaggcaaatccacttatcgttatcttgctcctggtcaagctcccgtacccgctcctttccgtgggctttctttctgctttgacttgttccttttcttgctttcaggaagtcgtccttgacgagggccccttgatagccggtcttcgttgccaatgagaaagaaaggctcctgcttgtgtgcttagtctagccttgcaagcaacctcttcctaccagaggactaccatataccgatccttgctgttaccgcaaatcgatcaattcgttacttttcatcggaagaagtagcacgcaactcggaaagaaaaaacctctgatgctccttttttcttaatgatgcaactaatgtaatgcctagaactgatctattgcaagcccagatattcgattcctaacagaacaactcatgtgtgaagtagatagataagtagagttgctttcgctttgttaacttacgtaaggttgcgtaagatatgtgaatgtagttacgtgagcttgcttgcctcactttcctaatatattgttgacaacgcttgcaatagggcgtagtgttgcgctgggtcgtcttgttcggaagttgattgagaaaatatgcaggcgcaaattggatgcgtaaaccttggactcatcatagctatgctatggctatgtactagttgacgagcttgcctccagtacttgatagaagcccatgactctctatctgaaagtggtcttggccgtaagccgataggcgtagttgtagcgaagcggcgtatatcgtagttgttcggatagcaagctacctgacgtgataaggctactagtgccctccactcgtgcctactttcactaacctatagctattgcatgcaagctcaatcttctatctcgcattgctacgtgctcgaaacagccaattcgctcgtatagctaacgcaacctatagagtttggggagtgctgctattctttccaaatggtctctgagtgcggtctgtcaattcctgttgtagacatctgaggagagggggaagaagagtagacttactacttttgcaaatcaaagaaagaatttaaacagacatcaatcatctaatctgaattctttgacaattaatagatacctatcatagaaaaacctttctccaaggaagcttgcttcttgttccagatttgatctgatcctaaaataggttactttgctttccgctctatcggaaaacgttctaacgtattgattccgtaattctatttcaaaaaagagtgagactcaatctccttatgccatcccacgctaccgaagcagactcgctccgtctatgcgtcctgaacccgaagatagagaccccagctagacctatttagtttagttgcctcgggtgagctgaactaccagaactagttctttacaactcgtgccccggagccctctatctagaatagctctctctagatttcccagaaatgttaccagaataagttacaactgactatatcttcttttcccagcgacgcgccctcccactaagctctcaaccaatccaaggttaagaaaagaaagaaccaatggaatagttgcgaatagatcagtcaaacctcatcaagtccaggttttgtaggcaggtatccggataggtttatggttggaagagatagacacgaacggatagccttgtatgtatcggtatgaacaggtgttcaggtttaggaagagtaatttgaacagaagggctagctgcgcttattccgacaaggctgaacatgagttgctctcaaaggacttgacttctgaaatctctattctacgtttttcaactaatccacacgagaaaatcctatctttcaagctttctctcactaacttcgccaattgtccttcgctccagatggtcaatgtcttcagactagccatcagcccttggcttctgtacccttctttctaatcaatttagaccttaaatgaatagaactacccatttttttttctatgccttgtcaacttgcttggaaaacaacatgctcttcctttccaaaaatgtttttagactaaaaaggttcctttttatcttgtgcactctgatgtgcggggaccagcacctactacacctacaatgggtggcaatatttcatcttatttttttatgatttttctactttgattttacttggattatcttttcaaacatcgctcagagctcacgaaactttactttgatttgatttgaaaaaaaaaaagtttttttgctactagaatgctgctgagtacacagattcctctttcctttcaaggaacagcgagcgttttagggaaggatataggggcgaagcggctgctaaggtcctcttagactaaatagctttttatcaagctattatgatgctcgcttctcttcggtcctcgtcattaaaggaaattgtgcttcttcagttctacattaaaattgtgagtagattcttcagttttaagctgagaaatcttggatcaagacatacaaggcagcattggtcaaacataggactacctaggctaggtcattcattgcttggtccgctatattcgttttgtcttctagttctccacagggacttcctactactccgccgaatctctcatctgagaaagtaggtcacctgagtcgggtttacctgtggaatctaatgcattagggacagaatcccaagacgacgttggcgcagaagcaatctctgggtctctacctttagattacctggccatagaaacacgttctggcgaagatgaacaaacatcctcgggtaagtaaacttagagcaaagagaaagcgacaacgagatcatacttttattgcttttgaagttccttctactggtgtaccgggcacaggggatgttgcctcacctaactcctttatctccggcggattcgcatctatgtctctttgagaagactgccttgacaagtcaataatcaatcactagatttaggatcacaagccgatgcttcacgtcgaaatgggttagtctgcatctgagagaccccgcctagctctaaaatggtttcaacctttcctcgaccggaagcattatgatagttttcttcggctagaaaaggaagactcatagtcgcactgggagtgaacgatacaaacgatgaagctcccgaattggcataattgatgtataagaagaaataggatctgttgtccttggaaccgggcgcggccctctttccgctattatgagcgggttttgggttagccagagcgggccaatagggataaacaaagtatggaagtagttgtgaggtaatcagattgaacaaagcgtgctctcgatgctcccgcagttgactcatttcccgacgttcttgttgctcgaagcaagctccaaaagctgtgcttaaggctgttgttgttcctgggctggattcgactggcgagatagactacttgtttgcgactttccgtgctttactttcaaccgcgatgaggtcagcgtttcttagcggataacnnnnnnnnnnnnnnnnnnnnnnagtcgtaagatgaagtagcagatcctgaaccagctttggacatagttctttctttttttgattagaggaaagacggaggatgcttgccttgcgaatttgcaaaggactaacgagattgtttctatcgccaagatgagccgcttcgggctcaggagactatggtggtctatgatcaaataactggtggtgagactgcggctcaagtccacgtcgtgagaaagactgagctattctgtacttttctaaccctttgaaggatgaagatggcgaaggcgcgggcccatgataaggattcccaagcctacttggtcgatttggttgataacttttagtatgcctagggcggagactttgcatttccatgggtagagcactactagaatgttagccattcctattaggttactgagctcaagtagggattgtagcttcgaggacgttgaaacccgtcaagaacagctagtaaagtgaatggatcatgagccaaatgagtgaaacaatccttcaacaagagaagacaaaaagtatgaccttacactcctgtgcattgaatgaatagaaataaccaggattcgccgccagacgaaaggaatgaaacatgttgtgtctgtttcagatcgagattgtgatgtgtgatgaacgcagctcggttcttccaataagccaggtaggcgggtaattctctccgtatggctggaagtgcatgctctcacttcgagtttcaattcaatcttatcgcaaacgctctacgcctcgtcgaataagagtgtttctggatcatatctattcttctcgggtactctttcttaatgagaaaatcataacttgatctgatctttatgtcgcacagtggtgtcccaggctagggctgcaggtccagcataagaatctaaactaaaaaagtatgtttacgtggtccataaataatagtgacagaaatccctcctactgcgcctcaacttggactggagctttcgggtctctaggtattgaattaaagaacgggtttagctttgctttggggggagtcctggtggggagatatgctagcaggtaatggctcagcttctacttaaaaagcgttttaagcgggtttccttatttatttgcgggtctctcgtacaagattctatcagttacagcggattcaagggatggagccagatctactatccgcttgctgtccctaagctgataattgcccgagcctatttgtttttttccggggaggggcacatagcgatagatactttataaacctatcactaagaagcgggctcactgaaaaccaaactgttcgtatttctttaaaacgctgctgccctagccgggggtctgtctatagaagaagggaatccagaggaagaagcagctccccgaaggaatccttctaactaccacctatctacctcccgcttttgttcggacaaggcgagtttcctaagattcacccaccgcggatacactaagcgttcttcccgttggtaaatctgattcttgcaaatcaacatcagacttagaagcttcatggggtctggtctcgccatttggcaatttaagccaaacaaaatacagtacagaggttataaccaatacacaagcaggcgtgaaccagtcagaaattagaatggagaagtagacacagaagaggaggttgttgggacagtatcgatagccgccttttcacttattgctaggagtgattgtgagagaatacataacataggtgaaagccaaaaggcatatatgaccccccaatggaagtgatttgaaactgacgtttctttagaattcgattaagaataagaacatagaccggcttctagaaaaagagacgtgccctcttctctatctgtagattcaggagcaacatgctggttccttttgtcataatacctaacggctgtgggcagaatgaatgaaaaagcagatgaaagacactatacataccgatagaatgataaatttagaataaagctaggtgacatcacggcatttgagaaccaattgcttcttttgcttttcaccaaccttcatgtacaatcttatttcgtattggagtacagcctatcgtaggcccagcaaaggcaagacggaaagcaagcattaagtgaagaagcaaggtccaaacaaagtagtgaaagattgacattgaaaagcttctccatgtctatatctgtccgatggaccaagttcaaaggaaacggcttctctactgcatcaaaaaaccaatccaagcctgaaaaggagagttgcggttaacgattcctataaattgagaaagaagcatgttcttcatgcccaaaagcggataaagtagatggaacctgttctctaaccttctttttgtagcagatactgcataaagtttacctgccttgtaaggcttttgtaggattaatcaaatttgctttttctcgttctatctcagagtatccattcattcgatcttgctatccgctctcaattgaatcccttctctgttgtcgacaggtgtgtccgcatcaggaccagaatcacggtctagtacctccgtactcgaatacctcctactttattaattaggaagtgaagtagggaacggtttcctattcaaagtacagtgcctttggtacattggtgcattggggatttccaggtagcaggtcggttgagtgagggctccatccataacagatatagctagcgcacaggatctcccttctgcgaacaaaaggacaaaagagccgggtcgggcgttgattcgccgttgctatcagtcggtctactcgtgcctgctgcttactttctcgatcgatggaatcggtgattcgaaaaacctaacatccataaggagtctcaatcgtagctcactcgttgccttactctcccacaagatcacactaaatacaataggtgcgtgatctactagattcttatataatcaatttctcaccttagttgatagacaggaaccaccatcccataacaaaaaaggggggcgaaggttattttgtaccaatgaagacggatttctctctcgagctgctcaaagatctttaagtggcttacgaggtagacttgatcatgatccatatccaaccttctcccatctgcttctgcctaagtatttgttttcatttctttgattgaacattccaagcttcctttctattatacctaatgcccatagctagttttattttatatttgtctattctttttgaaaaagctttatccgccccgtgcgagagagttgaacaaatagcatagcctctgggatgttggccctagtgaaggggagctcttcgcagctgtcagtggaaagatggaaattggttctaaaagagccgagctagggataagagatacggttggttggctgaatggaaggaatgctattctaatgggaaccgggaaaagaatggttcccaatacagggcccgaagaagagagacgaaagaaagtagtgaaagaagaaataaagtacgcggataaaagtgaaaaatcacatagctactaagtcaaaacgtccaatgagaatggagatcaagaaggacatgaaatccattagcagctctatcagttatttcattattggcattccttaaccaatagaaaaagaaagagatcacaagcgttatcagtctccagacgcatctatctataaaaaggagtagggcacctgatatgagatacatactggagtcaaggattgagaccactagtgagaaggcaaagaaatcgtttttatgtatcggaagggaaagaaggaccatccattggcaagcacttaaggacaatggctggattaatgaactccgacaactgctttcccttgcagcacgttgccaactaagctctcttacgtaccaactgagccacttatttacaacggaaaggtaagtccgttaggcacaactgcaaatggagtttattaccttagcattcccaactgtaagggattaccttaggacaactggaaatgggacgggggaggcttgagcaacaaatctttcagcttcatatgccgccgatccttgacaggcaaaagaaaacctctattccgaggctagctttcttccttgtttggtggggctctccgcctttacctgcccgttctttccttgccaccattgtggtgccggtctcaccccctctgctgaggaatcaaagatcctcttcttcctgtgtacctctagtgactcgactcgtgtcttggaggtccaaatgttcctatttgcctttgcgtttttgcgcctctagaagcctcatcgctttttcacggtcaaagttcaagaaatagggtttctgatcagcagaaagaatgaactgtagacccgctaaacagctgcaccaagaaaaatggctctttcggcaccctcaagaatagcttgtgcgttggcccaaagaagccctgggtaaagctcgattagtacataaaaaaaggaccctccccggggcggaggaaacggcaaccctactgcattggaacatcgtctcctcaccatctccctccccatcgtctccttcttcacttccccggaactgcacatcaggattcttcaatccttctatctggcctccgtacccgtagtggagtaccttgctactttcaatattcaagtcattttcattgtttgtttttagttttgttgtggagaaagagggctacttaggaagcaaggtaactctatcaccttccgtccgtcttttcttgaacatttgacttcgcgaatcctagcttttataagggaaaaccaacatcacgtaagatgaggcctatccttcccgaaagcgtcggctagttctattctattctaacttgactgacttcctctaaaagaagagttaacacggtcgaaggtcaaagcagaaagggtttgagcttctttggcaacttagctattctttggcaacagagctattgcaatagagaaatcgagggaaataggcttaacctacagagaaagagtgtaaggaaagaatgcagaaaaagatagaaaaagtgagtgaaacaaatgaaatcagagtaagaaatctcacaaatagtaggttttaccggactagaacaaacgaattagcttgttttaactaaaaagcacagttgagcaggaacgaagtgtgaacataggcacaaaaacaacgttttggtgatcctgtgtagttgcttgctttccgcttgagctactttcactgtgaagaagaggacttcatctcttcacttacccaaggaacttggaaataacgcgtctggcttggaaagctagttagggatattcgatagaggaaggacccgtttcgagtagtgaacgcaccaagaaaagccttttattttaagccatgcttggtaacgcacatgtcctactctacctgcatcgggactggtgagagccggcgatgcacggaattttggaaacgctctacttcactaaggaagatacgtttcacttttccgatcggaattttaactctggctggttcaggttacagtcagaggaaataagaagtatggtaagatgaatgaaaggcaaaaatataggacatacgctttatcgcagaacatctatttgctttctattcgacaagaaggacaaggaaaagataatggatatggaacacaggtcctggcactattggaaaatgaagctctctcagttcaaacatatgagattacttaccccggtttctaagggcggaagaggaaagtaccaaggtgcactaggtgagaagaacttttttcgcttttttatcggaatttgactcattttagtatagaaaaacaccattctatccgacctagtaggaaaagttactattttgcattccttagggaaagtggcattttcaagggtcatttttgaaaagcatttgtcccaaccatgtgcaaaagtaaagaaaattgcttctccctcgtaaatggctccaaaatctgctccatttttgaaaacttgatagccagcatggggcaatttggtagttttttcattttgcttgtaaatcggctctttttggcatcccagttctgaactttttcatctcgcctagtggaacttgagactttttccagtatctttatccagcagcaggactttcactactttcccaagtaaagctagtgttaagagactggattgtagaagtgttgactgacttgactggaaatataatatggaaagactgatggactgactgaagtggctatttcctgattccgatatggcgtcctgaatccgatattgcttgattgtctgttgatgcccagccgaagaagtgacttgcttaacgcagcaatttctgttttcttgtgctctccacctccgcttgacactctcgtagtagatcataagagaagtattctttcaagaaattcgtatagaaagatggactagctcgagaacaagcaacggattgagcgcactagcgcgaaagcgttagcacgcgcatccgttttcttgctccttggcttcaaacaatcgattgaatctggattcctttgcttatccttcctggctatagtctctcttgtgccttcggcagttcagttaaagatttctgtatcagcagtttgtttccccatttgctcaaagaacgcataaaacctgttccctcaccgtatcaaaagatcaagcggaagagtcctcttcttcaagaagagtttttcatttcactcttccgcagcaatgcccgggcaagaaaacaatatgagcaaatccgcaaaacaatatcatagcaaacggtatgtgctggttggatagagcaatcagtagttgacgttcgaaccaatcttctctctagtagactttagattcagtcgtccgtttgttttgttttcaattgacatagagaaatcttcccactacgtaattaaggaataggtggcgaaggcccttggcggactatatataaaggaaaggggttatttttcctttacggcaataagagctgattcccttgcttgtagtttttgatcgatggagtgtatttaacatatttaagagtggttaggagagagaatcaatgtttagtagtaggcccggttcaccaggttctaccactgttcggcccaatcatagtcaaaatct

SEQ ID NO: 28338 - DNA, 69766 bp, Oryza sativa
  unsure (1)..(69766): unsure at all n locations
tgaatccttcgcgatggaaatgccctcgcctacttgactaaactaaggacctcaacggaagcttatgtagattttctacttttccattttccttcttgtttatcaatcaccaatcaagacaaaccgggcactacggtgagacgtgaaaacacccgatcccattccgacctcgatatatatgtggaatcgtcttgcgccatatgtactgaaattgttcgggagacatggtcaaagcccggggtaaggctaaaggagatttcttgaagccaacatccagccttagtggcccctctctgataaggttttaaagttttcaaaacgaaaatcaaatgatccgaaaatcgtataaaaatgtgtggttccgaatgcgctaacgcgcaacggctttcgcgctagttgctcaaaaaatcgtataaaaataaagcaatcaaaaggtgaaggcagggcagtgggcgtgggactgtaactcctttttcgttcgctgggcctgggccctttggactctaaatccaaacggagtgagtggttcgattccactttagaacgaaagcaaatgcaagtgaaacgagacgagaatcaaagatttttcagtgccgctaaaaccagatctggaaaagtgttcagtgcatcctaatctgaatctgcgaaacctttctattctaagacggctaagtcgagggcagacacaacaggtcccgaagaggttcgaaaaggcgtacatgagttcctcctacataaggggctcattggttgtcaaccaagtgagaggggtctaataaagctgaaggatgagtatagataccttcagccgagatcgcttgggaggcatagccgcctctaccaggagattctcccttatttcttaagaaagtatgaattgccatagaattcttcgaggcctgattcaagatctgaagtatgaattgaacattggtttttgcctgtcaataatatcccttaaaaagaagagagagagagactgccatcgccatctctctctctctgtcatgtcaaatcaagattgtgtgggtgttcagtatcacaatccctgtattctaggttctagctggttagagcagaggactcgaaatcctctttagctttgcgcgttggactctaaatcctaacagagtggttcgattccacctcagaacgaccttcacgaaagtgaaaaatcttcgtcctaccaaaaccggatcttgaaaagtgttcagtgcccaacacatcggtgaaaccggggagagctgaagagaagggaaaccccagaggcattgatcatttggtacagccgctaattcggcatttggtactgccaccatttctcgaaagggaaaaaacatacttaacaattcgattgggaggaccaagggatagatcgattgcaatatcagtatcatacaaatagaaatagacatgagtacatgaataaggaaacgcaaaagacacagagtaggggtagtcagaagcgtcaatgcagacgccaatgggtaatcagatccattccacttcttcagatagcagtcgatcctggatcgtcctcgcttccaaactccgtaaatgaatgaaactccttccccggtccattgctcgggtgtgatacaaatacttctttgaagttgtaggatgcgggtcatcgatcttcctatcggtccagaggttatgcgccagcttgggaaagaaaaagtaagatttgtttgtcatatcacgatcggaacttagatgtaactcttcttgagtagggggaaaaggacacctatcacgcggtcatgccttgaacgcagtaaagaaattaataagcttcgaataatagctacgctagtctccaatagcgtcttaagcgttggttttctttgcgggcatcgtaatggattggtggttcgttgcctctatttnnnnnnnnnnnnnnnnnnnnnnnnnnaatcttctctctcggttactcagtggagtgatctctctcttaaattcccataaggataaggaaaagtagacggttcgaaacccgtgcttaaatcctactcaaggcccactacgggtagcgagcaattaacaaatagagacaaggatgaggagaaatgacgcatatacggccggcctgggtcactcatgatgttggtagttcaagtgaattgtcgtagtgtaaggaagattgattggttttctgattgctacttggctggcataagaaagaaggcgccccggcaggaattctgtaagcttgacttgcgcgcagcgtttgggaatcaaagataaaaaataactctatgggacttacggaactggaaagaaggtagcacctaggcgtaagaaagaaagtaaatagagacagcacctactacgctatctattgaagcttactatataatatataaaagaaaaaaaaggccatataagtgagatcctagccagagaagagcaacaggagctataaaaaaggaacttatggacttgaatcagagattgggttgacatccgaaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaacagaggtcaggagctgccggcagggcgctgcttttaatctgactgatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttcctaccatccatatatagggaatccataccgtcggcttgtcgatccgggatcgcccaggatcgggtggaaggtcggagaagccagtcttcagtggtgcttccatggcagttggatagtagatcagagaggcaggccagtagaatatggagttgtttttgttctcttgttattcttttatggctataagtctttctgtcttggattcgtaatgtttggccattaggtttgaattgccttctctttctgtcttccatttgaattctgtgacttatcctgcaatttggagagtagttgatatggtctttcttggctttggctttcaaagtgcagttcgaaaagagtgagttgctgtcaatggcgggaatgaaatatataaggatagggtggaaaagagtgctccatatccatatatgtgcttggagggaaggccacatctttaattgtattctttttcgaggtcatcctcttcagcctgtgttagtagtgctagttttgagtttctttttagtaccttccctacttaggggttctatagaaaggcttagaggatcctaaagtgtcagtttatgttggaattgctttgctcttttctttctttgatgcttggaaggaaggcctataaccaatcaatagtaaacatccctcacccaactaccagtctgtttagagaaatgaagaagcgacttgggttgatttagacaatgttatgtatcgagaaactcaaggccactcttcctccgggctcgaccaatcaataatagaacaactcaccaacacaagcaagttgaacgagtagatcaatccatctgcctacccgcttaatcagcgtagcaggcatgcccacgggaggcaccctccaaatcactaaaagcagcactataccaccacaagtagagaatcccaatgcgcttttcactaggaagacgaggatgctattctttaaagaaccgagcttgacaagcatttcccatccatctttccccttcttgatgagcgcaccacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgcagctaaatcgataggaataggatttctcaaaggaaagggcgggtggacatacgttgcgggtgtccagttggcatgggtctgggttccgctcatcaactcgaacggtcaatgctggccagatacctgcatcgttatacgtcacaagttggggtggttgaacaggaaaaacaacaaggcaggcgataggcacacacacctatgagaaacaattccacaggaattgggcagaactattagttcaatataaggaatttcatatcaccatgggacttactagtaaaaagcgaatatcaattcatgacagcgatggccgcttagttggtactaaaccccatcatattgggggagatgagttcaaaaactttggccatacggcccatcgagctttaagcagtgttttagatgaaaacgaggtactattgagagaattgtcgagcttggctgatcataacactcccaaaagtagtggaaatgacactaaccctagcccgaaggaaccgtagaaaaataaactacgataagtatcgagagtagaagtcgagaacaactgtgtggagtagaagctgggatagaaagggttggaattctcagcgatcagtggttgatctgatcagtgaacttttggtgagttcattggtatcgggtggtccgtttcatcctctttcggcaaaggaagttggactttagttagctaaaaaaacagtaccagcagcctgtctgtgccctttgagtctatagccgccaaatctaaagattccttaagttttcgtacggcttcttttgtcaatgatcggtgacaatgaatgctacgaatgttcgcttccactaatgtcgtctaagaattgtgaggtgcccatagcttcccggaagaagaagagtcattgtcgtttcctgaccgatatgaatgcacatatttaccctcgcctcggggaataccaccagtagagtctgcagaaggtgtcgttcaggagagatgctgggctctagatatgcgagtgagatacccaccctcggtcatgacctgggttgaagaaggaatctatgttcttggaagcaaagaaagaactccggtattccgaccttagatttttgctctgtaggggctaccctatgggctgttatctcaaggtcctggttaggctcttcttgttgtctcttagaggctaaaaagaattgtctcttgtgggagtgcccgataaggatgaagagacctggttatttgaaggtacctttctaaaagaatagtgaaaaggttacctagcctatgatcctccatatcctccagagattgactacgagtcatacccagcgggatacatattgaccaaatttcacctaaatgaaaatcctcttacttaacccagcatcctatctatgatcaatatctatctcaagtgttcagtcaaagaggagagtgagagagttttctctttttctgaggaagccgccgccccgccgggcaaaggttgttgtccctcgcctctggcttgaagattggcatttttggccttctctttgacagccatttctttgtcacgcttcgacgcatcctttggtaaagaattcaatcctctgccctccctctctataggatcttgtacacatatgccatcgcatccgcactttaagttaagaagcatagtgctgactttacagaaagcaaagcggcgtaaggaagtaaactaatttgccagctcacagacctactatcttatctgataaaatatataaggagaactccggggtttgatgtgaaaacaaaccgtgtcaggatgaaagttttgaagtcaagtgttcggacgaataagagttggatattacctgcttcatgcttcagtaccaaatgaaaaacagccttcccagcgagtgccaatgtagtaagtttagcctctaacgccagttcaactacaattcgagaactcgcagcagctccttcaaagtcagatattccacttgctaaactcactcgtgtaatgacttcgattccattaattggaactattcaaacagcgtgaagctataaagggggttagggaacttgacaaggaagatggagatattgatgaaatgttgataaatggacctcgctttcttgttgctgagagatcttgcacgcatacagagaaatggacgcggagaaaaatatttatttagtaatatttattatatattactgatggtgtggattgaaaatccatggataaaatatatttaaaacaaagaaattctggaattgtcacacagaagctatgacaaaatagcttgagagccctattcacatgaactttgactcgtcattcaacactgcatgtagactgaattcttcaccatatacaaatggagaagagacaatagggttacttatctcttatttacgtagatttacaccacattccgtgtagatttacctttagtatctatgtgcgtagcggcacaagtagagagaaatccgccccatccgtgcattattttcatctcaattgtgtatttatgggcataaagtgcaaaaaatgcccataagtgaagtaagatcttgtgttgtccagccagaagccacttttatggtgagcactatcctaagcagctgggaaaccgctgaccaccctatgtatgcttaccctttcactacccagacatacctgcttattatgcaatgtcaggaagtgaattcagtctatctgcttacacttcaattgggtgtgcgcagtaagccgaccctgatgtaaaacgacatgattttcgatatgattgggatcagtcttccgtactctagagttgttataggttcataaatattcggtgaattaggcatgcaactccccttacgaatgaagctcatatccgatggcggagaggctcgtcggtgcaatacggagtgaaggaagaacgaaggggatgaggacaataaatacgaaagacatgtgttactaggtatggagagaaggggcagctaattccatttcaagaagaaagaagagaaggaggagctactgagacggtcaagctgaaaagtgatctcgctttacccgatccccaagcactgacattgatagaagtctggtttgcagcatcggccaaacagctgactcttctttttcggataagattttccaactattcattcatagcggacgaccctcctcgggtttgttattttccttccaagcctccggtgtgctatctaccaacgaaacgcagaatagaagatcctggaaacccaggaagagcgaattcacttttcagaaatatgttcatttgaaagtgaacacggaaaataggattggggctataaattgctctctttatgaaagacctccatctgtttacttttgtggttggttactagcgatattatgagcatttatctcattctcctgagtagactacttttcttctatatctaatccttttaagaagtaatcgaacgggtggggaaagaccatcaagttcttcgatatgatatggttttttataaacccacaaggaagtatttggatcttttaaggccaatctttttcttgcccttgtgcttagcggtggtgccaggcatcggttggctattaaggattaagcttcgacccgacacatctactgcacgatcctttggagccgggggctggataaaacacagaactaaatcgacttccttaccagcatgtctgggattcctgtggttcttactgccccggtgaatgtgtaggtacgaatgactatcaaagaaagtgagacctataggttggattttactccctagtcgtatcttttagcaggttcgctttggtcttctttgttgccgtagaccagattgagctacgattgggttctcattctcccacgtgtcgctctagcacatgctgtatggacgcatgctacggcggataatccgcacaatgagattctacttttatggattccactttggggaagggtccaatctccggctactaaaaaggtttatgtcccatgggaaaagtttaggcttgtcttacctctctgctgcgttcggactcccgctacatagtacttctgacaccggagaagatgtaagattgatccatcttttgaacttcagaggtgaaaaacgacttccagttcacgagctccttcaatcgatagagaatccgtatcggttgtcgatatcagttatagatggttgccgttcgggggtgcttaggaccagaggtacttgcatgcagaccggagaggaggaggaaaacttagaatgtcgtcttttgcgacataaccagggccctcttgcccaaattgaaacgttaaatccacgatgcgatgtccatctttttcatttcataatttcctggaaaaaaagaattaactaatgaatcaaacttatctttatggaagattcgggaatatctacacgagtactcattttgcaaacatagcagaaaatcttctaaagaaatggacatattgattttatccatttttgctcttggggcgttgaacatgataaaggtggaatgtcagagcaattcaaattatgtatgtaaggcccgttgaagtccccgagaaagagtctaaatagggctataagtaggccgtttgctattgcaataagggctgctcgcctttccttttgacggcttggcttcctatcgctcctatgtagtggtcggccttaaaagtatctttggaccctaccataccatcatgcatgcctatgttatagtgcgttaagcttcgccagaagcaagcaagatgatgaagcgaagcttcgtagacaaggctcgttccgtgcttgacttacgagctcgtgtagtaaggcctcgccctacttcaataagggcttcttatgcactccacccgtaaacgagcgttagagctttttgagcgagcgagcgaagccttcctggagcttcccccttccctcacccgagaattgcatttccgcttcagcttccccggtttagttggtttggaggattaattgattggatacccaatccgcataatctttcaaagtcaccgcttctacgacgataggcgtaaaggcatgattagttccacaaatctcactgcactgaccatagtaaactccttctcgttgtaccgagatggaggtaagatttgaacgaccaggtacagcatcacatttgacacctgaggaaggtacagcccaactatgaggtacatcagcgggtgttacaatcatacgtagatgagttttggctggtacaaccactctattgtcaacttctaataaacgtgattgacccaattctggatcatcttctggaatcgtataactgtcaaaagtgagtgactgttcatcggaactgttatagtccgaatactcataaggttgggtcgacgcccgcctccccccaaactttacttgcaagtttccccgcaaaaagctctccacgcctactcttatttataaagagcactattcttctttagttaggtagttctcccccctctatgagaccgtaagaccccggtggaatcgaaggcccgcttactaataggcaagaggggaccctttctcgcccagccctacctacatcagtgaagctggaaccgaggaagacaatgttcaacacacatgagacaaaatgaaggtatgggacggccagttcaccacggaaagcgaattcgatcctttagtagtcttctttgttcgaaaaatgcgcagtggaaagggatgctagtcggctttggcgaagttgtaggccccaatagatcagatcaagagtgattcctcacctatcctgtcaggggccaagtcgaaggctcgagtatagattccctatgctcatgtgaacggccggcctgtagatctaaaaggatccataggcccgaccggaaagtatgtttgtccacgaaaaaaagtcattcatgagacctcgaattcccacgttccagcctgcattatgccagcaggtcccacccccaatttcttgagtcacccttatctaaaaaaaaaaggacggagtctatctagatcataggatcactgtattcagaggtcaattctctttctttgacctcccaccgttcacgacatcccttgcttctcgcaagaacggctcctcggtggaggagtagaagcgctggtccccttcggtcaagtgcttgtgcgtgctcttacctaccgtaggacctccgtccccgaagcgaagaaggaggagcaggaacaacaggttgtcctctcttggcccagtagttccgcaactactaccgtggttgttgccaacggggatcccccattccgaaaggtaacggggccggcccttaggtccaaagttgtatgccactgctgtggtgccgatagattcactactaaagccccgttatcggacattgcaggcttagcatctatttttcgtatatcgctccaccacaccgagaagaggtatgtgtacctccagcaataacaagaatggaaccataggctcctatgctgggagcatttcggggtataggtctaaccacctcaactctccgtttctggcatgctatagttcttttagtctctcgacgacgggaatgggagatgaccggtaagccagatgcttcgcgaaccaccggtacatcgcgaactgagacgtcatacgcagagactgatatggccggtaatagacaacaatgagaataagacgtaagagagagaacggaaagaatgagccgcccccaccgttcacattattcaccgctcgttacatgtcttgaacttcctcattcgaagcctgaacctataggttcgttccatgtcttccactctatacaccactccaggccgccaaggttttacttttcacattatttattatagggaggccttgtgggatctttcaattggtgtactgctactaccttaattcaacaaagaagcccattgcaaccaaaaatacatcggtgcacgagcttttttcatttcgaatagagcttcgtgagatgagagaaatcgaagttgaacaagcgtatcacgtagccacagatgatcttgtctctgccacatatcctttcttggaacaaggcgcctcttctaactcagtcggctagcgtgcctgggagggaggcaaagtcgtacccgaagaaagtctattgaagaaacttgggaagtttgccgttggacactaacgggaaacgcaaaacaactctagatacttgaatgtgaagaccaaaaatgccgaacatgcattcttttctcggttgcggtgtacttggagtgaaaagagggaagaagccggaagaagaagcccccgaagagatagatggaaagctgtgcatgagatgtgctttctaaagattgttgggtatgtcttgatgagggggttaaccaaggatgtcaatcacaggtttttggggtggaaaaagtgaggaagtgtgtggggcggcggcacctcctgatgagcaaggaaggctctctactggactggaaaagttgttgacacctagtagcgaagaacgaaaacatagtagattttttcccttacaccttcacctatgcactattctctactgttttaagcatatgtgcttgggtaacttgctataagaattctttcaagacttgaagcctattttctctttaggcccagaaagaagatttcttttctttgctaattcctctcaatgaaatttgccatgttgcactaagttacttacggatgtatgcatgcaatccgggaacactttggggtgaacacccatccgaacaagtagggtcaatagttcagcatttaggccgtaacatttagcaaaaaactaatcttaaacccaacaagtgctctccgaaccaagctagatagtctcctatcactaggctcaccaaccaacctggacttagattctttcttattattctaaccggatatcaaaatcataaggattgtttccagccaagagttcccatatgacataagcgctcttgggtggggtgggccctcattcgccaggtctttgagtgcccgtcgtaccacgtggttggtacactaggctgatagagactttactttaaggatctggcacctgcgcccgactcggtctgccagtgaattttggctctacgtccggtcgggtatgttcgcattcgtacaaatggaaggcatcgcgtacgttaaccttcctttattgggctgggccattccatctttgagaaggggcccaatctcgtatttgatggtcggcgtggcaataggcttcgcttcgtagactggtttcccagccgttgcaaagacttcgcgagaacggtcaggggcgcggattcgccaagctagggcaaacaaagccgtccggccctaccagattaagaatgcgaaggcctttccttcgaaaggagaaaaaaaatagctatgctattgaccgaccctttcgtatttacttcgaatcaataggcctatcatttttcatgaggcgggccaaatagagaatgaaatgcaaaaaataggggaaggggggatggtcgcgcctttgattttgtttaagggctgctcgcctgactaaagtaccaaaggctttcacggcttccacccctaccttagaatctaagccctttgaagcgccagtagttgtagctgtgggtaaggttttcgttcaactcgctccgggttccgatctatatgacccccagacaatacaaagtacacctcttccgtagaggcaagctggtagtaacctaaccttttagagtcgggggagccgagcccttaactctatcaatagaaaaatcttcgtgcgtggcgtgagttggaatcctagaaaagatcgattgagactccctccccggttccacgaagatctctacgtacttgtctagtccaggacaactgggatcttccggtctgcgtgcgtgggagcagctgaaacaaagaagagtctggtccgctcttcattcaagcccggcccgcccatctgctgctaggtccgagaatggcgccaggcgagggtgccgctatgccccgcagctctgctgcggccggcccccagactatgcaaaagaatcgaggccgggggatgtcgtccatcagggcccccgccttacaaatgggccgtcccccttaatgaatcgaatggtccttcgaccctcgtttgattccgacggccggcatagatgaaatcccatgagacccgcccactattactacaaaaaagccctgcccctggcaccttcgctagacggagagtaagcgacttctattagcaccggaccgtcgagtcgaattgatcgtgtcatgtgcaacgtccatcaatggtggttcattaatgtccatagatttagactccttcccccctcccttatacgcaaaagatcgagaggggcccaaaccaaaccgagaacgtaaacagaattcgactcactctcgtatggctcgccctcgagccctgggcgagtcggccgggtctttccctcttgttctgtttccgccacgataaagacgcacggaagaactatggtatgcccagcgcagcgcgtggaggatccgttgagagtgtcccttgtctcggtagggaacagtacctattgtcttgaaaaaaagtcagtgctacggtcccctattgtttgatccaatattgaccggtgcggatcacgttctactacctccggtccgtggttcgacctcccgtagtggtccttgcttttctttttgaaagctccgtggggccaatttttcgtacttgctcagtgtgcccccctttcgtcgagtgccccgcccggttcacagggctgttggcctaccaagcaagcacttgcccgcagctcctgccgcctgccaagcgggctccgcgctcgttatcctgactgttctctctgctgggccctttcctattgctctaaccataagctatggcaattccagctcgcacccactctggcccgctcagcgaggcctgagtgagctcagtggtcagcccctgacgttaggggtctttcgcttttgccagatctatagagatattacgagtcctccgtcccagattccctcgccgcggccatctggttcaccggtactaccaaaaagtctcatgcttacgttactgtgactgatatataagtatgatcccggactacgaagacccagtcgtgcttctggtttccattctcatcatcatattgaaggaaactcctcgtgctctgccataagaacttggagtccgtatcatggtgaaggtaaggtaacgctgtgattcttgctcaaaaaactgaccgaacacgttcgagttattggctcgtccgacccggacgcattcatgagtcgctcgttcaactgtccctcggagacacggtcgagaagtgccatgcatggtcgcccccccccatcctttctttctctcggtcccaccagggcgggcccctctggggtaataaaaaatggataaaaaaaggggacttctgctacgggctatgccacccattacttatgagggaagtcgcatccgtcccatcgcaagcacctacaatgtcatgatcacattggtttacccttttttggtagttcaacggacggtcgcccctccaacaagaaaaggtagaaatatggaaacttctctgccatttagatcggagaatttatagaggaaatcgggttttaaatttccagaaaccacacgattatatagccaaagggaatacgccgcgcctaaaatcatcccaagcgctgctaatgtggctactaagctatttctttggaaagctcctactaagattagaaattccccaataaagctgctagtgccgggtaaactcatattggctaaagtgaaaaagaagaaaatggtagagaaattcggcatggtgctcactaaacctccataatatctaacaagtcgagtcttatgtcggtcatatagaacaccaacacatagaaaaagggctgaagaaaccagtccatgacttaacataagtaaaatgctacccccaattccctgtatgttcgatagagcctaatattcccccagagtacgccgcttaccctccgaaccgtacaagatagttaccacctatcatacggctttctaactccacttcttttctggtcgttccgctctgtcggatcgatggtagtctcagagatctggtaacctccgacattttttacaacacgcttcctgcttccgttttgagttgcgcatctttccccccggggcatactatactatagtatcacatcgtagacctccaccccaactctatcttccttatcagtgaaccggaacatagtgcataggtactcttcgatgctgcgaggacgagacgaggtgacatactacgatcacgcactgaagttctgcccttcggctcggcatatggaacctctcaactgctccctcgggataggtaggcccatcccccacccccctttcccgagaggcggccgggctgtgtttccccagcggccacccagtggcggcagaaaacgaaaaagggtgggctccgcgcggttcgcgttttattgtaaagagagagcttttcattctcttatagaagcccgcgtccacgcgggtaaagcccagcgaagctgcagggagcactgagcaatggggggatgagggcgactccgcccacgggttggaccacaccacaggcaaaagtccttccacggcaagagaagggtgaccggaacaagaaaagggagctagtcgttggagggaagacaaggctcgttccgtgcgactccacagaagagtacgcgcgctagaaaaggcagccagcttaaaaacgctagctactttttttttagccttatttagtttggttgcctacgcttgctccccggcgcgctacggcaacaccccctgcttgcttctttctgttcgacgcggagctcgcagcctccccacccttgcttagcgttccacttgtgatcctggaggatttggagaaatgcgcccgaccatgaagaatggattttttcttatctttcatgtgaacggccctatcttgtaaagaatggtttttcgtgctatagaccacgttgagaaagaccaaccaacaacacaaataaagcccgttccatttgggtacctcgaaagggaggtgctctttatgatgctacggacgactgtccgaagtgcatgcaatgacgggctcggataggataggattgtgcgcgccgggcccttcgggtgtccatattttggccgaccttagcgtaggcccctatgttatgcggccgtaatatttttataacttccaccgctgttacgccagaaatccaaggttccacacgagctcctgttctgcggcgtggtggcaggaccgctaggggattggctccgggtgtaggtagggtcaaatccgcaggggtcatgcaaatacataggccccttcccttctgccgagttgtttagaaggcgctttccgttctacggtccctcggagcgaagggttaggcaggtagtacgggccctctgacttccagctatgtgctgtgtgcgactcccgcgaagcgaatgaagggaagctcttcgagctttctccgcctgcggcttatgtagtggtcggcattcctacgtgctccgactgatccccacaggagattatgtgaggggtcttggaaactgtcgtgacgctttggtgacgaaggtcaccggggtgactatggaaggattccgtggtagtctctgactccctccaactcaatcaatatcaagaacatgtcgtgagcatgggggtttggccgactactaaactatactattggctagggctaggctagttatagcttctatagtgagtggcccttccgctttgatctagttgtagtttgtattgtactaaattgaacacatatcaaagaaaggcgatcaatcaataagtagttgcccttctccggcctgggaaaagcagcgaactcgttaaactaggggcttttttattcatggctgttgtattgtatattgtcgggggaagctactgcttctacgacagctccgcttcctcgtcttgcttctactttgcttgtttgcgcgaaggcttagagtcgttttcgctaggtccaaattcgtcaaagcgaaagatcagatccaacggaaatcccgcatattgagcgcagctgatatgtggctactaggcgcgatcatctcacatgccataaaaaaatacttcttttttttatggcccgtcatataaagatagaatagatatggatagagagacattctattgaatcgcgaaatggctcgtcgatccaaatgaatcattcttctggtctctctctgccccccgccccaaaactgacccacgacactgcgcccattcgtttcgcgcgcgggaaggcaacgaagttctgttcaaaagaccgcagcggagtggagcagccgcgacacgaagttccttaccttagctggatctcgctggtgccacctaaacggtaggtataggcggcggatgtctgacgtttggagttgttgttcgtgcacctgtccccaatagaagaatgagtgatcccttcccctgcgctgcggatcatggccttaccactaggtccccgatggccagcgggggatattcggtaaagcagctcacgttcgtttgcgctgcgcgttcccgctggaccggacacgtgttagctgtaggaagtatggttacgaaagtgacttcggttcgccagttcaggctcaactcctcgctttacgttagcggacttacaggtcgggccggggctccacgctctttctttctgtgtgggacgatgccggggaatgtgtcgaggcggcgaacaacaacaagacaactaactacatttgctttttccccccatgagatgcgccagtgcattggaccgatggataatagaactgagctggccaaaaaagcgcttgggcgctctacatacgatgtagactccatcagatacatatcgatttctttctgatggatccagaatagatagatatcttgtatcatcaatagatagaaagaggtcaacccttattattgatagattccctttcgatctatcagaacagatcaggccatctatatcaatcgatttaaaaggttcatctcgcttttcggtcatttcagccacgctataatagccgccacaataagaaagaagcaagcgaaacagctagaagcgctcgcttcgccgcgcccaacaattcttattcacgggaaccgaaagattcgattcggacttcgtagagccggtgctgctgctgtctgcgtagggccgtcccccactcccgccccggggcgctaaggggttttgttttaggaacagacggcggtgttttgctgacgcctcgaatcgacgcttttgttgcgacatgctaagttttcccccctattgctagtaggttgatgggtcgcacgcccggcacacatgttttggccttgcttgtgtgtccataactcaaaataggtgacctaacggccgccgcccgactaaacataccaatagtcaccaaattcatatgggctactgaggagtaggcaatgatcttcttaagatcgatctgtcttaaagtggtcaaggaagtatatattatagcaatcgcgcttagagtataaatgaaaggagtgaaacaaagtgtcgcttcgggaaacatgggtattgaaaatcttaaaaacccgtaggttcccaattttaaaagaattcctgccaagatgacggatccagccgtaggtgcctctacatgggcttcgggtaaccaaatatgaactggtaccataggcactttgacggcaaaagaggcgaaaaaagcaatccatagaaggatttggcgccgctcactaaattctgtggttaataaaatttgtaaatcggtggttcctgtttggagaagaatcaacagaatagctaatagcataaaaacggatcccagtaaagtatataggaaaaactgatatgctgccttgatctttctttgtctcgaaccccatacccctataatgatggtagagtcaggggtggccccaaagcggaattgaccggtggtggttggtcgaagctccagtgggtagccactcccttctcagggaaccgtacgtgagacttccgcatcatacggctccgtcccgagcttccgtcgtcggcccttgtcattagaccactatgcttgtcttttccgccttgactctcgaatcttttgcttctcgggtggtggcgaaccatgctgcttgcgtagcgggagatgcccgcccgtcgggcccggcctgcttcctgcccgaaagaaggctagcaggactagtggtagggccgtcaaaaaccctacctttcgaacccgcccgttcgttatatctaacgatagagagatccgtgaaagtcattgccttatgttatggtcgccccccgactgacggcctttacgcaactacgactactgtgatgtgagcggttctattggtttgatctttccggcctccacttgtacgaagatgcatgcataaagggacccgcccctttatttatctttattttctttattaggacaggaccctaccctattctcgaaccctccgccgagctctaccctgcccgcatttatttggaagggggccaaagaaatgtctccacctgctgccaacagtctttcttcggaattctactgaacgggtcgatcctccccccccccccccccgtttgttttagcaacttatcctaaggtctcttcgccaagaactctccggcaacgacagaggaactaacctgcctgctgtggcggggcggcttttttttaaacaataagacctggacgattatccctaccctcggtagcttacgagtttacgtccatccctggtcgggtacagtttcctttatttttatcccttgtagccattacccgaattcgcgcaagtgtgtccacaccccccccctgacttgacgaggaatccattctcgcgaacaaacacaccccctacacacacctaggagcaccccttcctgcatatccatacaagacctgagtaggcgggtcgaggtcctacgaggtacccactactcggagtaccctcccaccaaaaaaagatgtgtggttcggtggttcgaccagaaatgctatgcttacgcacaagactacccctcttcccgaaagcttcgcggggacctttactactttacgacgacgggggaccgcccgtagggggtttactgcacaaggcccctgcagaggaaaagcttgatcccagcgaatagaagatgctcagctccgcacaacatagggattggcacgctttcggaaagaacatagaatagtagaggatccagcatgcaggacacggcgatcattagaaattcacgaattagaaatgctgtaatatactctttcccaaaacttctcataccagaccaacccactgaaatgcaaatagggatcagaaatgtggtcaatatcacgaagaataatgaaagaccgtctatacccatatacaaatggatgttttcataaggaagccatcgaaggctttccacaaattgagatttggccgtagaaggatcgaattgtatccgaggaacaaggggatacaaaaaagtaataagagaaacgcacagaccaatcaatcgtatcagtcttattgaagaatttggaatgaaaagaagagtaatgcttcctagcacgggacagagaataggaccacttagatcgaaatagcattcacagaaatgttctaacatagagtagaatcgaacattgaaaagattagttgacaacagtcaatcaaaaaaaagatggggcgccaaattactaaacaataggggtctttctgtgcaagtcagctgaacaccgtaattgatgagtgagtaggtgggttaggcgcacccctcgcccagtgggaagtcatgaggctagcccccctgaatgaagaagtagtggggccccctgcccgcccacgtatgcgcctttatttagattctaactaaatattatactgaactttatccgggaatctttctaaagaatccatctggcaaaacgcaatttgtcgatttcaatctaaggtgcaccttgcctttttcaggtagctttgttacgcctattcagctaggtggggcattggtcatagccgaagtcgaagggcaaaaataaggtaatgagatgatggtgccatcaagaagttttcgacgaacgtagtagcggccaaaaatgaaactcttgcatgaaagaccggacgcaagatgaatggcgttggggtttttcaaatgaaacccgtgatcagaaagtcaccaacggagccatacaatctatctagtagtgtgccatagcacggtataatggtcaacgactttgatttgttcgtaccattctgtcatcgatcactgctgggtcggttggtgagtcacccaaaaaaagcatagaaaaaggtcaagcaaaatgatcagcggtctcatttatgctatgccctgcatcgtgttcgtgtgtgtttttgagctttcttaactttcagcgccatgcgctttgctccgctttatagcatagagagaccgaccgttgtcttgagagtgaaaagcaagcgatagaaaagatagtccctcgcgcgaactactatggtgagatcattagtgaaaaaaggaccaacgacaatcaaatcctaaaagagaaggaggagtcagttttctttaaagatcgaggtgtcaataggacaggacaattatgccattcggaagaagtcttatacagagggaaagcctgttacgagtaagtggagaggaaagatctccagagattcttatccagtggctcgaccagtaaccaaggtcgaaaactcgaccatggtttcccggtagaaccccatttcgcccaagttgttgcggaaccggaaaaagaagcggtttttcgcgcagcttgctcattgtgctggtcccacttttctatttatttggccgaaaaagcatcggacaggttggagttccaaccttcttgggactccatggaccaagatctgctttcattatatgggcaataccaatctactaaagtagatcatatggatgtagaaaaagctttagattttgtgatgaattggaaacatctcttttccatttctatttacctagttcatatttttgtttcgtgtgttctcgggaggaattctatctctaaagaaaaagttttggaagatttttttaacctcagcctagcggattctccccgttacctggacctgcctcccccgcggtcaaaactctcctctccagcccctctggctgggccagaagcctcgtctcctttaactgattcaagtgattcagtcaaaatgaaagtaatctcacagaaaattggattatctaaaacctcgtaaaaatgacaacgctaaatcgaaagtcctttatttatatacaacacacacatattcctttcaacttacgaacatgaaaatccagtggatggtttggaaggttggaagagtgaagaaaggttctttacccccggagaccggctttcgtgaaagcacctttgggcgatggtttctcgatcctctctctcacttgaaggaagatagccactatataaatagatatatatatatccatttatttattccaaattttcagtgattttttaggtggcgactctaaacccctttttcttctacttggttgcttaggtggccaaagtaatgatgatgtggcaagcggtgccaaaatgcgggcgtacagcaggcgactccacaggggaataaaagccttaaatcaaaggtttttggcttataaatataaatggcttgacttgaaaattcaccaacattcccatttctttcctttgtgaaaaatgtagtttgtataaactaagggttaacctatttgcaataagcacacaccacctcactacacctaagcattgcatgcatatgcgtcttgcatatctggaattgtccccaaataggaaaacctggtgggaagtcttggttggcatggtccagggggccgagtcatactatccccaaaaacccaccacctgctgtcaagtactcctcttaggagggtataccaaagtgggggtgcatagtaccgcttgaccagtccgacgtcctagagatgaagggctgggaggtatattttaaagccctcattgttgtgggaaccttaacttgtcttactatagcctaaattccatcatgtagtggccatagaactactgaagtttaggactacccagtaggatgcacctgagcactaagcaacactaagaggtgatttggtttttgtttttccttggcatgggaaaagatggattagatgctctgtgaatgtgtggctaaacctgtggggctgtatggtactttagctggactttacaccagctctattcactgatagcgttactggctcttttccagcatttcttgaaagcagctcgcactcaccgctgcgcgcctagttaggcttttcaataataggaacaaagatcttccgcaatcaatgttgtactcaaatcctctctggccggagagggggatctcttaagcagagtattccgagtctagggctagcggaagcgttgaagagggatatcgttttcaaagaaggcatggggtcctttcgtctttgtagagactttcacaatataccagtggataataccatccaagagagaaggcccataaaaagaagcaggcaacaaaacatcttgatttataggaatcaacgacctcgccactgcaaaggaggaagtcgaatgatttggattcggacaggctgtctcgacagtaagaaatcgacatcatcatctgtctttcatgatggtgggaggcaagatttcgtggtcaagcacaaaccaagcataagtggatagcaacttatactatggaggcagagtctcctcccctcatttctgggctgcttattcgtcatcacggagcaacccggtaccttttcttaggcgagcgactgagacgagagctttcaattatgccgttttggtcaaatcccagggctctttctgatttgattaaatacttctatcatttagatagagagtgatctttccttcttgtccgagaaggcaacaaccatttcatttctttaacccggattgcattatttaattgatttactacgtcgtgtactacgtattggttcgcgaatgcgttgcttgaaggaaggaagcagctttagaggagggatgccgtcaaaggggtctgccggatttgggctttgctaaagataccggttcaatatgtcatttccgaaaccgaggagcacaccgctgggaggacaactcaagcaccaaagacaaaggtatcgctcgtaaaaggagcttgcatcgtagtactcgctctagcgttaggttcaatccagcgttaggtaggataggcaggtattctagggatatgctcatccgctgcccgcgtaaggttcgtatctgtccaaggacaatggtataaggttcgcatcttcccaaagccgaagaacttctttgaactacagccaaggcaaatctctagtattggtaccgggggccggtgtctagggataggagccgtcaaagggctagtcatcgctagaaaatccgaaacaaggctatcgctatcccggggcgtagcataataggaatcgggtaattcgctcgtcatttcatatctctactcaattggctaggttgcctccgaggagccgttgattgccgttaccgagcccctctttttctttctttcaagagctacaccgcaagctcgtctcgcaagtcgacgcatctagcaatgcctctgaaatccaggtacttaccatctgcaaaggacctgttacgcgctgcttgtgctaagtcacccaatcgttccccacaacattctcaatggcaactgctcaggcaccgtgggaatagctcagaaggaggtgataagcattataaaattgatacgaaggatatccgtagaaatctttctattcgtagtagtctaggacccgggctttggggatgaggattcgtattcctatttctttctttggattgagcgacaaaaacaagagtgagaatgcaggattgaagttcagtacttgcttactagctttctacttggcagggacaggggttcgtggtagacttacttgtctatgcaggcgtgaaacaatcttcctttcctctggactttatcatcattatatacttgctttaccacttgaattagatcttctttttaatacctaactactattaaattcctttcatgcctttattcacaatacaataattcaaatctcaatcatgtgctttgccgaggagagcgctcgctacccgatccccctaagctaatgtagttcccaggttgcctactagataccgtttacgactatatccgtgtaggaagccgaggaaagagataattgatagttgccaaaaccacgtaaaagaaatgagattgaaatatgttcaattcaacaaattctgattgtttcattatcaaatgcaagggatgtgggaccaggttctgttattggagttaagcggtgtaggagccgtgccgttcctgtgtattagctcgttgttagcagccctgaagggcgtaaagggggtaaaagaagataaatatttctcggaagcagctcttcgcctgtgggaacttgctcttttcttttgtttgaaaatggattggattgtagcaaagacccgttttgagcccttggaaagggtattatgggttgagtaatagtgttagtatatttcccttgcccgaggacagtctatcgatgaacggatactaggaatcgtaggaatagctccccttttcgtaggaatagctctagcgctcgctacgccctcaccttttcaatcccatgttgatgtagagtatacttcaattgcttcgaacaagagctaggtgatcatcgacagcttgggcgttgctggataataggataggggattcaatgaaaaggatgaaatgaagagtatacccacgtcaacttctgctcctaacgtatacgaatggttcttatgctcgccaagggaagggggccgaacccatatccgttacccgaaaccaggagttaaaaaactagggatgcgggaagccattggaaaaagatatgcgaatccgctggttaaaccctttcttcaaccccttggtatgatacctcctttccctttgctttgctaaaagatacccgttccgctgttccattggtgctgtgccttgtaggagccgtcatcttcttctttgcttcggaaaagtcatctgatttatttgcttcggggataggaatgtgcacttttgttcatgtgcacatcaacacaatccgggatgaatcaaaggcatggaaagggaagagatagccctacccttcagtgaaccactcaaggtcaacctacgcctgatatccgcggttattatacgatgcagttcgtggattggcaaaacctggatgatcaaagcatctatctatggttgggggcttcaagatcgtcataacatgtcacagtagagtcatctagcttataatgggaggctgaaagcgaggggaaaccctttctcatgtgggtattagcaaggtataagacaaagagagtcgttagtgggataggtttttcttgtaggagagagatcgggaatccagacaacagggctagggtttggggctagtgcggattagtttgggcggaaagaattgaagagaggagaaagccatgaccgatagagctcgggttggatagggaaaggaagaaaaaggggtagggtcaacctaaggatttaaaacctgagcttaggctgacgactgcttcgagagcagatagaggatcctcttctgggcatgaatctggttttcaaaaagaaaaaacctttttactaaaccagatcgacgagcaatgaatctaatcgcagaacgagcaatgaatccccaacgaacgccaaacgaacaaaggctcctcttcttttccggtgtatccttcgcccaaaagttcttaagtaaatttagaaaaagaacctaaccgtcagtctgaactcccaggaaatgaatagctgacagaaggagtcactgttaagtggtttctgtgtgtgctcttgaaagcgcggctaatatagctcggttaatgtagtgattgtgtttcccttttgtctagtggattaatcatggtgcaattgattggattatataagcatgggagttcgctaaagtttacaccctattgttaggccttattctaggcttgaatgcgcaagaccgaaactcaaggcgggggagataacctccgtttgctggatcttctaggcacttcaaacagaaaatctacttatccagtaacaggggacggaacataggaaggagacacgtgctacgaagaaataggagattgtcaaaaacagggaaggctacggatacacatggtgctaggctaacaagtatcttcgtttgaccctggattggggttaaatttcctatgtttaatggaggggagaacgagggaatgggttgacaagtgcgagaagtatttgaagttgttccaaataaatacacttcaaaaagtgaaaggagtagttagagaaggcatgggctggaatgagttcttgaacgaaggttttgataggtttgaccaggaaggagagtggaaattgctcaaacagtggagtgatgtggaaagaactaggtgtcggtcacgaaaaccttaataagaagtgaggagctgattgaaacataaaaagtgactgatcgtaatcttagggcaaagagcagtactcttatatcagtatcatcttccctttcttttttttatttaactgtcgccttcctttcctatcaaacttttctctggcccatcatctcgtgacaagaactgctcgaatcacaaaaaaaaaggcatgcactaataaagaataaattcctgtctcttctaacaaacctatttattgaacatctgaatcccgatcctacttgcttgatgttgcagttacagcagtaggactttctcttcctaacgacgagcagcccgatgagcgtatcaatggaatgagccgtgccgaggcaacggagtagttcacagctactgtttccgtagcggattcaatagctgcctattcatgccttcaaacctcttagaggaaaatgccatcgtctgcatccaactataggggctagcaaatatgttccatgccattaattcaatatccttaccacgcttagaataaaatacaaagaaagatagaaggcgtagtcagtctaacgcatgcgagagcttctagagctgcttattcgagaacaaaagaacctagtggggctatattctgccaaaaagacgggctttccataaacacgggaaaattggcataaaggcatccaagctgtgaacaatactaaaagctgcaactcgtctgctattccgatcttcctctgattcaagtgctaccagttccttcttcaactccaggccaggcaagagccaagaagctatccgtcaaagaaaaagaatatgttcaacccaacaagcaacggattgagccactagcgcaggctgtagtttgatagcgagttcaccttcctagtaacgtttactcatttcattcattctcattcaaatctacttctaaggcatgtgaagtaccagttgtagacagattccttggcttgcgtagagaaatgtgaaattcatttctaaaagcaagagtttcttttctttaattagattataaatctgcgtaggataggtgagatgaatgaaaaggtcctcttgtccgtcgatccgaagaactcactcgattccccatgatgatatgcgtcaacgtaaggaagttgttaaactacacgtgccttcaacacccatctcgggccgggtgagaaagaagcaccaatagcttaatgcaattgctatcatgcttggagcatagatagaagaggtatgggtataggtaaaatgcacacttctaccaggtatgtgagactctttctaagtaagagagagctcgttctagctttgtcaatcgtggaatgagcagctccatccttactgtcctggtgaattaattgggtaattaatgagcacactgactcacaaagtctatagctagtctctacgaatatctcgatgcaactattaccaatagttggaggtaacttcgtgcttgaatgtattagtggaagttagtagcttgaagaatggaaagagtcttttcgtccctctcaaagagggaggggagtagttcacagctactgtctcaaataatctagtagggaatggagtgaacagcacggagtttagtgggttgttttgctataatgagtgcgtacttccagagtgaaggaatgaacaacaagcatagtagtgagtgaaaagcatcgatgttggtctgatcaatgagttaatttccaacagtaggagagctgacagctagtggagaaatgcgttcgtttccaacaaacaaggaagtagtgagtgaaccgttttagagtgcggagtgagaaaggagtagttcaatgagttcgttgacaagagtaggagagtgagttgataggtatacaaactcaatgctagcaacttgtgttgtatcgttcgtcatcaaagagagatttatgctgtgcagttgactcgagccaataccatacctagcaataagaaagtcactggcggccgtattctgaaatcgttgaagaagttcttggacttcctcttctgtacatggcgaagcggtcgtctaatcgaatttacaaggagactggatttcatgctgattactcactctttcaatgctatgtctttaagacattgagctttcctatgtctgagaagggatgccatactaatagactggccaagcaaagcctaggatgaatctctcttctagtctagcttccgcttacactgaagcttccactcccatacgggcaagaagagctccttctctttttgccaaagccctttcttcttttccttgtgcaagtcaactgttccctggcacaccgcacagttcagctgtgacatcttgcacttgtaagatcacttgcttgcctttatgcttgagtttcagcattcctttactccattcaactgtgatttgagcaaaacttgacaaccagtcaatgcctaaaataagatcataacgttgtacatgaagcacgctaacttctgtttcaaattcatggttttgtaacttgaattgaaggttgtcacatttggtactggtcaataacttacggcgagacgagcatccctataccacgtgtatccacactcgtctgtccttttctacttagttgtacagatcacttcagaaaatcgtataaaaatcaagcaagaaaacgtatgcgctttagcaacaaagcgctcatcccttcttctttcgcttggaatcccctcgcttcttctttcgcttctacgctcgtgctttcagcaagttcgtaccagtcgtcaggagctccaacctccgcgcctagccgcaaggaacctaaacgctggttctatcccggccaagcaagcaaggtgaaccccggtgggaaagaaagaccagggggaagaagcggggtagaggaattggtcaactcatcaggctcatgacctgaagactgcaggttcgaatcctgtccccgcctaatcacgtcagatacttctacgagtcctgatcacctgggtgaaagaatctatgttcaagtcgcctgcctaacaaatagacaactacgtgttctagttgctctgttccgttggtccccatggaaagtgttgttgtgtcaaatcgagattgtgtgggtgttcagtctaccgctcatgttcacgttctcaaaatcaggctttcgttggaaaaactaacgccgaccccaaacaagtctctccaatataaggagagcggagcttaaaaggatatagttacctatgatgagatttagttcaatggatatgaaggatagaagaaataaagtattttctactactctacccactcgtagcttgacaattcctccccaaccagtggtgcaacctgctcctcctgctgatctgaaagggatcttcgtattgcaagttttgatgcacccgagccaaatcttactttttttagtaaagccttatgatgttttcaatttattaagggaaggggcttctttgcaaagaaaagggatagcgctaggaatatcaatagcgtatggatagcattattccattccattgctattttccttcgtttcgtaaagtagaggggctcgcaacaccgacaaggaatgaagtcaacagagctagcgttagggataggagcagtgtcgcaatacgataatagaatgcgctttatcaaataaatatcatcttctttggtttggatatgcgattaggattgttctaaaggaaacaaaagatacctttgccctggaggattggacctttttacattaaccttcccccaaaaggagtacgaatcgctacgctctagctcgtaaaagggatagccctcctaaaggggatagcgataggtctaggaatagcatttctctagcgtataagggctcgcggtcgagggaaggtatagttgaaggtatgaggatgaggattagaatttcattccattgctttgttagagggagaggaagcttcgattggtggatacaataattccaatcttctttgccaatactactactcttgcttgctctatcttatttcaactactactactttgaatcccgttttattatctctatactacttcttatctcttggattccactgccaagcttcaacagctggtcttgtctctacttgattgagctgcccctgcaagtctgactatgcaccagcggcattgaaggaaataaaaaacctgaaaattgattagccagatcaaagatcaatggggaaactctcactagctggctagaacgatgttcgttcttacccacagccgcaaggggcgcttgaagggcactaagatccgctggcaaggaactgtgaggagatgagattctctttgccttatttataaagttcttatatagagtttggggcatgcatatagttagggcatatccttttttatgtgtttgttatctcgctgcgcgccttttcgatgataagatcattttttatctgacttggttgagtaatgcatgagatcaacctgcggccttgtgaaagaaaagttggtagactgcttctttttcagtatttgtattggattggttgaagatgtttattgattgtcttcggctttaactctttccttagtagaaggatccgtgggtggcttgacttactttctttcatcggtagcgcattgtcaacctgcggcctatgcttctcgtgtgaggagagctaagtaggaaggagggacggacttagactttaggtagagccaggcagcctgattgaaccttacaatgaatcaactattcccataataagcaagtggaacaggtacggctactgagtcgcaacactcacctacatttgacctgactttgatagtcaaacgatgtagaggaacgggcgtacctggaatcagcttaccattggaactatgcctacgcgacgccctccccggaacgcaaatgccctctttcgcttcgcccttggtccttccacttcgtgtaactccgaatttacctgcgaataaatcggaaaggcaagctttcctcccctaagagttctttctttgttccgctattccctgctttcctcgttctctcctcgagacagattttcactacaaataaccggatagagatatttccttacttatagagccagactgtgctttaacacacgacatcccagtcagaggggggaatggtcaaaagaaactcgttccattgaagatcttttacaaagcactttaaaaaatgtgcatgatttgtgcaatgcaagtcaacttagaaagagctcttcttttccaaaaaaaacacttctctctcgaaaacaaaccacttgcttgggcgggcatcactttgcctctttaaccatccctttacttacttggttcctgatccgcacagacacatagttagggagctttcaatcagcaaatcgttgctgtgcgtggtggtcctctcatgtctgggctgcccctctcttctgtttttgcatttctgtgcagtgattagtggaaatagtgctatgacattgatttgttgccaatgagaaaatgcatagataatgagctgcgccccctcaaaaagcaattaagtgagctcaggtccataaagaatagaatagaaagatcgcgagaagaacctctgcgaaatgagaacgtaacttgtcgcgtgtcctcgactagtagtgtctaattgaaaatgtcttcttacgagatgagtctctggtactgttcctgtaaaagtgccagtactaactggtaagtcggctcctggaaaagtgaatactttaagggactatcgagctctgtttatgaaatgctcgaaatagctcagttcgagaaaggggatagagaagagaaataaactattgatcgagggatggagaaggtgtgggcccgcttactaatacggttccgttccgcatgaaaaagaccaatcaaatcaaacttttcttggaaaaaccgacgccaacgttaagatcagtctcctttcttttcggcggcatccttccgcattggcggcgagtggaagagttgggttcgattccctttatacgcgatgtggcgaaaaagactgattcaacgaaatatgccatgcctgcattattacttaccaccagtatctcgggaaacggaaaaccggaaatgacaatcctttctatggtctatactaaattactttgtacgaatgcacatctcggcgggcgtcgggtagatgctcaccatttcaatgtctatatctgtggttccagaagtggaattgctattctcgattcagacaagacactgatttgtttacgaaccgctcttcattttataggatctcccattcgtaaaaaatgccgttccttccttttaaagaccaatcatttatttcgatgtgagatattggaaaaaatggcgagctgtatcaatgattctcaatggaagatcgggactttttttagcaattatttggctaaaaaaaaaaaattccgtttaagaacgaaaaagataaattttgggttgaaccaacaacccgattgtgcggttattctgaatgcagatagaaagtcttcggtcatactggaagctgctcgatcacaaatacctattgcattcttagttgattccacgatcccaggggaatcccataaaagaatcacttatcccatcccagcgaatgatcctatacagttcgtatatctatttcgtcattcggtcacgaaaacagggattctggaacgtaaatctgtgcacgaacccatgcaaacaggcttaaaagcagtggatagcctggttcctataggccgtggtcgacgagaacttataatcgggggcagaaaaacttcaatctgtagcgctacttccagagttaccaaaactcgaagtatctatactgcggctgacagcgaattatttttagctgtcctgcctttcctttcggaaatgccagaacaggtagtttcaactgtggagcccttcctttctacaatcccggaacaggtagttccaacctacattccacaaatgcaaaattttataggtgaaactactaccagtctaccccagctacaaggggaggctggcccgagtaactctacagggggtggggctgccccttcttcttcaatttatctggcttatgcggccgaacacgcatctttcctaaaagcaatttctgaggagctttaccggagagtaggggaacaaatcaacttaaagagtcccctggacgaggagaatataaggaatatagtctacaagatcatgaatgatgattttgaactcttcttcgatcccatagaagatttgaaggactggctacaattcattaaggcgaatccccttagttttcaggatcttatacaattttggatggcattagccaaatagtcgatggggatgggggatccaccagtaaaggatttcaaagaaagaatggttgggatgggggtatcatagatagggttggggacttcagtgattcatttgaagagcaggattgggtggccgaccggcccgcagacgtaggaaggcttttatcgccgactgaactgcgtcaccaaagtcgcgatctgaaagagacgtctctttcaggaagggcaatgcgggttcgactcccgctcgtgacaagaagcaagctaggtatgctcgctagctgaaaaggcaagggaaagagattctgattcaaacccaattccgggagtgaaatagtctgctgtgatagaacctggcaagggaaaaggaatacaactgagcaagataactggattgaaccagatgccgtaaagagtcaaagtaaaatccattagcgcccagaggcagagcaaagagattcggagatagaagagagtgggaccacttcgaagtcaacgggttaaacatagtgcgagttagacagatcccacatctcaaacgtataaagaagtcccttctcttagactccaaaggcacgaactacggctatgacctatgagctagggggcatccacctgtagtacaccaaactctttcattgtcttgaagcaatctatattactttagctgaagattgatttggtgggtgtgcagactatgaaccgtgcggttcgggtgagagtagctgatgctggtgaatcgaagacggatcatagcagtggagtggaggttctatggcagaagccccatatttatgaagaaaaacaagttctaaccgcattctaggagttgccacgagtgattcccttcaaaacaggtgtggaaaggtcattagaggctcctctggaggccatacaagaaggatccttaattcactgcaaggcattctccaatccccattcacactctccttattcatacatcagttcagctacaacaaagaagatatctgtcgcgtcccaaatcgactctaaaatctatcctcaaaattgtgcaaaagaataagtaaaattcattgtgaaagcctccaacaattaaaatgtgcaaagataaaagtcaaatgaggcttggaggatttttgtatatttcctaaaagcctaaaatacttaaataaattttagtggaattttcagagcacaaataataattgaaaagaaataaacaaagttaaaaaggttttataaaaagaaaaccctaaaagaagtcttttccccctcctcctcccttcttgggccggctcggcccattccctccctctctctctctctccccccggcccatcggctccccgcgcgcgcgcgcgccgctgacaggcgggcccgcccgccactctcgccgacgggtggggcccacctgtcatctccctcctcccgccgcgccgccgcccgcccgtgccctagcgccgccgccgccgcggattccgccgcatcccgtcgtctccgcgcgcattaaagagaggggaatcattccccgcaatcccctctcccgattccccctctttcccctctctctctccctcggattcgctcggaatcaaccccgcaaaccttgccggcgtattcaatggagccgagatctccgcgcccgtttcctctctctccggccgcactctctccctcccgttgctatataattgctccccgagctccgctcttccgtttccgccgctcgccgctcgctctcgccgtcggatccgtgctcgcgccgtgctcctctctctccgccgtcgccgccgacctccgtttcgccgccgtcgtcgctccggtcctcctcccgactcggcgccacctccatcggcttcgccgagtggttgccgaccccgtccgccgctccgcttcgcccgccgaccgccggagcaccgtcgtcatcgtcatcccgagccgcgccgccgtcttcctccgctccggccgccattctcgtcgtcgtcgttgtcccggggtgagccgaagaccgccgttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgtgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaataggatttttaattgaaaaataaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattattattaccttgttcaccctagattaaacaaaacctcaactagtgggtactctattcatggttccactagtatgaatttaggtagaagcttcgctgattaattaggcaacattaggtggttttataactttagactttgggtattctcttatcatttggacactttggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggactctatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagcgcctgtggtcgtcgccctagtcttccgctgtttttcgttgtctttgagtgtgctgggccttcgttgcccatgtaataattctatttacgcttccgcttgttaaactctgaattgtatcaacttttggtgtaccttgcctcctgggacaaggaataatacacgcacgtcaggaacgcctgttgggtgatttccggtcgtgacaatatcctcccatacaatggaaaggagtcgtcgataggcacactaccttctccaaggcggtgcacccatctcttcgagaaagaagaacaagaaaaacaagagtagtatttctccccgaagggaacaagataggtgccatcaaacaacgaggggtttcacggtcgtgagctccattccaattcaacagattggtgaaacaacctagaaaaccattgtcccctcaaaccggtaataacttgtcccatttctgcatccgttaatgatttaagaaccgttcgttgagacctcaaaagataagaaaactgtccctttttgtcttgcctcgataaaacaatgaatgggtaaagccgaattgatctgaccaaccaaacatgggatcttttgtttgatactcaacacatgagaatctaggaggatactgattggcgctcaagaatggcgtagttaatgttatgatttgccagcattctcagctgctgattctcaggctgattctacttggttggtagaaaatctacttatccaggaacaggcgacggaacatacgaaggacacacgtcctacgaagcaatatgagattctcaaaacagggaaggctacggatacacatggggctaggctaacaagtatcttcgtttgaccctggattgtttcattccacccttccctcttctaactagtcttctcttatccacgaacggatagaactctgatcctctttagccccgagaaaggaagatgagctagggcaaagagatggcaatacttacttaataggtattatgaagggggaaatcaagctttatttctctttatagtgaagctagcctcttaggcgcagtgtcagacatcttagctatgtagggaatagcggtcagtgctgcttgattgagtctttgtcttgcagttgcaggagtgatgtcaaacctcttgcttgagttgtctgtattggaagtcgtgtaagcggcttcttccgccttccgggtctagtacgtatgaaaagatgtcagcgtcgtggcgattgcctttcctggtggtgaaggattctattcccgagcggctaaggtccaatccggtattctatttcgtctgtgcgagcattaaaaccaaccatttccgacgtcaagatcaataggaagaaaagggagtctttttctgtcttgaaggttttattttaaatccaaatcgaaatgcctaaacttgataaattgacttatttctcacaattcttctggttctgccttctcctagtaagtagctcacgaggaatggggggacagattccctcaatctcgagatacgaacgtatcgtgtcaaaatttattggcaaatttttcttcagtggtttgtggaccgatagaccttaccttatttttatttttatttccctcatttttttgggactttatattgtcagaaggaggagggaggctttttcctctactctaattggatccttctctggtttgttttcgtttttttttgtggaaggcccagaggttgcttccgctatggagaacccaccagggcctgggcctagtgaagcgggtccttccggatccgctgcgggcaagtcagctgaagcctctactccgtcgtcctcttttttcaatgggctttcgggccagatacccgcaccggattcccccggggaagaggtgccgcaaggggaacagccccgttttgacccttattcaattccggaagttcccctggaacacgtattcggggctgttccagatcggggagagccatccacaagccacaccccgccgaaccctgaacctcaacttggagaagaaaatgccgggccatcaaaccaccaaattcaacatgatgttataagaagcagacttgaaacttgaactccccaaagggaagtaagcgacgatgagatagactcaatcatttttattaagaaagatattatcgatcgcatggcccaattagacccggaccgggatggattctggaatgagcaaaaggaccacttagtcgctcatggaatcctcaataagggtaaagagtataccttacagggactgataaacctttctaaaaaattggaaaaatccggtactagctgtaatgtattcaataaaataaagaagaatgaccgtaaatcatttcgaaagaactacgaaagcaaccctgatctttcttctatgaagaaagtacgtaggcactcctcagcgaggacgcgggttttaaagtaggttctacacattcgagaagacccaggcggattggagtggttgtgcgccggggcaatctctgcttgcatttcgcattggaatttcttgactagcccgaatagatggactcgttcgttcggtcgggcggggcaaatctctaaagtggaattcgtgaaaaggtaccacactcaaatcacatatgatattatgtcaaacaaatcaactagctaaaaagctaggaatttatgtagaagtctgggctggtcagagttcaactcactactcgggctccttttcagttaaggatgcaagggagacttccatgtctggggctgatagctttcgtgtactgaatttctatgagattctcttgtccgcgggaacaaaaagctagtaaattcagtacacgaaattaggatattctagacaacgaaaagctaaacaaagaaaggaatgacaatgagtgtggaaaatccatctacacaaatccactcactacgaggaggtaatcaatcttatgctcaggcaattcattcgtataaatcactactcggggtgtagaggaaggaaatcaggggaatccccggtattaaagtagacagatcaagactagtaggaaaggatactccacgcactagagctttgtctggtcaaagtgctcattctaaggttcaatgcgccgcagaacgagtgctattccttttatgaaattacaccgggaaggaattgagcaagccaagtcatttaactcactccacttaagattgaacaaccccagtcagtgttggttttggggtaaagaaaactatgatagctagctaattcaagaaattctattccatgaaattcttcctccggacaagaaagagtgcggcatcaaaatatgaaatgaaaaactaaataaactaaaaatctctcctctcagtaaattcgtctattcgactaggaaattgaagacaaaggaatttggaattacaagacggatatcagcttgctacttctgactttgactttcaatagggaggtcaaaaactagcacttttttcgaggagtgatcatggtttgacttcgatatattccgggaagatggcttgaagctaatagcaaagtctatttcgactagcttgtggtactagctaggaaattccctaacctcgatatgaacaacttactcaactcaacagagtagcaaatgcccaagaaagcccgagtcaatctatttggaaatccaatctattttctcgtattcgtgtgggaaatcaagctattctagttgaaattcaccagaagaaatgcacgcacttcaatatgccaaaattgcaaaggaaaatccttcgattaacagtggaattcaaccaagaaatgaaaaggtatatataggaaatgcactccaaccaccaaccaataagtgattccgggcaatcaattctatccgcgagttgtggaagtgtttcatttgcctccgaactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgatcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgcctactcaacacttgaacattggtgtgtttcacattcaactctatctagccaaatatcatagctagcccaatgcatttcctcgtcgtagtgaagtgagggaaggaatttactagcttaactaacaataccaggcttgtccgccgtacttcctatatatagtattgaatttactagagcatattttactaagtggtgtgtgtagtttttacatttcctacgcttttcgtatcaattcctccctctttcctctttcaacactttggcccttttatcatataattgaattgaattgtcttggcatttagcatttgctctcttctgggacctaaagaaagtgagtgcctgtagcgatgagtgccagctttttcatagattgacttgggtgttgcatctctttttccaactcggatttaccattggcttgtcgtcctctcttacctgaccctgtcctatagaaagtagtgtgtagtgtgcttaaaaaaaagcaagtttaaatataacccgcaaaaatgaaagctcgctttgattgagtactcttcttggcttgttcagttcttctcatctgcctcggtaactaggtgcttttaagctactcttgttggcaatttcctttggtttgatagtcggatcttatcttttttttaagaaatcaagccttcctccttagccttgaacagccaccgcccctggcatctcctctgtaaactggatctcttctcttaggttaaacaaccgaatctcctagctctcgatcaaacccttatcccaatcgacatccggaaaggtcgaaatcgtccgattttagcatgaaaggcgatattaatcgttcaatttcattcactcgcagatcagcttccaggtctgcttcggccaatggtgctgtttgaagctttctttctaaggaaccaaaagaggtgggtaagacaagctatagagatgttccacaaacatcttacttgaagctctgtttcgagtgcactaagcgaagaggcaagtgatgagtacaaaacatggaaaggtcagtatagcttgaatgaactacgtagtaaggtttagtactaagcatgattaagtcacggtaactaagtaccggtaacgtttaatagatagaagtaagtaacaagtaccggtttagcacatatgggtcacataggcataccgataggataataggcttgtacgcaaggtcaagtataggctagagagaaagaccggtatatgtttatgttgagaagaaatgcattgtttgatttccgaagcaaataaaggcgcgcagcgaaaggcatgcatgtttcatttgcaggtgctgccggtccagggctcttcggctgagcttactaaataaaagaaagcacggcctggtttatgggaatcgtaaatagacgaagtggtgttttttcctttccttgaggatctatgcttttcatggctctctttctaacgtggatgacaggtttcaaatagtggatcagtttcttaatagccttttctaagtgcttttcgttgccttcttcttatctttatgtacccaggaaaaagagaagaatcttcaccattaccatcaccagtatcacctccaatggttggcgtccctttaattgtcatttagtagtagataggtttgttgaggacataatctcccggccttattcatgcatgataaaggtagcctttcatagtccaaagcctttgtgtgcttttgtattgaactcttttctacaacgttgaaggattgccttacgggattagcaatggcttaataaaaggattaaaaaagggcttctcttaggtcccatactagatgaccacccggaactggatgtactcgtactagaacatttggtgattacccaccgggacttcctactaagtatttgacacttccatcaagaagaaaactataaagtactcaatcaatgcgaatagcaggaatggtacttgcaaaaaaaacatataggaccagagaaatgggaacgaggctgacctatccaggtagtgaagtctacctatgctaaagagcaagttcaatatttggttcgagtagccagcctattttcaggagtggcttattatagtattattaaaaatcatacgaacaaagaaagcctattttaggagtccaccatatcaagggaaagggagatcaggcttggccttcgctttgcttattcatctttctttctttgcttttgaatgacttgatgggtctggataataacaagaagagtcaaggtagcgaaagtagctatactctagtagctggcggggctagtggtgaaggaaatcaaatggcagagaagacacggattcagacttcttttttcaaatagcccttggtggtatgcagattcattgaacgaagaaggcagtcttgcttcctcacgaacaagatcggagcacccaaggttaggcactcgattggatgttcccgtacgtactctagaagcaagatcgcgggacgtccctataacacatcgctgacgtcctcaaggctttcgttgtcgaagagtgaaagatctcacaagtcctccatacgtcagtttctattccagcccagcaacgaagtgcccgtcggtctgcaacattccctggtacaatgctaggaatatgcagtcacagataagtcaagaataagtgagtatgtacgagtcaactcataggtttagtagggctactagaaagaggagcttgggacagagctatacaggactgcttcttgctactccaagagataacaccgctaccaagccaaaatgcgtatcccgatgtcgacttgcgttcatctggacccaaaataaccaaaaagttccagaggcatcttccattcatttcgattttggtctttctgcaccatatttagatcttccctttctacgatccggaattcccagtaaatccttgactcctcgaatacgatgggatttcacacctggcgaatctttcactctacctcctctgactaagactatagaatgttcctgcgaattatgaccttcgcctggaatgtgagcaaatatatcatgtcgattgctcaaccgtacttttgctatcttacgtagagctgaattaggttttttcggtgttctcgtcgaaacacgcaggcatactccttgcttttggggacattgatccgaagctcgagtacggtccgtgcgctgtttttcttctctaccatgacgaatcaattgattttttgtaggcatccctctttcctatgtccttcccccctttgccctttcactagtggttactcccgatccgaagcaccccttttccattcatagagaaatccaatcgtcaaaatcaataaaaaggccatcatggaccaagatccaaacagatcaatcttgttaggaggtactgcccaaggaaaaaaaaaggtgacttccagatcagggataataaataaaataggaaccggataaaatcgtatatcgaaacgacttctggcatcaccggagggatcgaaaccacattcgtaggccgacaatttttctggataggtcgaactattggaagcaaatggaaaaggaacaccgagtggaatcaaagaaactagcggactgatcactaagtagatacaaataggtgcaaattccgacaaaaatgcactttcatagccgtttatcgctaaatctatccgtattccctgaagaactgtggcgctttcatagccgtttctcgcgttgtaaacaccaaaaaaaatgttgtccatgaattcactttcttcattcaattgagctataaaatctttccataactcttcgcgggattggccccccaaaaaaagtgatagcggcgactcaatcttgtcctttggggccgggggaacggcagcactgaatgcacaaatagatggaatagcagcaaatagcatatttcttctatccttcttatccgttgaactaaatctcatcatagggtaactatatccttttaaagctctgctcccaaaacaaacgggagactttttcgttttgtggccgtggcgttgggttttccaacgaaaaacaagaacattctttcatgaactttcatgacactttatcattcggaaccctctccgtattagtaagcccacaccttcgtaacccaaggaccgacgaacagaaattgaaacaacgcaaccgtactatctatttacgataatttgattgctgacaacatcacgcttctctttcttattcttatttatataactgtcactttaccgggccggaaaagtgacaccgtcacgtctcagaatcgtatgcctggaacaagaagggtcgtcgtacaatttcggcgattcaaaaaaagaaggaggcgagctccctatccctctttgtctttccacttccctcgttcaggaacaaacacttcgccaaattcttttgagtcccggcccggtttttccccactaaccaattacgttacgaccactgaacaaacttggttgacgaacatggtttatgcgctgctaatctagcggcttgtcgagcatttgacaaactcacaccatccatttcaaatgggatttgtcccgtggacacacgagcaatccaacccgtaggatttccttttcctcttcccattcgaacttctgcgggtttccccgtaataggaagatctgcgagaactcttacccatatcttacaatttcttcggaattgtccgctcatagcacgatggaattgcccgattgtagcccgacgcgctgcttcaatggctcgatatgaaagacgaccagctctacaacttttggtgccatatcttccaaaaccaagttgtgtaccatccggttcgcaacccctactacatctgcatttactatatttactatatttcgtacgtttcggatatagcacgtcccttcttattttgactatatgagatccgcactttgacacctgaaattccgttacgagtggatacttccgcaagagcataatcgattttctggttaaatacattacaagatgtttttccatactttccgcattcagttctagctatttccgcaccccctaatcgaccagaacaacaaatacgtatcccctccaccccttttggcattattaatggaatatccttcactatttgactaaaaatggaacgaaatgagattggattgttccccagttgaaaagagatgtcttgagcaatcagagaagcactttgataaacagatttgatctttaccgactcaattaaggtattagtgtttgttctattagacaaaaaagatcgcattttttgcacttcgttcaaataagagttgtacccgtacggaattatcctctttctcagtatgatctctatcatcatctctattccctttatcaatttgcctatcctacctaggtagatgaatttctctatcaattccattaccttatccttacccatgaggttcctacatttgatccttaattgacctaggagttgttcccgggcatactcaaaaaatgggttattatacaccccaaccccatcccttggaaaaaaaaaggtagcaccgaagaaaggaaagagcgagatggtggtttttgttgttcccgcgaagcgaagatcattcgcttggtgaatgaagtggatcaacctctttttggctcgggccaaacactttttctcgctggtcgagctttctacaaaaaaagcgatgcgagagcgtattctcttatctaagcttcctcccttcgctccccccatcgtagatggttcagccacacccggtgccacgaaatgattgagaactacgacggggtcgaaatgcattttgttctttgtattaaaaaagtattgcatgaccgaataattcaaggaggggcgcacagcggggagggtcctttttagtagatgactcgtcgggccgtcattttctatcaggaaggctatgtcatttacaaccccggcgtatttcggatgcttgaaggccccgctcacccgaagtgatttagaaaaattcttctttctcgatggtgatcggtcatggtatccataacgttgcatctttttcggccaaatcctgatttcgttttgcttctcccggtcgatcgactcgactcttttccctgccccccggcctctcacttcgtttcgttcttcctctgtaccctcgcttgaatgaagacacccgatcggcccgactttcccaaatgcccaccaccggcccttatcctttccgggtcttgatttgtcgcgtcgttttagtcgtagtggtcgacggggaagaaagaaatgaatgaatgtccttttgggaaaatgtagaataatacacctaccgagacgaaagccaaaggtgagtatcgtaggtggacgtatcgaactgaaataagatctaagattgacatcttgatacaatgatttaccataataataaatagagtcaatggtgacagagccgtgggaagagccgcttcttttttgcggcgggggcttccattcaccagcgcagactacatacacgtgctctctgaaccgtgctagatagtcacccatcacacggctctcaaacccaacctgtggtggatcccgggggacaaagcaaagtcaaagcgcttgatcctttgccccatacttttagatcttcctccccaacaagcaacgggttgagcgcactagcgcgaaagcgttagcacgcgcatccgttttcttgctccgatcaagcagcaacgcagctcgtgataggcttagcttaagccgctaacgttcggttcggataagtaaagtcccttcggttggttcgctcaggtggtcttcccttattttccctaacgttcagagttgttctggtttgagaaaggagcaccgccaagtccactaggggcgccctgaatgaataagaaatggacagctgaggtcaggcttgcatgaaaaaagaagataataagttagatgtcgattacacacctgaggttggtaagaactgagggacaatgcccccctcactgggcccatcagcgaagcaactgctacttaatcgggcggtttgctttcgtgcaaggcccccgctgctggaacaggcggttggcattttcaagtaaacgccccgccccagaaggacgccctcgctctattggcaaaacgctttgaaagaagaacgtatcgccaaggccccgaccggccggcccgccccctttctttgcccgccggccgcctagctcgttattctttgagatctggatagagtctcgcttcggggcgggggaagcagcaagcgtaggctaaaaaggcaatagtctaacgttggggtagggcgcgccaaaacaactgggggccccggaggggtcagtacaaaagtactatattctttccacttactttcattggctagctgccttttgtagcgcgcgtactctgatcctcttctacgaatctacaactctctttactgagcgagacttcatctatatccctaaaagtggatttttattcccattttttctttgaatgacagcttcaacttggctctaccttagagagggttttcggttttaatcaagatagggtcaggggcgcgtcggaacggtagctgcttagtctcatccgagagtccaatctctttgtactgtgcttttgtgtctttgaataaaaaagaaagaagggggtcgatttaggctccttcccttccactgcatagctgcgctatcaggtactacgagccctctgccccacgcatctaaccagctcgcgtggttcgccggttccaccgaaaactctcatttgttgaagcggagcatagtgcggcgccgagcgagaaaggtctcttttttcggtttattcactgatctgaaatgaaacttagcacttgttttttattgattcctggggctaggcgttcgcagaatcagtctatccgaaccgcagacgcacttttcagatcagtgacggcctctccagcggagctgggcgccggggccctggatgcgctagcgatcggcacattaggggagtacttgcccgggtttctcggcctggtatccttatcctcgcgttcatgatatctacattcaactgtgccccggagacacggtcgaagcacgcccgccccgtgtgcgtctttcacgacatgctctggtcccgggtttcttcctgtggtcttctagcgttagaagaagtcgtgtccgtcccggacatctgcaacgtcctctcacgcctttttttggggggacaaacaaagatcaggaaaagacggaccgaacccattcggtgactttcgcggtcgccctcactgaaccgacttggatctgaactacgattcagatcaagtcttaccgaaattggatttccttttcgtgccatatgtcgcttagactttactttttcccctttctgtcctttcctctatttgttcgatagggtcttcgttctattctaattctaaacccattgtcgtccacagtttccttgtcgacgcgaaggggcaagcagcccccaaacaaagaactcataccgcggttgtggcttgaaggccgcatgcaagttcttcaatatttagagagtatgtgttagtacgagatcgcgctatcaacttatttaatctttctcgatgatttaagacaaaattgtatcccttaggaaccgtacatgcacctttgtttggatgccgatcgaatattgttacaatacgaaatacttgaaggccacacgcaattgactcacctacattttatgctcccgcccttttgtagactcagcctctgcctctggggaagtgctcacatcaactccaatttggatggagcttctcgatgggttagagcgtttgcgaaccaaaaatgggaaaaacccatcctccaaagtgacagtgtgcaaatcggtatctaaacaaactatagtgaagtgagccaggacaataagacaataggtctcatgggccaagcctgctatcaggcagtgagtgggaatcaatcctgaaagagagaaggtctagtgctctctgaaaatatttgattcgccgaaaaattggctttatcagaccaatccatgttcaggagccttccatcaaaagtcagtggtctaggccgctttccttgactttgagttggatctcattcttcttcccggcacaaaaagagggtagacttcatccgagacacatgggttcttttgcttccttcaaagaactcgtctttgagcctctaaaaagatgggcatagtatcccagccacctagaccacctaaaaggaaggaattggtctttggctttgagtgatccaatcattggtgaatgggttcagtaaggtagaaggaaagggcccctctcgacctgggaaattcacagcaggaaagactggcgccgatcagcgaaagcgaacccttcagtacatcgcattcagccctccctcaaaatccccatttgttttattgaggaatcactcttgatcctctaaaggctcttccccgtctataactcaaagtccatctgtctctcgtggaagcgctttagagtgcctagaagatccagcaaacggaggtgccaatgctgtcccaagaccagatcacggtaggtagctgctttaaagaggttgggagacagactggtgaacaatcttcttcttgttttctccgacctagagcactcttttttcaatcgtacgaagaaactccgtgaaaaacccagctatcactcctatgagacggctaactcccaactcccgatacattctttagagtcgaccaaaggaaaggactcgttggtttggacatagtttctttgttcctgtgtttctgttttgctctcccccttttttcacttagtttagttagaatggatggaaagagaacttccttcagcctttttgttgcctggttcggtctctctgagtggaataagtgggtccttcttctttttcctgactgatgaaggtcgaaactgaagatcgaatcaagcggagtctggattcctatgttcgtaccaactcaaatgattgatgaattggatcttgagtatgctcacttcgctactcagcaagggtgaaagaatgacaaagagactgacatcacagaggatgggaaggacccaatcgcctgcctctttcttggtccaccccctggtgggtactttttagctcacaacacgagataggcagatatgtgacatagtctcattgctttcattgacaacaagactctcttcctgattggtctgtgcaggatctccttccctatgagactcttgcttccctttgaaagaggcagacccctacttcaattgtcatctgacgactcttccccagctgtggactcagacctctcacaaccaaaaaaaagaaaagaaaaagcaaacgaatccgaatataaccaatctatcgcctttgatgactcgttgacagcctcctcaacccaagcttccatctcctgctccagacatcggcgcttgcccgcgccagtccatgaaaggtggatgaaggtgagtttgactacgaactcgaggatgctgggaacgatctcttttcgggctcccgtcgagaggccctcttcctccctttttctgaatctgggagagaggcaaaagagaagtccagagagacctcgactctttcagggaaaggagggggatcgaatgcgagatggagtccctgccgaatggaatggacatccttggggacagctgtgtaagactgaatttaccataaaattggacggaaaaacaactacaaagatcacaagaaacccagctcaaagtgaatggagagagaacccctgtgccttggaaggatctgaagctgttcggacactcatagacaagtgaactccaatccaggatccctcgaaaagtgaagtgaactagccaggtagaacagtcaggttaggaaaagagtctttcatgtcaaggtgaacatagacagacaaggttagtttgttttccttaattctcagagagaagactcgttgctggaaccgagagcactggcgattgctttctttctgaccttcagccgagaaattccataccttccaccgacttcttttgtgtgtggccagaacgtgatgctttccaatgccgagtacttttcttcacaatgtatgaagcccgtaaaaccgaaatcgatccaaacaagcaacggattgagcgcactagcgcgaaagcgttagcacgcgcatccgttttcttgctggccgagttaataaaaaagaaatctctcataattagggatgaagcaccaatgacacacggatatgctttcgctgcggttgaccgaacacttcgcgacattaggagaacttctgcaaatgacactggttcaaatccgcatcacagactaggtatagttttttttatcatcataacaataataaattcagttggatgctcgagtaagatgatagagcttcagaatgctattgagtctctgtctttttcttcatttacagaagcagcgtcagcatatcgtggatttccatcagtgatgggtttgttaatacgtgagagataactgctaaagattggatattagctaaaagacaaagctctagtaagctaacagcggaggaattacggtttgtaaatgcattggatcaatatgatcttgaattgatatgccttcgttcaatatctatagtattctcggatatgatagattcatcgcttgttcgcacagctgtgttcttaagtgtgattcataaaatcaaaatagagtattcacgctctaggttggtctcccgcgtaggactcgaaacgacaagaataaaccaagttatgagcttttggttgatctagaaatagctgaaacgcttgagaatcctgaagattggtttaatgctgaggaaattccaaccgtatcacttagtggtaagatgggtataactatagcttcatatttagtggagtttatggtgatgagaggtgtaattggtgtggttcgatcatctctcagttcaccgattcatccatccaggagggcaaagcatgtctctttgtccaggtatctctttgttttgttataaacgtttatctatgctttttctttttctattaagtgaatatgcccagctccgaaccaatcgtttcttcataaagaaagagtactaaatatgatattcaaaaaaagtactttttcgttgaataacgaaaactaaactttctatgagttgttgaaaagcagagacacccatattcgctttttccctgttccttccaacgaagaaatgtataaagtataggttcctctcctgatgatccctggtatctccgttttgacgtagcctatgccaagcgcatggaaggaagctaaactgctccagcagctaaaaggagttaaaacggacagaagagagtacgaaggagaagttcataccctgccgatgcggagcggccgattcccagaagaagaagccaaaagaaccggtgttgagaaagaagtctggtagaccaaacaaagacgctgtattaaccttccctagactagaagctagctctttactgatagggtaccctaggctttgattcgtggtttactttaaaacagggatgacagtcttcaactgctataaaagtagtgctgtgaactagtaagaatagcgcctgccaaaccaatggatcctgtttatccccaactgaagcgggaaaaaggcaccttgttcaggtggatcaccgatgttcatccttggtgcctcttctggttcctctatctgactagggtcgagcatcttcatgttatcttgattgatgcacacctgacctgttagcacttagcttgaagtgtgttgatgactttgtttgaggttctgtatattattacgagattccgcaagcattacttgaaagaggaagtgcgccactaagactgattgcttttctagcacagatgaagttcgtaccagtgcatgctgtcgcagagctaagaatcaagtcactcaggaaagctaatccatggggaatagaaatccccgtctgaagaccgagctaccactttcataaacccagacatctatttaattatacgaaatatgaggtcaattaaagaagaggcaggttattatgtaagataagaatagtggagtggagacagtgaactgaacatcgcactagaatagcgaacttaacttaattaagcacagtactatatgtcaattggtcgttgcatttaacctatattgactaagcggtatggtatcattaacaacctacctttcactaagaagcggtaccaaccctggacttcccggaatcaatgaaggagttcattcagcaccgagccgagcgagcgtagattcaatatgttgattgtaccgaacgaaggatttgccttatcacgaaagccacattcgtttcgtttgaggaagtcacacgtcctgttccctataaataaggagattcattctttttttcagaaatcccctcttcttcctcctcgagcccctatcacaagaccaagcggatctcatcctgcagaagactctgagcggatctatctaatggcatggctggctgtcggatgtgatctattctcgtgtcacatcgctttctttcttctccctccattttcttcactactaccgctcctacacataaatcaaagaagcatgcattgtggaatagtggcatttcgttaatggcgaaaatgttcttagtgaaagggttgccgcaaaaccggcaaactcagagcggtctctgaaagtgaataggagcatagcggcatcatccaagccaaacacgtctcctcagtcaagggtcttctcgcgcaaagaagatcaaaaacataacaactgatttcgcttaatgcatgtcacccacccgctctcaatacagcaagtgactctctctcacaagacagagaaagattaccgattcatccaatttgatcagaagtgagttcattgttgttgtatagcgaaacctttccttgacaaaaccattctcagctaatagaagccgagctatctatccagatcagggttgaacgaagcgaatggaaaagccaaagaaaacagaaatccattgcgattataaacctgtgactctacagccaggactgcgatgaaagcaatctacatctacatgattccaagatagtaaaagatagaaagtaaaaatgctatggaacgcatggtgaacaacctgcgggagcacggtaatcccgacgagtaggatctagaggaactcaggcagaagtactgcctccttgattggatcgcatgtcaactggcttttcagagacctaaaaagacgaagcccctctcctctctcagtaactagagaggtaggcaaacctgagtttagagccacctcgattcgggatgtcggaacaccaaccggatcggaaacctcatcctaaacttacttcggaataggttcgagagcttccatttcaatgtgtctttccaaaaatctttggtatgccttttcctggtcaaaaggtttgtttgggaaagcttctaaatctagggtgaaatgtccccaccccctggggcaggatagtaaagagctgattctagggaaagctaggatttcacttttctctcagccatcgagttggagtagttaaccatctatatgccgtggaagaatacgcataagcattagttcttgcccttccagtgtaagtggcggatcaaactttatcctagttttgctagcctgcttgtttggtgtcacgtcctgataaattcatcccgaaataaaaatcattcgctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaaacaacaaaaacaattatcagagtttaacaaaaagaaaaacctaaaaataatccctcctcttcctcctttgggccaagtctagcccgaagtctccctctcctccctctccttctctccctctccttctctccctcctcctcttgggcctcctcccctcccggcccactccctcctccctctctctcccgggctgcctttccccccccctctcccctcccggcctgctcggcccaagccgcctccccctcctctcccacctgggccgtgtcccggcccaagccgcacccccctccaggccgagccgcgcccccgcccgtgctgcgcacgtgcgcgcggtgacgacgcgcgcccgaccgcgtggggcccacgcgtcaggccgccgtcgtcttcttcctccgcccggccacctctctctctcttcccgtgaaaccctactcccttcctccctcaaatccgcgcgaatcaatgcccttctttccaaattgattagggggaattaatcccctttccctcctctctctttcccccttaatttccccttgaatggtgcccccaatcgccgggaacggccgcgccaagtccggccgccttcctttgccgccggccgccattcccgtcgccgttcccgctcctcccgtggccggctctctcccccatcctataaaatgggatcctcatccttcgttctatcgttttagccccttcccgagcctccccgtggtcgtatcacctctccccgccttctccttctccctctccgacgccggccggcctccagccacctctccctcctcaccggagcatcgtccggccgtgccgtcgcctccctcggctctgcaacaccgtccccttcaccggccttaccgtctcctcgccggaaactcgccggaacggtgcccccgccggcaaccagtggcattggtgccactgtactccctccagccggctgctgttcatcgccggtgcgccgatcgacgccgccgtctcctccttcgacaccgcggcatcgccttcttccccggcatcacctcctcctcgcccgaatttcgccggaacgccgtcgtctccgcgccggcctctccttcctcctcgtcgacatctcctccggcagcccccttccgccgcgcccgtgcatcagccggcgctgccatctctcccttgcgtggtggcgtagccctccacctcgtccactcctcggtttcgccggaacgccatcgccgcgaacctctacatccgcctcgccggagttgttcggccgcccgtccctccccgccgtgcaccggtcggccacacctccaccacctccggcatcgcagcggcaaggtcgtcctcggcatcgtttcccctccatccaaatccctccgcggtccatcatcgtcgtctccgatcgttctcgtcgtcgacgtcccgtcggtcgcccggctcgtcgtctcgcggcgccgcctccgtcatcgtcatcgcagcggcgtgtcccacgtcgtcctcgtctccgtgcagccgctgccggctgtcctcgtcgcctcctcgccggtcccggtcgtcgtcgtcgtcgtcgtcctctcgtcgttcccggtcgtcgtggcgttcgtccctccgtcaagccgttctcgttcgtcgtcctcgcttcgtcaaggtcgctgcagcccccgtcatcgtcttcgtcctcgcctccgcgtcgtcaatcctcgcgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggatccgtcctctcgcttccccgccctcgtcctttcggcgtcgccccatacccgttgtgcggtcgtcgaccccggtacccgtgtaccggtgtcggtagtcgttcacgtgtgcgggtggtgaccgtgtagtgtccgtgtttgtgtgcccgcttggtagccgcgtggtttccacgtgtgcagtccgtgtggtgtccagtggagtccgtttgtcggccactcgcctcggttgacacacgggatccgcttccgtcgacccgtggaccgtctctgtgcactcggtctaccgcggtcctttaggttgacatgtggggtccgcatgtcaacagcgcagccttcctgtcttttccgggctagcgcttacacatgttttatagttgcaaaacctaattacaataatccgcaaatctccatataacagcattaaacttcggatgatcatatcttggtcatacgaactctgaatcgacccgttcaagtctcttaatgtttgttataacctaaagaaccctgtgctttctttttatgtattgttattgcttctttataggcttgtagctttgcttgtgtgcttcgcgtagctttcgtcgttccggaggtttccaaagcgtggttcgtggtcgtcgccgaaggttcggaaggccgttctctctgagcaaggcaagtcacatcatccttgaacatattgaatcccagtttgtaaaattatgttgatttaaattattgcattaccgctttatttaaattcccgcgttatcactgttttatctagccatgcctatttacctttgttatgaccttattattgttattgttattattattaccttgttcaccctagaataaataaaaccccaactagtgggtactctattcatggttccactagtataaatttaggtagatgcttcgctgattaattaggcaacattaggtggttttataattttagactttgggaattctcatatcatttggacactatggaatggttggcttatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggaataaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggctagggacgagctggaacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatttggtttgctagttcctggaaagacaacccttgctttgattgaaggaagtgagcggacaatactgttcctccaagtcagctcttaggatagggacagcctgttcgataatgcgaataatgatcctgctgtagatacggtacggctaacccaattgatcttctcatcggcttatttcatatccggaagtgagcacactagcgcgaaaggaaagaacttgcaacgaacaagcgacggattgccttccttcttccttgaaggttggacttactcgaaatactacatttcctgtttccgctaaccctgtttgttcgcatatcaggttcggcttgagcgcagacatcggatcgtattgatggatatcgcatgctagtgagtaaccctttttccctgtggtcgagctttctcccgtactgcttacatctctttagaaagcaatagatctgtcctccatctttcaaatgttcaatgaatgaactagatcgaatatagctagatttcatctcatctttcctttcaaactgattaataaagtaagaaacctattcatctatcctatccctcggcaaagcaaagcagacaaggagacctactagtagagagaggagaccttctagttgatctgcttggtcgctggatatgatcagttgcgcgatcagcacagtctttactatatattttgataagaggttgctagctagcaagtatagaaacaggagatatgcgtagttaacagaagcaagggaatatgcgtgagttgatttgatagtttttttgagaaaaagcaatttcatctcaagggaaaatgcattgcattttcaagggattgccaagctaggctagggatcgtccgcgggtatcagatcaggaatatcgtatttatctcttctaatctagatcccacttccctccacttcttgcctcacgcccgtcaaacctgactccacattaacgactgtccttccacccaattccccgcatccttgcatcacatctccaacccctgcctccacgcgatcttccacaatcgtaccccccacctctgaagcttgcataacccccgacgaacctgtctgcacctgcgggcccgcgcttacatcattggcatcgcatgattaaacatcagcacgcgcacttccctccgttttcgatgccgacagggggctgctagggggtgtaaagtttcgtttcggtcgtgtcagacgacatgcagggggggcaatggctgccaacggaatctataataattcgatactaggtcaactgtaccatcggacttgtaagaacatgtaaaatgtaccacacgaggttgtaccagctgtgtgcagtcctccggcacgggttaagtgtcctgcatagatcttcccctctctcccaaagaagagatgttcgcttcatagccttctcttccgagataaaccctacaaaggatcctaatcgtgctagcctttcatggactcttcttggatttcctttcagctgcgcccagcacctctctagtttctctacgagatggagatggctcattctctagttttcctacgagatataagtcagtttctatcgtactttgaagttcaggaaggagttattaattaagacgaagaagaactgggtggggatatgcctttcccataacaatagaaagaatcaaagccaatatacactataactatagagttttcgcctacctatgaaaaagtgagatgagagcttttaaatataagcataaacgaattcctagccgagccctatacttacctgcttgtacggtcaatgccctagtagacatcaacttgttcataaactccagccttatctactgcctttcgttgcttgacggcagatcgatctaatcctcggctccacgaagcgaaggccctgttcccagctaaaaacaaacctctctagtctaatagcaacaaacaaaacgaagactgatccccaaaagattgaagaaagcctgcagatatctaggttggaaagcgtacattccctttgtcagaggttagtggaggaggtaatggagtaggtgtttctggtcgtggcttcggtggtactggtcgcgggacgggaggtgccatttatagaaaagattggctacaatagcactttatgcacttcacttttggctattctacatgggcaaccctgggaaatgggcttcattcaagtcttggtcttttcggattcacttatttacgtgcattttcttaaggaaagagcctatctacccaaacctgatagatggatggaatgaacctagcatagcgaattcttgaagttgaatataagaaagaaagcctacaagtatagaaagaagtgctagtatcaaataaacataagtagttgagtcagcataagtagtttattgcttacgccctttgcttcttctttttctcctagatcctatattgcttcccccttatagtaatgattttcaggtcagtttgagttacacactaagctgcttattacaaaagggcaactcgcttacgatccaacatgccaagcctggtagcagaaaaggcatgcaacaaatacctagcttgaaaactagagtataaagtagtttagtgaaaaggaaagtagtttagaaattgttacaagaatgaaaacaaaaactattaataaactgaatgcaacaaagaatacaaagctaacacccgaggaaggaccgccgctcctttcatatgctaactttgccaatgcccttccttataaaatagacgtaataatctattaaataacattctggatagatagtccattcctttcttccaacgttgaactcttgactatgtttgtttgctggtgaaaaaaactgtttctaaaaagaataaggctggcagaaatgctaactaaagtcgtagtgaaagaccagttatgaaagaggaattcagtcaatccttccaatctagtatctataaaagaaagtaaagatgggatgggattagaagcactaatcaaaggagatttatttgctgtcatcgagcagggctgaatagatatctgttctgttggcgaatctcgggcatcttcacggctaagatcaaaagaagtgatttaattagtaaaagaaatcgatcactgcttggactccccgaatgggagttacttttcttttcttcatgcaacccctgcaaagtaaaggtgaacctaccttacccaataaggagtacggattacccgtgtaccgggcctagataatttctttaattcgctacaggtaagggttagcacaatactccctaagattcaatcccgcttccttgtgcggcttcgtcgaggaattacctcgttagcccacgtgaactagctatcagctattagatagcaataagaacacctttctttcgtaagaagggttaccgaatgattgggaggggaagtaagcttggagggttttaccagtgtgcggcatttaacaacatttgtaagtcgttccagctttccaaaaaacccagtctcgcagagcaccaattaactcttttaggccagtctcaggagtttatttatttgagcctctgtctcggataagattagtgcgagccacatccaaatacctcggtcaaattattctgtttattattatattaggccgcaggtggtagaatccctctgtctcacgagcaaaacagccaagtaagctaagtttggatctgataaggttgggttaaagccaaagtaaggaatgaatggagaagcacagtctggctctataagtaaggaaatatctctatccggttatttgtagtgaaaatcagtctcgaggggagcaagcaaactccaaattaatatgaatacgaacctggttcaacaagtcgaaagtcataggaacttagagattcggtttcttatgtaactcgcttgctagaaacaagtcttggatgccacaactccacatccagtcagtaagtctgtaagtaaggtaacttaagaaaagcgagccagataagattgttaagaatcaaagcgagtcctgcagatgattctgattttctagtaactggtcgtctgtacttaaatcgaatgaaacaagcgagcccacttcttacttcttgcaggtgtttgggaggcggctaagctacagaacttgtagttcaagtttacgagccagattggacggaaggagtataagattcagatttggagctaacgagcctagcaacagcttagttcttttgtaggtaatcgatcgaatccgcctagaccggggaagatttctaagaacgcaggtctagcattttaaacaacatttgccaatgcacaaagtatggtaagtaaggtaggcttagctgactgatgcttactaaatcgaaactttgacttctatattcaactcagtctttcccttaagatctctgctgttggagatagcgtgggcggcccctcacttttattcataactttgatggtacgaagtgcccagtaagcctggctggaagaaaggaatattaattacaaccacttgtatgcagcttagtcggactcaaaggatataagggaattggcgctcgctcggattcattttccaggtcctacatgttctaggactatagatgatccaacatgcctatagttttcattattgttttatgctttagcctccttttataagcacgcccatgcgagtcgatttcaagatgtcaactttgactatctttctcttcttactttacttatcccttacattactttacctagtaactttgaaataggcatatcttgtctaccttccatataccctagcatttctactagttgttttcttgcatatatccaacctgaaataccattgcttcttgtaggtttttacttctactttcttgactataattacctatacttgccatcccgtctttctattccttttgaaagtcaacttgtgactgacacagccttcgaagctatgaaaagacctattatgtatagagcttgacatgccaactactatagctatagtaagtacttctagctattcctacttgtttttttcctacttgactagtgctgacttacttctttgcctatgaaaattcttattattctccaaactgtggtatctgaaatgacccactttcctgagcaaaagaaagcttactacagcacggtcttacgtccaggaatggaacattccatctcttcttgtccactggtatagaaagaatatgcattttcttgacccaccgaatcctaatcctcatcttcaagggtccaccagggcttccaaagcgaaactatcctcggcaaagaacctaaggaattcctcgaatcgatagactttcgtacaacggcaaacagagagagggttttacgctacttcacagtcagaagcaagggtggaaggtataactctagccggcaggcaggagggaacgaagctctttcctgatcttgggctagaatccccgacgttggtagatttcgcagtggtgtagcttaggatcttaaaggtaagcagcagggttaatccctatcgaaggaatggggcttttcttcacttcagcacttcccctcgcagtggattccactaggttcttaacctcttcccaattcttaaactaaaacctgcgatgtctaatccaactcggcacctaaccagcttgtcagcatcgtaagtttgcctcaacattccccctagaaatagaataagaatgtaaatctactttcatttatttattagggatgagactttcttatatatttttataataagtatgctnnnnnnnnnnnnnnnnnnnnnnnnnnnnnnnnnnnnnnnnnnnnnnnnnnnnnnnnnnnnnnnnnnnnnnnnnacggtcggttcccggggagagggggaagggagaagcagggctcgaagaaaacgagccgtgcaaggacgcggggatatagcaagtaagctgcaaggttttccctttaggaccggctacaacaagctcgcgactctaatagaaacaaagggtcagctctctgctctatttgcttgcaatgcgttgcctatcaaagtcggcgaacgcttccaccccctcttgcccttgttacgcaacacgccaacaaagaaccttggttccgttgcgccctgtattccgaggcgaccatttcgcgcggttcgacccatttcccgatccgaaaaatccgataacgtacctatatgagtgggatggatggtaaatcatttgcagtctttttcggcaggacctagacacggaggttcgggaagtagcgcatgacagcattcactggtgaaaggactggcagcagcgagagcatcatagttgacatggtcggagctacagtccccatatccgtctctactctttctgtaattgactccctcccgctcccccttttcctttgaaatggttgagggatatgaatctggatcccgatcttgtctcacggactatcccgtagtggttctgtgaccgtcaattggatctatttctttcacacggtcaactggcattggtttaactaactggctggctgctattgattgatatcagagcccgagcctttgcccctttttgcatggtctacctcctatcggctactgaagcccgagtatcaaactactgaaagcggaggttcaaatacctcggtacctgcttgatggtgctggcagatcgactacttggtctggggggtttcgtatcaatccatgggggctttagtcatagcccccgcctctgctttgttcccgctctaggcttagaccatccttcgtcagtgcttcctgcgcttctgattatggagctgtacgaccttccgggtcaacgaatgaaatgaaacaactgcctctcccgtccatcaaaaagtgttatttcctccagctcccgactccgcttctccctccgatgccggtagattaattcattgacaaaacccattgattcaaagcaagaaaacggatgcgcgtgctaacgctttcgcgctagtgcgctcaatccgttgcttgtttggaacaagagttttcataaaatggttcttttatgcaattatgaacgggcaggcctcttgtggattcctccaactccatgaatgaaggggggagtatgaggaaggccgattttctttctatatgaagatgaaaaaaggatcagggtcaaacatttcttacttttgttgagtatgactgaatgaggaagagctccttatatggtatcactttaccaccatctgaaatgcgcgaaactccgattggtggaagccagtccatgaagattcccccttctcttacgtgaaattcccctctttcggtaagcatccagtatctcagcaaatgaacatttctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28339 - DNA, 1905 bp, Oryza sativa
cgatggagcttgtgttgcgtatacagtcgtatacacacatagtacggcgtacggcgatatcgacgtatatacggcgggccgggctacttggagcagcacttgtggcagtcgccggaccagtcgtcgcagcagatttgtcgtcgtatccgtcgcagtagtgcttgcagtcgccgccggaccagtcgcagcaccccttgcctttgcagacgtcctctttccccggagacgacggcgggggcggttcgtcctcgtggtccggcggcgacggcgacgggtcctcgtggtccggcggcgatggcgacgggtcgtgatcgccgccgtcgtgatcgtcatctgcatgcatatagacgacatatcaaatactaattaatactaaatgaatactatgaagaaggcatgcatgaacacaatacatgtagtagtatatcgtatcgtagtccctccgtttcataatgtaagtcattctagtatttttaatatccatattaatattattgttaatgaatctaaatagatatatatgtctagattcattaatatcaatataaatgtaacaaatactagaataatttatataaatgggagaaatactagaataatttatattgtgaaacggaggaagcagtatatatgtgtatgtgcaggagaaaatttaacgaaaaaatggatgtatatatatgcatgcagggtgtgtgctagctagctagctagctcacgtacgtgtttcttcggcggaggcgacgtggatgaaagcagcggcggcgagcaggagagtgaacaccagtaaagccaacttggacgatgccgccatggctgctagcttaagaccttaagtgatcttaattaattttcaactcacggtataattaattaggactggatcgcacaatctcgagtgtggtgagaagcctatgcgtgcaaaccaagcgtatttataggcaggatgaagccttcttatgagatttagggttctggtagtagtgcgttagttactagttgatgacacactgcgtcttctcatgtcgaccgattcaaggttatacgtatagcagaacatatataattaagctgactagcgaccagctataagagcatccacaatagtaaagtaaggtgctctctataaaacatgtatatttcagcaatagactcgattaatagtaaaccaccttaatagtatgtctatattggtatctatatctctctcattcattgcctcgtttttctctatagactatctttaagttagtagatagctttgctctctctctctcttcatttaatacctttcaagtaggaaaatatgctgacatggatctcttgtagagagcctatagataaccattgtgggtgccctaaccgttttgccattctgattaccgcattaatccccggttgccgattactccctcgttccattgttccattttaattaattgcagttataaatttttatgtctaacatttgatcgcttgtcttattaaacttttttataattagtattttaattgttattagatgataaaatataaatagtactttatgctcaacttatttttaattttttttaataaaatttttaaataagacggatggttaaatgttgggtgcggaaaatcagaaccacacgagaaatgagtgggaggagtacattattcataaaaggtcaactttacgatggcccggccaccaatgtcaacaactaatcacgccataggcatgcccatttgcatcaaatatatatgtcatatgaaagcaaaattcgtggaaaccccaagcccacatgtctgtttagaatattttagcttttcaaaccaaacaccaccagtacaagtgtgagtgtgtgacgccataggagaagggcgattttatttgggcgcgcgtaggattaatttcattcgccg

SEQ ID NO: 28340 - DNA, 5440 bp, Oryza sativa
  unsure (1)..(5440): unsure at all n locations
actcgcacgaagaaccccgccttttcattttttggcatacgtatgttttgtcggcttatctactttcttttttatgtaaatgtcggtttaataatttttttactatataggctaaatctagattggttttatgcatacttctttttcctttttggcttgatttttccatgggctcagtaattttggcctatttattttcttcaacttttttactttttaagtttgtttttaattttatacgtgtaaaatttatatatacaatacaaaatttatacattaacatgtaaacttatatacatgtatacatagtttttatacatatatacatatatacatatatacatatatatatatatacatatatatacatatatatatatataattctttatagtgtgtaatataaatttatacatataaaaaattgtataagtgtatatgtaccaagtatatacacaaatattttatatatacgcatataaatttatatatacattatatatatacacaaatttatatactttgtatgcatatgcatatacgtatacgtaatagaggtggagctggttgcgtatcaacggcctcctccttagtgatgggcttgtacatatggatttgatttggactgttgaggatttattgggagcatggcccatttcttcagcccaaaacaacaattatctgtggcaccttgcaaacttacaatttgagaagttgagaaagtatttctgggtatgtagctggagcgctaaatatgcatgcttatatttttgaataaagggagtagtcgagtagattaatatggtatagtgatgtatgttactaagactaatactcaggtgtatataaaagtacatgcaaataataattgagggctactacataatgctatatcgtttcgataaaaaagaatatgtaatacttataatgctatttccttaggtatcagatgtggtatctatgatactagataggtatatcgaatatgataccgtgataccggacgtaatactcatatcatgatgatgtcagcatgacaccataggtatcagatcatgacatcaactattttatttgaactgtatacatttttctagtaattttgaataatatttaattaaggagaagtgtttatttatgaaccaccatgtgtgatctgcttcatatgagttgtacggagctcgctccatcggcctacggcgagcagcactcgccggaccagtcgcatcagtcctagacacccttgcatgggcagcatggcggcggcggcggtggtttgccatatccaccgcctccgccgtagtacggcgacggtggcgggtcgtagtagtccggtgatggcggcgggtcgtagtagtccggtgagtgcggcgggtcatagtagtccggcatggcggtgggtcgtagtattcaggggagggcggtgggtcttcgtggtccggcgactccggcggattgtcaccgtcgtcatctgcagcattaattgggagcacgcgttacctacatattaaatgcaaaaacaaatatgtacttcctccgtttcacaatgtaagtcattctattattttctatattcatattggtattaatgaatctagatagatgtatatgtctagattcattaacatcactatgaatatgagaaatgttagaatgacttacatcgtgaaacggagagagtacgtgcctatgttcaagttcatcaaaccgacgagcacaatatataattcatcgatgagccggttcgttaaatttttttttgaaaaaagatgaaattatgcatgcatgtgtgtgtgtgtgtgagaaaaacgatcgaattgattaagaaaatatttcaactccagtatgaaaatcaaactaaattatatgcacgaattaatgaggtacggtgtgtcggtgtgtgctcacgagtttgttcggcagaagcgacgaaagcagcagcgagcaggagagcgaaaacaagcaaagccttggacgacgacgacgaggaggacgacgccatgtattcttttaatttctctcctcacgaagtgaagatatatgtaatcgaaattgctagtttaatttgaactatttcgagtgtgtgatgagaatcgatcgataacgtaactagacgtgtttatataggcaggatgaggcacatacatgtgatctagtactgtatacgtactcttagtagatgacgaaccggtgcttaattttgagcttcttgacgccgtcgatcgaccgattcaaggtaaagaaatatgtactgtaatatactagcaggctaataactgcatgcaagtacttcatatatgcaagtacgcttggcatctaccatacgtacgtgctcgttcgattcaccggaaattaatcgagttgcaaattaagtgaaagtcaatcgttcgatttgatcgatttaaccacaaatggaggtgctcagctacaaaagcaaactccattatatttggcagggccgtcggccacaaatgtgccaagtttagttaattcatcctcacaatatgtacacatataatttctggatatatatatgtcactatttaagcgaagttcatggaaacccaagtacgcacatttctattttccagaccaaaataaacgtaagataagatatgaggtggccttagataaaaagggggaaaaactaggagtagctagctagtccagattgagcgatccatccgtgaggaggcgtacgttatggacattcgtgagattgcttatgaggtggggagcgggctatcaattcgtcgatcgatccttgtgttatgaaaaggtttagctgcttctcacattttggatagataggacacaaacattttctccaacaaaagttggattaaatttggatactcgtagcacgtttttcaaactgctaaacggtacgtttcgtgcgaaattttctatataaaagttgttctaaaatatcatattaatatatttttcaagtttgtaattaataattaaaactcaattagtcacacgttattacaacctcgttttacgtgaaacacttaatttttatcttcatctatatcttcaggacatttaaacaccaccataagctcgatcctgtaggccaactaggccgaagaaggtcaactctaaagaacgtttctatgagaacgctgacccacaaaagttgtctaggctagacaggttacgaaatgacaagtataccatgtaaatgttcctatcaaagagatgattatgtaaaacccaacataaacaaaacactagagtttgcttcagatgcttgtaagttataaatagactccaagatatgatttttattgcctttatatacttagagataagtgtttgtctttccacaacactcgtaatgatcactgtaaagaaaaaaaaaagtataaacactactccctccatcccataaaaaaaccaatatagaaccggatgtgacatattctaatacgatgaatttgaatattctaatacaatgaatttgaatagatgtatgtctaaattcgtagtatatggatatgtcacaggtactagtaggttttttatgggacggaggaagtagaacgtagctaggcttaggacaactagaatctgagtcctaggcttagcttcttaatccccatgcaaattttataaaaatataatgtaatttttaaaggttgtcaagactatattagcatatctagactgtcaaagtacaataatattttttttccctagtaggtgtagatatctagtagctcagctctccgtatatacatatctagactgccaaagtacaataatatattctttttaaaaaatatatattggtcctactatatatgtggtcataggccttcccgaaaggccgaaagtgtacacatctcaaaattaatgattttgacttgatgatctccataatgaacatctctctcaaactctcagtcatcttgttgacatacaatgggatatctatgtaaataataactaatataatcttatgtctcacgccccagcccttgtgacctgttcaatcgtatctagtaggtgtagggaataagatcgacagacgcaatctctctccgaatacgcgaatattagagaataattaaatatcaaataattagattttaaactcagatcgtctagtgtatcattttatgaagctagccgaaagatgtctgatgtttcttcagtaagtcagggcagaacattgaaacaagcaaagccaaagttaatattcttcaaagtaattaatgagcaagtgacgttttataattcctctatatttgactatgtcatcataatttgtcaagtgtgtttttctcgctagctcaccgttttttaataatagatattttattaaaccggcatcgatatctgcaaagggtacacagccaacctagcttaacggaaatatatatccacaaaggaggcgcgcggggaggaccgcgagcggtggttccagtggcgggaggtgcgtgggctgcggatcggtggctggaggcggatccgacgacagggaggtattcgggtggtgaatttggtggtggggaggcccacaggtgggccgacggagctcgggcgcgcctgtcgatgggtgatgaagctcaggcggcgacggagcttggccgtggctaaggttatgagcgggtggcgacgacgaggcttgcaggcgtgggtcctacggtgtgttggcaacaacaagtacaaagattcngcgacgtggacctcgacctccttcctccgcgccggcaggagatgctctacactagtgtccaagtgccgctgtgggggtcgattggtgaatctttagtgtgttgcatgcatgttgtggtttgtgattcttgaattgtgattggggatgggagaatccgatgtttgattgtgaatttgttattgtgggattagatgcaaattcatagaatctgcgattgtgggatgtgatgtttgatttggatttgtgattgcgggattaatgacaaactgatgtagattgtgaatctggttttggaggttctaaaaataaaatttaatatttttgccggtcgattttttttagccaaaaatctctttgctggcggtccgtataatgtagccgccattgaaaactgtttttcgcaagccgataaggcccacctacgatgattatctattttcattgaccctgatcacatgcggatagagagtccgctggtgaaaatgtgttatggccattaggaaaaatggattttgtaataatgacaagccatcgtcatttcacgacctctcccgagaaaaccaaagaaaactaattagtactccctatgcatgacatcgttgacttttagatgacattcgattattttccttattaaaaatattatataaatatcatttattttgttatgacttcttttatcataaagaaattatagtataaacttacacttttacttttacatatttatactaaaattttgtataagat

SEQ ID NO: 28341 - DNA, 1128 bp, Oryza sativa
ctgttcccataaaattactatcatggatgttcattatattggtaggtaaaaaaattactatcatcactacaagaaacttgttaatccgtgatggattctccgtgacggatttacggatcgtcactgacagacatactccgtgacgatattttgtttttcgtcacagatgagcccagtggatattcacagcccacaaactcgtgacggttttatcaggaccgtcacaatgtatgattttaaattcgtcatactctagttagcctagaaaaataaaaaacaatgtatgattttaaattcgtcatactctagttagcctagaaaaataaaaaaattgtagcgcaaagaaaaacaaaaaatatgattgcaagaagaatcaaaatatttgttaaatttgaacataatatttttgttgatttgttacgtgtatataatggtttgttaaatttgaacaaaataattttattaatttgttacatgtgtatgatgcataatatggcaaactaaaaaaatattgtgcgcatgcggaaaaaatcaaaatatttttgttaatttgttacatgtatatgatgatttgttaaatttgaacaaaataattttgttaatttgttacatgtatatgatgcataatatggcaaactaaaaaaatatggtgcgcatgggggaaaaatccgcagcatgtgggatttgaacccacattgagcaggaaggtaggaaatatgttaccaattgaaccactgttgtagatgtccacttctgcactatatatttttatttatttattattggcccagcatccctgttggcgtggcccattaatgccattcactcgagttgagttggtccaggatgttgcccacagtctggcccagcagctggagttggcatttcgaaaatggggcccagcagccggagttggcatttcgaaaagaaaaaaagaactcgaatttgtaaaatagaagaaaaaaatgcaaccaacgagaatcgaacccatgacctactagtagaaggggccccatcctaccactgcgctagttggtttgatgtgttattgtaggattctgtactctttttgacctgtgtatgtatggaggagtaaggtttcctcaaccgtgactcagttattcagtt

SEQ ID NO: 28342 - DNA, 859 bp, Oryza sativa
cattggctcattgtcatttccttaatttatttttcattgacccaagcatttgtttttgcattactacttagtcaaagaaataaaaagaactaccgatattctctctgtaaagctattggataaccatctacttaaatgaatatttatttctgataaagtgataatgcatctcacattcctgaaggacgcagaggaaacccatgacagtaattgtcattaacaaccatggtggtgcaatcttcagccttctaccagttgcaaaaacagcttcactccaaattttggagaaatttttctacaccttgcatgacatatcgatttccaaactctgtgctgcacacaggtaaaagcgattgttgtattctggtgcttacatacctcggccttgcttatagaaatacaattttaacaatatgcctgcctgatgctaacgtagcatcgctgttactgattctgggatttattagatgttttctgctgagacttctgcctgttacattattggttatggagtcagctgtggatacaacaaataactttctggtggcaattttgcatccccagcattctcatgagttgtatttcaggataaaacatattctagttcagacaaaagctgaacttcatgatgccttagtgaagtcccatgaggggcatgttgattgtgttgtcgaagtggagaatcgcattgttgataatgccaactttcataggttttatattcaaactagttcttttgattattttggtctacatcgcgtttatatgctcattctcattctgcagaattataagcatgttcacagaccatagtgcaaccatgcatctggcatatcttctgggaggtccatattgtaag

SEQ ID NO: 28343 - DNA, 1494 bp, Oryza sativa
cttttattaagtattaatttttaaccttgtaaaataacaggtggcaccaattgaaattcatgaggaggatctgttggatgttgaagaacagcttaggtttctctttcacagaatgaaagatgctgagctagatgttgttcctttgttgagaggatccttctccaattggatatggacaacccttgggattcctgtaagttgacttaagaaaattttctgtgaaaaacatacgagagactgatatttttccgcgtgttcttcttcacagccttcttcagtattccctagtgttaagtgtggtctagagatggctattcttaatttgctggagtcacaacgaatagatagatcctatggtatttttactggctccaatgtggtcgaatataatcagagcagcactgcaaacatacagatatgtgcactcgtagactcctgtggcactccaatggatgtaacacttgctgttgtcaaacttgttgctgaaggtttcaccaccgttaaactgaaggtaaatcttctaccagttcagtaattataggaagttgaatttattagcttctaaaagaatctgtacattgcttctttttaaaatctcccaaaggttgggcgtcgcgaaaatcccgctgaagatgcagctgttattcaaaaagtaagggaaattgtaggatacaagatcaatatccgtgctgacgcaaataggaaatggacatatgaacaggcaattgattttggatccagggtaaaaggcttatgtttgcaatacatcgaggtaatctgccttttattcatctgatatgcatcgaaaatctaaaatagacaaagcattaaatttgtacccagcatatcataatactggttggggaagagactgtttttcatgcagttcttccttgagagtcttcatttgttttaaccacaggaaccagtggactctgtaaatgacatcatcaagttctgtgaaaatagtggcttgcctgttgcactagacgagactatcgaccacccttacaggggatgtaatccctaagctacatcaattttcacatccagagaatagttgctcttgtgagttcaaactttacgggctagttttcaagctgatgcttcattttctagatttgacctcattttcatgttgatattcaggttataaaccccagtgttgttggtggctttgagactgcagcttatatagcaaaatgggctcacatgcatgataagatggctgtcatcagtagcacttatgagagttctgtaggtttggcaccctatatacagtttgcacattatgttgccagacaaaatgacataacatccagaataaagaacagaggttcttgtgaaatgtggcacatggacttggaacataccaatggttaagggaagatgtttcagatcaaaagttaaaaatccatgcgccaccacttggtgatggaatcagagcttcggcagaagatgcccatggctatctccagcatttagttataaacg

SEQ ID NO: 28344 - DNA, 5194 bp, Oryza sativa
acatgtaagatttcttcaattttcttttgaaaaccaacagtttattaccagcttgttatataagagggtttagattagtgctcagagtctgacacgagatccatggctagatatttgcagtatgagagcaaattagatgattaagttgcaaacagcaggagctattgctagtagcatattaactggaatatattgctaagcatatcatagtttcaaaagatggaattcttttaatcgacatgtatcctactttactcgggatttaaggaggtatgctgtagaccgcggaactatcacaaaggtctgcagaatattgttcacgtattgatttaaaactactgttcttagtactaacagttaaaattcaagtgaaaacattattatctccatatgaatgattcaataatatatttgataggtccttggttcatttcttgaaggaagcacattcataattacatgttttctcttgagtttgtctttcttgctaattatgatgttatctgttttctattcacatcattcaatcaatggacaagtttcatacattctgggagtgctttgacgctctcttttcatttgtgtgccttgttcctaatctcagtaatagttaaatttctgcttatgtttttactcctttgattttggttgtccagttatccacttaaaaaccagatgcaagcatatgttcaattatctaagttttacttgcactgtatacttgagatactggtagtttctccgtatgtagtaagatggtgctgtcacagtaactattgtcatgatttaaccaatgtaggaaaaggttattctctttcttcatggatttcttggtacgagtgaagactgggttccaatgatgaaagctctctctcctagtgcacgggttatagctgtcgatcttcctggccatggcgagtccgaaattctacagcatgatgttgaaaactccaaccaaatctccttttcagttcaatcagttgcagatttgttactgaagttgataagaaatataactgatggagcggtggttgttgttggctactcaatgggtgcaaggattgcactacacatggcattaaatcaaaaccacaaggtaaatttctcgacattgtaccttttgtgtttatttctttatttttatgattctaacgcagtcccgttaagacagataagtggagctgttataatttcgggtagtcctggattgagagacgaggcaagtaaaagacgtcgtagtgctattgatagatcaagagcccacttcttgtcttcttgtggactggaaaattttctcgagacgtggtactctgcgaaaatgtgggccaggtaatattgttatgcagtgacaatatacttttgttttgccaaaaatgtattgacatgccttttttcttttccttttctgggatattttctgttgatggatgaccaaatttacagtttacgagaacatcctaaatttgattctctagtgaggacacgaatgaaacacaataatatcaaagctctatctaaggttctcgctgactcaagcatagggacgcaaaagtaaggcttgccttcccatactccgtattatatttttcattgatgatatccataaagtcatgttccatcgagtccgttagtaattttgacgttaatagtggtaaaaaatatagtgtgccgatgatacatatagagcctgtgaacactttgatggtcatattacattagtgattgtgtaataagaaaatcatgtgtgattcgatctcatgttagtttcaatgttctaggtccctgtgggaagatttgaagcacttgaagagccctctcctcatcgtcgcaggtgaaaaggacccaaaattcaaagagatatcgcagcaaatgtgcagggagataagaaagcacaaggatcgcgaatccgatggtctatgtgagatgatcattattccagacagcggccacgccgtgcacgttgagaaccctcttcctttagttagagcaatcaggaagttcttggtaagggatataccagacgtgatatccaagtagattacgaaatggaattatctatgtagaggagttcaagttacagcgatagccagagacagcagagcagaccaactctttggtgcggatgggtgcggcagttctggatgctattctgccgccggtagtctcacctacaccagcccgggaactattctcattgtggactggtgggggaggattaaagattagatccagagagaagggatgtgactccattatcatgcaaagttcctaaccatgtgacagacttggtaaggaaagaacgcaatgcgagggtcttcagagatgaagattcttccctccacgagtagcaggaaaaatcatcattgatgagcttcacgtatagcggtataggagtacttgtgaggacgaattctaggagtacttgtgtgctgcagcattgtcccgagctgtacagtgctcttttcatattttgctgctctgtatatgctgttgcctgtgggttagttgccactctctttcgccgggacccttttttattaatacaaaatgatatgcaagtcctatgcatatccgtgaaaaaaacatgttggccagcttcacatccgagctgagcttctgacacagtgacactactggggaaccctttgcaaaccgagatatctaatccgggactaagatatctcgaatggtgttgtcaatcgggactaaaggtatttttttccttttttttcattgtttattactacttgcatattacccaaatccgattgaacgtacatactcaacaacaatttgataccacagattgaatgaacatattcaacaaccaaatcatacctaactcattgctatgcacaactcctaagctgggtttggataaccaagccttttttacaaaagtttctatacgaaagttgctttaaaaatcaaattaattctttttgaaaaaaatagctaatacttaattaataccgcgctaataacccgctccgttttccgtgtgagagggatcagttcccatcactggaatccgaacacatccctagtctcacttgcaaaaaggggactaatttgcagctacacttcttcaaacagaagattaattatatacatgaacattaattctgaactacagtccttcagaaaataagaaaaagagaagagaagaacaaagaaagaaggagagctcctggccgcgctcgccgcgatgctgttcgttcgcgccatcgccggcccgggcccggcgctcctccctcctgtcaaggacgaggatgccgacggcgatggcaacccggaggccagcggggaaggaggcggagtgcctccggtgacgataaggtgggcccgcatcacctgtgccgcctcccacccgccgacgcctgccaccgcccgctgctgacgccgccgacagaggggaaggggaggaggggagagcggtgtcgccgcttgccgcccgctgctgacggagaggggagggcgctgtcgccgctcgccgcccactgccgacactgcgacggcagaaacgggaaggggaggagaggggcgggggaggcctaacatgttgattgctaccggttaaaccgcagtagtcctgccgtagactgctcgccaattgtcggtctgaccatcgggatccaaaaatcacatatcgacgagacgaaactcttgaaagtagatcaactttattgcatcaatatgtgtttacaaagtgtatctaaagcactcctctgtcaactagtattgaagcctcgaagcaaaactataacttttctctcctaaaaaattgatatacttctagcatcaacccctcatctatttatatcctcaacgtggctacccctagccacaaatcctacaagaactagaattcccaatcacataggaaacctactcaacaaggtaaacaacattctcatacaactccgcgctctaatctttctaaacttggacctcttcccatacgtacacaacactatgtatatactttatggaaaccttcactccacatgcatggtttctagcctaagcatcctgtgtgatatgaccatttggacctcaatttcttccaagcctagtcctgatccattaccgactatactcacataacctcaagcaacacctgcacataaacaacaaagagactctctgtattcgagtataagttcgcaccaacttgactcatatcagcataaaatagtatcacatacaaaaagaaacatctaaaagtcataaacatgaagcaatttagaaatcccacgaaaacaacccgaaaccaactacaacccagagtctgctggtctaaccgccgggctatccaacacctccggtctgaccgaccacccattgctgactgcactattcaccgaccgaaaacattattcactgtattttcaataaacacttacttttgacaattgtttatcacatagattaaatcaacacattaatttcacagtaccaatcgcctacaactacaataacactgctgatcacctaggtataaagcaacacatcattatggactttaaatgggatatggtgttacaatctcatctgctcaaagctgatcgaacaaatgaagtttgcagttgtaaagctagaaatgaatctgcttgatttgtgcaataaaactatgctcgaaaccacttgctccatgtgttttccgccttccgtttgcaatggtactgttgctaccaagttgccgcggtcggttacttttgtgggttaaaaccgtgtcggaattcgtaataaccagccgactgcacgcagagagaggcatctcacacctccgccttctgtgacttctgtcccgattcctgaatgttggtttttcaaaacttcctaggggtgcgagtcttgatccatcccgggtgccccttgccttggatcctggtcttttaacactagtgtcagtgccgtagaatcgctctacaacttccctctttttataaacgagaaaacctgccgccgcgcaggcgcaaccatgtgagaagtgttgcccagtcacacgctcacacacgccctgatcccaacacaaaatttttcatcctgtcatatcgaacatttaaacacatgtatgaagtattaaatatatgttaagtaactaattacacagattacaactaatttacgagacgaaccttttaagcctaattgctctataatttgagaatgtgatgttacagtaaacata

SEQ ID NO: 28345 - DNA, 6118 bp, Oryza sativa
cgccttcctctcagctgactgacaaattaagcggctaagcatttgccttcctataaagatcttactactcgatctaagcccccctctcctctgtacactgttaattttctcactcactgactgaccaagctagctaagctagagcagaagagcgtagtgcatccagagaaaagaagcacgtacgccaagattggagttcagttcatgttcatcatgagttgccgaaggacttcgagtcttcttgtgatcgccttggtcatctccttgctcttacttgaccgtcccattgctcacgcacgccattgtaagttcatattcatctttgcagcaattaattgttaccatagtttttctctgagaaaagcaccatgaaatttgtggcaggagcatttccctttttctttcttcgtatgttcaactattgttgattttaaccagtattactatcttttttgcagtgaagaacacgtccatgtcgagccgtggttcatcaacagaaagaggattagaagattcaaagaagaagctcgatgagagaagaccaagaaggttgaagccgtgcaagttggatcaaactctgtccatggagggagcccggatgttcatcagtttgcgaagatagtagtggttgaacgccggggaccaacgcctcaccctaagaagcacaacttatgagtatagatagccaagatagatggatatatagctgccaagttcatcccgctgtatctattttgatttagactagcttttctttttctcagttttatctttctctccctaggctaagataggagaggagtgaccaaactccatagatcatagctagtagtgtactactttccagcagcacgtcgttgagaaattaacctcaataaagatgtcacatatagcatcttttcaattttgtagcctgtatttgactactgatttttcaatttatttagaattttttttgaaggattcaggggtatccgatccatggcgttctcttgagtccagagagtatttgactacggaattctcaatttatttagaaaatttttgaatatggaagggaggaaaaaactagaattttttttttgaagaattgatggatacccaaatatccaatgcgtcctcaagtccatgttgagagggagattgacaactgatttctctaagatttttctaaataaattagagcctcttaagagggggataaaaaaaagttgagagttggtaaagagggggtcaaagtgcgcgagccctttttgccccccacaagagagaaataagttcactttgggtccctctattttttgtccgggtatgatccgtcccccaacttacgaaaaccgggcaaacgtgatccctcagcggttttggctggcgtgacgcatacgtgacttgtttgaataggtctttcgtcccacgtggcattgacgtggcgcttacgtggcaattatatctaaaaaaaataataaaaaacgtggccccacatgtcagctgcacaaaaaaataattttaaaattgtgggggccatgtgggccccacgtgtcagtctcactcctctcttcttccctctcccttctctctcttcttccctttcccctctctctttctctttctcaggcagaggacggcgcgggtgggcggcggagcaggcgagctccggcggcggcggtggccgtggtcggcgccgccgctccgcgtgaaggcgagcagcgcggcggcgccctagacgccatcgacgctgccatccatgtcgccgccgccgaccacccggacgccctccgcgcgcgccgggacggcattgccaagcgcctctacaccgcgctcgtcatgctcccgccgctgcttgccgccgctccacaagccgtctacgccgcgctctcccctcccgacgccgtgctccgtctcctcgcctccctcccctgcgcccccaattccttcatgctcaacaccacgctccgtgccctcgccttctcccccaacccggcctccgccctcagcttcttctccctgtccgccgcgacagcggcaacagcagcggcagcggcggctcgtactcccctcactcccttcccgggcacgcgcgtatggaaaggggaagaggaacgaaggagctagagccgtgccgagctccctcctctcccgccggcgagctagaagggcggcggacggctaggcgagctccctggcctaccggcgagcgcgcgggcgtcgctccctcctctcccgccggcgccacacctgtgcgtcagccatccgtgtgcggtccgtgcgaggcgccgctccaggcgtgcaggcttccacgcgcctccttcctcgctcgccgtcgccctcccttccactggtaagtgattcgctctgctccatgtgcgtgagtggcttcgagttcgagatggcaaatttgagtaaattccggagctcttgaacttttgaaattggtccgattctacgtgccttgttcttaatcgaagtgtggtttcaatgtacgcgtgtgtttctgacagttcggtggattggaggaagggaattggtttgaactttgaactaacttggagtccctcggttggatttgagcatctgtgatgaagcagtggagaatcgcctcataaattgcttgtctatgtttgcattgcggtgatttgaaccttgctgctgtgatttcagtttggttattaggcgatcgcaacataacccagtgaagcaattctggtgctgctgtttgaatcctctagctctggattgtggttaactcttccattctgtcgcatttggccaactgaattgcctgttctgtttgcgtttctgcattgcagtatgtgaatctcgttgctgtgaactcaatttggtttgaagtgatcgatcgtggtcacaacttaatccatctgttgcgcaagagagagatggccgcctctgccccacgcgcctcgcgtgccgccgcgcacgccatcgcccgccgccagccatgcgctgtacatcgccggcgccgcctaccgccgccgcgccgcccgtcgtgctggacgccgcccggcgagaggagggagcagagagatgggaggagctggagagaggaggaagaagaggattggatttgatcatttgggaatgacatgtcatttgggcccctccatatttatttttaaattattttttctatggttgaattgtgggaccacgatttttattacttttccaatatacaattgccacatcagcgccacgtggaacggagaactagtctaacaatccacgtcaaccaaaaccaccgagagaacttgtttgcacggttatggaaagttgggggacggggcgtagcccggattgggcgacaaataaagaactaaagtgaacttattcccacaagagaaggctcctcgtctccttactacgtggaagcccgcacctgtggctaaagcgcaacccaaagtacactcgtaaagcggtgcgagaacacatatacacagccgcctcccgcctcccccccatttatatccacacttgcaaacgggctcgcgaattatcacgatgaactccgctaagtggtaagctcagcatgtgagagttatttctgtccacagacccgcgacaagcacgcgaaatatcacgatgactgctttaaagttagtgggctgtgcgggggtaaaaagtttattttctctggggcctttatttttttgacatgggctctaccgacactgaccccgggagcaatgcctgccttgggtaacttagacccaggacgagagactagcgcccccacggatatccgactcgttaccaactctgccctccaaagaagctggagtttaaggcccgcgctaccaggcccggcgatggagactccggggcgcactcctttatcctgggggacgcgctccacggcgagcggtatggtactaaaaaataataggggcggcggtgaaaaaaggagacgtgccaccggaacggtgagagaagcgcttcccctctcccctcccagtcccagtcccatcgcgacatcgcgtgatgaactgatgatcgccccagtttcagattccagcactttggtcgcagtttcagaaaaccagatgtcagttcagacttcagaattcagaccggaagacgaatattggtatgatgaagagaaaaggaatacgttctagctcctcaaaggctcaaaccagcaaagatcaacacaaactaatttttttttacagatagcaatgcaatccaatgatccatcaccccctaggctacacgctatttatacacctcttcactcctcttctcgctcacggtacagagttacaagccactgacaaaaccgacaagccatcttacctgctacaggaccaacaaaaaaaagaagcaggtatacatatatggcgtgcaaatcagacacttcggtggagttacagatagatttcgaccgacttcagcagcgcatcagaatttcaaagattcttcaggaggtataaaaaaaggggatgctcaaaatttccagcagaggaagcccttattccagccacggcgccgcttgtttcgcctccgatccgttctcgccatcctcaccgggctgctgttccaatcccactgtaacctgttcatccaccaaagcagcacatacctcccaactttcagttttgagacaaaagttgttcatgaacacaaaagaaggtttaagtttatagttgtaacatgacagagtggatgaggatggatgcttacactggaaatgcgaaggaccgggtgcttgtcgtgctactatctgaccggatggagatgttgccaatgtgaccagaggtcgacactgggttgcacatgatgctaggcccaagagagcatggctcaaggggatacccattgccaatcagagattttccctttgcattattatcaggcacatctagttcatccacatgagtggaatccttttgcgcatcggtagaactcgtgctaattctgccatcgtttgttgcgtctgcgcagctctctgaatctgtctggttgaaatcatgcacatcagtagcaccatcgttgtcagagttcttgttgttcatctgcctatttgcatcactggactctacaacatgaggtgatgaggatgtggccactgcattttcatcctgtggatccgctatcggctcgctggtgaagctttcggggtggtcgttgctcttttcggatggttggacttctgaagaactacttgatgtcagagcatcaggcatggcttctgctgttccaacttcgttaaattgtttggagccaattaaaccgtcagtagtctcagcagtggacatgggtttatctaatgctgcggttgcatcatgtctgtcagatattgttgctgatgaaccgttggtgttattgatacttgatacgttgctagtaataagttcatcagtttttgatgcagttgcaacatcattgcagtcatttgtggaaacctgcaatgtggtgtcaaacctgtttgtcagtctaaaaaaccaatctaaggatgattgaacttctcataactatataattcaagttatcacccaaaagagtagggtcaggtaataaaaaaataataatgacaaacctggtgatagtggtaatgagaaaacaaatttgattacagattaagccagtaacttatgtggttacctgtgcaatagcctcttcatgaacagggggcatgtttttttcatttattgcagaagttgtgctttgatgctgggtctgggattcttctgcactttcaagtttaagtctttccgtggattcttctgcactttcaagcttaagtaactcatgcaaacttattttcttctcactgatatcactagcagtatccctgctttcaagatcacattgtttctccgtgttatcgtcagcagcgaatccaacaggtaggagaacagtttttggtttctgtccatgtgcatattttttagcatcacctttccccccatatgttagatcactattcgtgtctatcattaggaaatcaaaattggtggtgacttctcatctaactttttttctgctgaaattttccgatgcggaagtactccttcatcgatgcagacatccttgacaaaattgccaccataatcagaagtaaccacagtatctggcaattttatctccaaaacatccttgt

SEQ ID NO: 28346 - DNA, 5243 bp, Oryza sativa
  unsure (1)..(5243): unsure at all n locations
actttcacaaggcaaaaaaatatatttttaaataaatgtcatgctagcataccaagttatcttttttgacatataacccaagactgactactaatacacgatgaaacatcatttgggcaatcctacagaatggaatgtaaattcaacctaattaagatctctagcattgtcctcttccattttggttgctaaatcacttttaatcagttataagcattaaattttcctgtagtgacttgtgactgcaaactgccatcttcctaaaatatagtatatgaagaccatgatagggacaattctccccccagtctgaaactctgaacaaagaagctggtggactggtggtagtcttggtggaaccaacgtatatataagcataagaccacgtcaagacattgatttttcattatgagtatcatgccttcccacttaacaaatcaatttttgacaggtagagctgcaaggcctgcaaccgagatcgatcgagaccccgaatacacacaattggatccttttctcactcttaagaaaaggccatatcccctttcagtgtccacaagttgctgaaaaaaaaatgtagactttcattttgattgggatcaagttgaatttctgcattattattactaaaagtggttttcagtttttgtaaacaggctacagctatggagtcaacagagtaggttttaggtagtgaataatcagtgttcgcaactaacgatgaatcacttgctggatatcctaatttttaagtagcagttgactaccctagctactctcaacacagcagttgactgcacaatttcttacagcttacaagaacaaagaatattggcacccttactaaccaagcaaagttaacttgaaagtaaaaaaataatcctaaattttatcccagccacagtgatgtattgaccgtactagaaaacagttggtgttcttacctactgtgagtagacaagggtgcaactgaaaaggtcacctagtttcacgatatagatgcagatcttatggagaaaagaattgcttatgtcctgcatgcgaaagaggtataataagatgggaacaacggttaagcagcagcaatatgagttctaataattacattgaatggataaactcgaacaacttaatataatcagaaaagttactgcaagtattatttttttctgtggatattgacaatattactagcaacaaggaatgctgattattattattattttttgtaaactccatgctctcgcattatgttaacaaatccggtcaaaataaaatgaagaaaattaacacgaaatcttgaaagctgtcctgacgcaatgaagcatctcacgtcctttgatgagctagtagtagcctagtacaaaccgcaacatcaacagaaaaaaacatacacaacaagcatactcatctccaacacaaaatgaagaaacgtacggtttaagcatgctaggcatattagatttttcccaacagatggcctcgaaaatactacctcgatcgaaaatcgaaatagttggttgggattggaaccaattctcctttctctctctggaaattaacatacagcctctaccatctgtttcagacttcagatgagggaaaacaaacgacactgcaatctattaacccaaaatttttcaagatttaaacttcctgtccaattatttaaacatatttttttctaacataaaactgccggtttatttgcatgatacggagtacggagatgcgccatcaattggtgcttctcctcgtcctagacatacagtacaatacagacactgtctcctactactcgtcaagaacagtttagaacacattacgcaacaacaaaatacgcagaaataaatcaaaacaagaatacatcgatcgggtctacggccacagattcaagaagctggcaggaaacgagaggaaaaattaatggacattaactacatggagcaggcgttgtctgcagctaggtggcgccctctccccacacacaccgcagttactacggcacaggccggcaggcaggaaagggagagcttaaccagcaagcatgaggagacgcaggaaaaaaaagaagaagaaaagattgctgctttgatcttgatgaaattcatatgagatgctcatgaacaaaagtttttttgaaactatgttgctttttactctgtccaagcccacatcagtttttcttttaaaaaaaatcagagtggagtaagtgagtttgacaagagagaaatttacagtagatgatgaggaaagaagaatcaaaagcaccaagaactcatcaacagaagattagaacgaaagatatgagcatagcgatcaaaagaaacgacgataagagagagagagagagagagagagagagagagaggaaagatcgagagcaagaactcacctcaagttcagataaactcggcaactaattctcttctcctacctcctcttccaaaatcgaaagaaacgtcaaggagagagtttgcaagcagcagagggagaaggaaggtatgagtgagcctacgggggatcgcaggaagcctaatgaacaaggaattcggaagtgaaggagaaaaaaaaaatctgaacggaagcatggacacttaaataaaaggcatgagggcgcagagctgtgcaataaattcgatcgatgctctctctctctctctcctccctcttccctccctctctggatgatggatgtgttgtgtatatttacaggccagtccttggattgcttacaacacaagttgctgggacaatttgttacaagtgttccaacttttgtggtttggccctagtgtgtagggagtattttctcatgagtttttcagaccaggtccgattcagttgggtacttgtatgttcatgttcactaggaagaatagcattttcaggtgtcaaaaccttgtgacctgaaatgtctttgaagcacactcaaaaaatgactttaaagagtatactgtaaagaaaaaaaagttcattttactccctcaaattattccaccagatcacttaaccccctaaattatttttggctcattcgactccccgaactattgaaaatggttcagcttgctcccctaacactatttctcttttttttttctctctatacaaatcatatttcgtaatcaaaatttggtagaatatagatgcatttagaacttacatatgaactttttttttgaatttttctaactatttatatagttcgaaagcacttaagactgatttaaacatcaaaattttaaagctgaaacaagcatccacgaaaaaattcgaaaacattttcaaactttaataatggtattagttatggcctaaaaaatttcaacttaaaatacaacttgtattaagagtaaaaaaatagaaatgttattaatcagtaaagtgatccatttttaattgtttagaaggtaaactgaggaaaaaaaaacctaaggaggttgagtgatccattgaattagttaagaggagtaaaatagaccttttttactgttaaaaataatgtcttggttgcgttggagagtatctaaaagtaacaaaattcatatttagcgaaataaggtttatgntggctatatnagatggtgtctttttaagctcggtgagaaatagagatctttttatttaactttaaataattattcttctatgcagtataattatttttaccatacaaaattttgtgtaggttatggatactccacggtgcatgttaaaatatgagcaagtaacttttgaacttattttctaatttctaaatgggaaaaatatttttcgcactaggccatctgaaaaaaaaactctaaatttgacaatgttgatagtttaagctgaattcaaagcacttaaatgtgggagagttgtctcttaggaatatgtgacgagatgctagattactactcggtccagaaaaaaaaaaagcaaattctagctacgaatctgtatacgcatatgtccaggttcggattggatttttttaatgggacgaagaggaacataattgatgttttcctagcatgttcttgagtagcatataatccatttagtatttcattatccatttccactcagtggattttcatcttacagtagatagaaaataagatgatgttgcatttttacttcgactaatatacataatgaatgtatacaggtaagaatgttcctagcaaaaacaaaacaaaacaaaaggaatgttcatagcataattctgttgggattttcaaatatattacaatatataggaaccaacttatggatctgaaattcagaattttgagactcactgcttccgataacatttatttttgaatcagagggagtatatatatcatagagcatatcgcgtatatagaataaatattccattttaagtaaatgaaactatatctagtgaatgtctggtaataacatattatgagcagggcattattgagaaatggtagataagtcaaaggagagaagcattaaatagaggaggaaatggcgaaatcaaaccagcagtagaggacagctctcccacatttaagtgctccaaattccaaaccacctctacggacccaaaatttattagacatactggtaccaacgaagcatttctagacagggaaaaacttttaaaattaaataaaaaagtaccaatttgatttttttgcttcaatttcatagtaaacgatgtaaccttttcacgtaaatagaatcctaattcttgctatttggaatggatccaattatattgagtctagctttcttcttcgagctaaactaatgacctttttgctatgaaaatattttttttccttcgaacaaaactaatgtgaagtccttttcatcatagtttaagactggcaaaacaaatattggggcagatgtactgactgtgaggtttgtgtcacttgataagatgttagcgtgcgaaataatatactctacacataacaacatgtcacgctactactcttacatgttttgcatcatggtactgtgtagtaaatgtggtactagaaaggtacatttattagtttctccaacagtctgtttttggacaaagttttgtttttcagtctaaaaatgtgttgctttctgtagctgtttgtcactaaaacatatcaaattgtcatctgaaaaagacaaaaaaattgcaacactttgttttgtaaaaaaaaatttaacaagaatgtagtcttctttataataaagaatacaccctagtatattttgaccgaagttttggaaatttt

SEQ ID NO: 28347 - DNA, 7682 bp, Oryza sativa
ctgcctactcttcgttttgaaagcaaacaaaagaggagataatcttagaaggatctttccatgtgcgagagccatttggccaaacttaattaagcagagtgcatgttctcatgaacatgggatgcgcttcctgttagctaaagtaagatacatataagtgcaagtaattaataaattgtattgattcaagtgactactcttgtatgatatctgatcttgggctttgtccattcagaagggcaatgtgtatatttgcattgaatggaaagagactcagtattcagtatttgcaaaccacaggtaaaagcaatgtctcatggcatgggccgagcagatctaaatgtagagatgccattgttgcattctaaatgaatgcttaatgcgtcttaagtagtttggagaaagaatgacattacacagccgtgtctgcagaacgaaaacctgtacaacaccttgagtatcaagatctccattaattcatctaccctaggactagcagctggggaaaaaagatatcctttttgataccaaagtgacaaaaactggaaaggaagcaaatcaacctaacattacgatgaccgaaaagaaagacgcatcacctaacattctgaaaatacctaggaaaatgttcagcatctgtgctgacagttcttctcctgaaactccccggtcaatggagcagagatgatccaccttctggcttctgctcgttgcagcaacgtgacattatgtttagatccacaggatgttgggcacttgacttgagaatttctcctgcaattcccttatcttggaagagagctccaccttctgctccttgtagctctgaagcaggaagtccttcccttcgataacttcctttagctcaccgacctccctcttgagcatctccaccctttctgcctctcctttccttttgtcgaggccaataaaatgcagctcagggtcatcaacactgctgctatcagcatagccattggcatgcccattggtggcacctgactgccaatgcccagccagcaaaggtttatcatgagagagtgcttctgcaacacaatgatctgcaatgatcttcctcaggtgctgaatctctcgctcagattcgaagagatcacggttagcggaatccagctgagactgcaaattggtggaatgtgtctcctggatgttaagagagtttttaagatcagcaatctgagcttgcatctccatgatcatctcatcacgtttcttgagatgctgcctcagcttctgtataacctctttcttgctatagatgtcagatcctgattctgaaacacaaggagagccagaactgtttgagtactgaaatggtttacgaggatcctcaagtcgatcaggtgatgatatccacatgacgccattattctctttgcttgattctggtcctggtatcttcacaagtggaagggagggttccatctgttttgatgcaagacttgcaggtgcctgctttactcctactccattgcctgaaaaccctgcaaaaaatagcaaagaataaatacttcccatatgttgacaaagtgccatggcaacaaaaaattaacaaaaagtttttaaacacaatttacaatgtggaaactacaacacaatacaatgtaacttagttatattaattccaggaacataaatgtaagaacagataggaaacatgaaaattgcttaattgtctgtaaatgcttcacagccagaaagacaggaataaagtaaagctacaccagcactttctgtgtatcaaagtgctcgataaggaagtaagaaaatgtgataatgacaatagtactccactcatataaaacattatcttcttttctaattttctttctctgtgcataaacattcttctgtacagcagcataattatggtcttaactcttgactaatgactacagctggtaacagacagtgcaagattaggtcttagagttataacaaacttacatatcaacagataatttctgtatgaaccagaaaaattgagcaagttgcaatttctcaacactgttatttagttctcatttctggggatgttgttattctaccattcaaatcgagcaagttgcaattttctcagcagtgctatgttatcatttctgggttgttgttactccagcattttgcacgaaagcatcttcgtcaagagaatcctagtagacttagttactctgtctgtgataagttctcaaaagaacaacgatcaagtgcgctttcatttcatggaactaatcacactatgagctaaaatgagaggcaaacctgatggtagtctgggcctctatagtacagattatagaaggtagcgtggttatttcacggacgactaataactttttcatcccactagtagtgattttgataaaaacgtgccttggtttttggaaatgtcgaagaatgatgcttaaatattttttcccaacagtttggtgtacaactcataattttttttatgagttgagatcgagccttgaaagtgagggaagaagggtattcagcaagtttgaagtgctgaaacaaaatgttatgaatgctgcagaaagtattacgcctaatgtttttccattgaagctatacaaagataatactgcaaattatttttgaaatgcaaatagcatatatgcatatcttatgatactgtaactaagatagttttgcattttaactctataaattgaaggaagagtgataacaatcaaaaccacataggctggcaggtacagcacacagtgataaaaaggcaatagatcgtattaagttacagaagaagcacctgaattacaatggtagcagctcaggtgatcactaaaccggtagagatttgagtgtaactcacatgttcctggccttctttgggctgcaattttgcaaagtcagcagtcaacatttaaaacaatacagacaaggaatcaaggttacaacagcaaatggaggcattagacctttggaagtattactatttcgttgcttcgcatcaaatagttgtttcaatttgcacccaagtttaactgagagtgtgctcagcaaaactcctcccgcaacaagaacccagtttggtcctccttggacattatctgtttttctcgccttctgtatgctcctgttagtctttgacttcatcccagcttgtacgaactaccgatcttcagcgaactgtacaaatgcagtagcttgacctagaagacatgtataaaaacgcaataagcacaacagctcccatatcagtacagaattttcagttataaagacattcatagtaagagttctagaaaatgtatgttccataaaaaagtacagttaaaattgaaactgaaccatatgacttcattgtccttgcaagttgcaaaagaaaaaagatcaaaatgaatcggtaaataacataaaaaatctggctttcgaagataacagcgacaccttcatattcaagtatacagaggaattatctttagaaacagtataccaaggaaaatgacagtaacaatacgctactacccctaaaatggctttgcattgtgcctggctatttagggttcagtttaggttgccttctaaacatctacaccatgatgatatatatattcatagactaacaaacactgaactcacaaaggaatcagctagagttttttttaaagaaaaaaaaaagagaaaaacaactagagtttatacaatcacgttgacaattttttttcttcttctgaaaagtgaaaattacaggttctccctttccccaggagacatgagaacatagcgaattacagattcggtagatgtaaaccatttttcatggtaggacaattcacagaagtccatgaaccacaggtctgcgaatctacccgagttttccctcccctcccctccctccacgcaccgagccgattggattcaaccggcctccgccgtcccccgtcgccggggagccaccttccactttccccggcgacgagccagcttcaccgattaccccgacacaacaaggacgagcacacagaggccaaatcgaggaacacccccccccccataccataccagtgaggaggtcggaccagagtcgtcgtcgacggcggcggcgcggctccccgcccgctgaaattcaccgccggggatcggtgacccgggggggcattgccatcccctgctgctacgcttccgacggcggcgggcacagctccggcgccgccgcggcggaggagtggagagggagaggagatgcgaaggaagtgggcaacggagagagtgggaaggaggagattgtgtgtttgggagactcggaaaaaaaggtaaatccgtttttatccaccctcttcttcttcactcctctgcttcttcttttttttttcccctttggttatttttcgcttttaccttttcctttttggagattgctctgctctctgctttgtttatattcgccaaattcattttgtttgtttctttctctctttttttttgcgagaagaaatttgttttctttttttcatatttaggaatgcattggataattccagtgtcagtattgttgttgcaaatactttggtcaagcggtggaaaacgacatcgatatagaatacggaaaggacatgatacaaatgatagctttttcttaaccccgtaatgttgttgtgttctataagtactttacataatttatgctttgaagtacatctcaatgtcgaaaacattgtagtgttttaaaaatgcatgcatgtttgagcagggacggatctacgttactcaggccggtgtcaggcgacaccgacgactttcggcaaaacctataacaaaattgcttatctatatgttataacattatgatctaaatattattagtatactatggcaccgatagacacgttatgacactaacaaatcggttttctagatccgccactgtgtttgggcttagggtttttcttataaaccgatgacacatggcaagagtaatttcaagctaagactttaaagcatccacagtgaaaaccatcctaagagtatccttagagagagagcgtgtgctatgtaggatgatgccacaagtcgaaatactactcttcttacgatgcatagtatattctctctcgagtacgcgacacaaccatcacctccaccctcggatgtgtcatccttgccgcaagtccctcctcctctatggccgtcgtagccctctcctttcgcatccctagtgaactcgagcgcaacggcaaaagggttcgacgctggaaggcggggatgccaccactgctgttgctcctacgcaggtgtgatgatgatgagaaggccacgaagaaagaggcaatggagagggagtaggtggtcttaatctcgagggcagtatgctagtggtggcgcacaaccaacaatggtagttgcaggtgtaggtcatcatgggaataggaggagttttcgagtgcctcgctgtcgccggatgccttagagcaccaacatcctaaaatcgatatgtgtcgttgtttcctgcttttctagcgggtccaccacatttcgatccaactccatctctaaatgtgtatcacatattgacatgtttagacatggacgggtatcatttggtatcagacctaatattatcctatccagacgggatattgcagtatatcagttagatattataatcttgtaaaaatactcactacgcactagtactacttttgctcaaatgcaacatttatctatatatctatattcttgacttgctaaaaatattgatgtctcactgtccttaagccctatagaaaccttttaaaacacaaaccattccagtgttctaggagtagtatttaccaaagcaatatccatcaatgtgctctgctatatggtttaaactcatatatctaaaataaataaataaaaactaggggtaaaaccttccacgcttgtaattgaatataccgtatacagacagccaacaaataatccagagccataatcacccatttcaccaacacagccatactacaagatttgagcagtcaattaagttggaggtccacattaaccctctggtaggccagtacaatagggggaccaaaagcatttactcgtgtactgtggaacagtacctcacactcgcacagcctactgcctccggattgggagctcgtaccgtacgtaccgacgtcgagcgattttactcttccgaccccgtgggcccgccctgacagtgaccgttgtttgttctccttgggagcttgggggcgacgacgaccgtgcctttggctgcctccgccccggctgagctggcgacctgacgtggacagcagcagtggctttagcccacacgcgtggccggcggtgagacgctgacacgtcggcagatagctttctgggcccaactgtcaattaatataaaagccaacctaataatccatttatacaattagttattggttgtagataaatattgcatcattaatatctaatctacctatctctcacatagattattaagcacatgctgcagctagttataaatctatagcccgtttttcttgcccccccccaccaataagtacgaatataacgtggcaacttgtacaacctatttgcatcatcttgttatacctgctcgtcaccttattgtaccggctctcacagacgtgtctccaacaaactaggattctcctgcttcacagtcacatgacccacaggccacagtccccatgattataagattagagtaacctggtccgtatcaggagtactccatgataagagcatattgattgacacctacacttccccatgcctttttatcacaaagctttttcttcaaagttttattaaagtgtggctatgagtttgctagccacaaaatttaacaaataaatactccgtgctcagtgacagttctgagggtgatccaggtgatcccttgatcaccatcaattttggtcccgaaggactccctccttcaaatccagccaatttcactttatatgaaacggcggattcaaaaattttcatgagtctggacaagtctaacaacaaataaggtatacacaaacctataatagataactttagtatgaacatttgctttaaaagtttgtgttgagcgtgtttgctgctttactagttgcattgtactgccataccggtgagtaagaaagattattgctaaggtaattaggcactaatttactggtgaattgctgcatgtagctggtagagcccgggccattgcccgtgcaagccgggccttggctccgccactgtttatatgcatggcttaatgactatatatgttgtaatttttacaaagctcaaatgctaattttagtggatttgtaatattatgaggtactatatgctatatttgtatcatacttctaagtaaatacgttagagaattttgagcatggagtagaatcacccaacgagaaattcctaaagctgccactacgtccgtgatttatccccagaagttggatttctcaggaacggagagagtatgtctaagatcggtggagcagaagtgtgatcaaccacggttatgacaataaatcaaacacccaccaaacaaagtgtaacatgcttatattccctcaatttcatattataagtcattttgatttttttccacttttttaagtttgagaaaaatataataatatttccaacacaaaacaaatatattattaaaatat

SEQ ID NO: 28348 - DNA, 7868 bp, Oryza sativa
taaagtagccatggatgataaagtaagtcataaataaaataaataataatttcaaattttttttaaataagacgaatggttaaacgttgcaaacaaaaacttaaaatattatattatgagacggatggagtaacatttagtgtgacaaaatgtggcacctcatgtgctcagctatggctgcagcgtggctttggtttataacgctgtctttcctatctggctgggccatacattcagcctgaaagcccgattgtgagcccacgtccgtgacagcctgtcagacgccgatcgaggctttgtgcatttcgctgttttgagtgggccagggaatcttggccgtccgttaatagattcctttctttcccagattgtgacctggcaccatccagatggattattcatcagtacataaatgtactaagatggaatgcacaagtgagcatatatgacagaataacacataccgataccatatagtaactatacaagtagtgccatatgcatcctatgtgtcggtcttgaacataagaaatgagacttctgtagattgtcactatgctctagtcagctactccctccgtcccaaaaaaaaaaaagacaaaccctggtttccgtgcccaatgtttgaccatccgtcttatttgaaaaaattataaaaaaaattaaaaagacaagtcatgcacaaagtattaatcatgttttatcatccaacaacaataaaaatacgaattataaaaaaatttcatataagacagacagtcaaagttggacacgtaaatccagggtgtgtgttttttttttggaacggagggagtatcccggtgcttccagacatcaaatcaagcgatataacagtactgatatcgtagcatcaactcatgatttccttttacagcgccaacgtaatgcaaatattattcgagttgcgcgtacacaccttcaagattgctgcttatttcaatattactggcagtgcaaacaagttagtagccgaccagattagttccttctcttggaacattttgtcagtcaattacagataaatctacctatattgcacatggaattagaactgaagattcattatgcaaaagttgaaagaggcttaccagtaattcctatgttgatgatttattgaaactgatcgctgagtgcatttccaaatctttcggcccttccatatattttactggcaacaatacttgccacccaaaaaaatcagatcactcatcggttcaacaaccagcatcagaaattgtgccacacagtaactcagaagatccgtgacaaaatcgtcgaatcaaacttggcaacctctcttcagatcaataaaataataaagtagcgaagcctgccatagcggtatgggacttttggctcctacaaatctgtaaacactatctgtcgacctgatatagtacaggcacacacacaatctggattcaaatgctttgcgctcatatcagtcttcaaaaatctgataatcactgctctacaaagaaaaggaacacggtattattagctttatgatcttttggtgatatcctttttctattaagcttcaaactcaagttatctttcgagtacagcgctacagctttatcaaaagggatgtttctgctcagaaaatctgtacactacgcatggaaaaggaaatccaaggaatggtctagagaactcaaggaacatataacaaaacaaagccatttttttcaagaaatcacggaattcatcatttttcctgacggcctatcaatttagtgatacatttatgaatgctttctctgaacacctcagatatatgtcaatgtttgtttcccttgataacccaagcaattaactaaccttgccaagtacagcaagttgttttgtatagctcaaaaatcttcctttgccaagaaaaatagttcacatgggtaaatgtcaaagttatactctatggaccttatttgtggatatccagacacaatgttccaaaaaaaaaaacaaagaattgtcaacatatagcatcaagtcgttatatgtgcttccaccattatctagagttcttttattttcttagttcaggagctacggattctcatgtggtgccatacattattcagtgaacacactgaaggctagagaatttagtatcaattcagtaagtaaagttaaggttagtattgatcaggtggaatgcggaattttatatttgtacacttcggtcaaaagctttatgggaagcaacacatatagtcatgtactgagagtaacaaataaatagcaaagtcataataccaagaaccagttttgtaccttccagagagcaaatagagcgtgaactcattttgtgtgtgagagagtatgttggatgatccatttcacatcacttggtgcaccttgtgcttgaacagcacctaatgagatgccagtttgcacagctgatggggatttcgcttcgagtgatgaatgagacttgtgtggcatattattccctgtcaggtaattcctcagtcagcattgcataggtttgatgacttggtctgcagttcatacgctctaacatgataatcatttcacgggatatatctgagtgacctttttttatcaggccatcaataatcactttccacacaatctcatcgggactatagtctttccatctagaattcatgaatatttctttagccttatctgtttgtccttcacaaataagcccagaaagcagatgttggtaggacatcaactgtggtataaaaccatgttgaatcatagagcaaaccaacacccatgcatccaaataccttttggatttgcaaaaacaagtaacgagagcagtatagatgtcttcattcagagatatactatcttctttcataagagaaactaacgatgtcgcctcttccgttcttccatcttcagaaaacccctctagaatggaagaataagttcctgaattaggaagaaattcgttttttttcattacatcaaacaacccaaagacatcagtaagctctatggctttccacacaccagctggggtcaaaggcaacacatcctccactaatctcatgcgtacaagatgtctaagcaagataaaataagtaaactggtttggcacagaagcaacacttgtcatttgtttcaagattgagactgcatgatctgtctgtccaatacttgcatgtccatccatcagagtattgtatgccattgtatctacagtgaccccatttttgctcatctccatcaaaacattttctgcttcatttagtcttccttcaatgcagtaagcacgcatagacgttgtataagtgactacatcaggattgcaacctgatgaaaccatttcgccccaggttctcgcaaccaatccatagtttctctcctttaaaagcttatgaatcacaattgtataattgactgttgagggcttcacatccttttgtagcatctcccctataaaggacagaccttcttgtgaccccttcatcttgcataggtgttcaataaatgaactgtatgtgtaagtatcgggtgtgcaacctgcagaaaccatcttttccaaaaatttccatgcaatatcagctttaccagacttgcataacccatttatcaaggaattgaatgtcacggcattaggttttatgcctctagtttctagactatcaaaaagggagcaagcttgatcagttcttccatccttgcagagagcattgatcaacgcattatatgtgtactgatcagcaattaaaccatctccttccatcaaacgtagcaatcggaaagcactctctatatgtccatcaatgcattggccccgaatcaacaaattatatgtcacagcatctgggttgactccacatgctctcatcttgttcaacaaagtcatcgccttgtgcacctttccttcattacagaacccttggaccaatgcattatatgtccacacatttggcttgcaccccctcaacttcatcaactccaacaccctcaatgcatcgctcatccttccctccttacaatatgcatttatcaccgcagtgcatgtcacaacacacggtgccaatcccttttcaaacatctcctgaagcatttcctcagcctccttggccttacgctccctacaccggaaatcaaccacagctgcataagcacgggtgcttggccgccaccccaattccttcatcctacgcagcatgagaagcccctcctccccccgctccgcattacacaaccccttcactaaggctgcatacatgtgcatgtctggctggtccatctccccgaacaactccactgcctcgtcaatcctccccgcctcacaaagcccctcaatcagcgtggcgtaagagaccacgtcctgggcgaaccctctcaggggcattttgtcgaacaggtcgcgggcaacgtcgacctggttggtgcggcaatacccgacgatgagggagttgaacgtgtaggcgtcggggcgccagccggagcggaccatgaggctgaggtaccgcagggcgcgggcgaggtcggcgcggcggcagagggagcggatgacggcgttgtaggtgggggctgtcggcgccggcggggcgtggcggtgcatgtgggcgaagaggcggagggcgagcggcgcgagggcgaagcgggagaggtgggcgaggagggaggcgaaggggcggtcgaagagcgggcggagcggcgggggcgagagggagtggaggcggaggacgaccgggagcgcgacggcgaggaggtggcgggacggcgcggccaccctggccgccgcggcggcgaggcggacggggagcgggacggggagcgactccggcagggacggcgtgagcagggcagggaggcggggcagggaagggttgaggaaccagtcgggcgaggtgaggacggcggcgaggtgggcgaggagcgccgccgggttggtggagcgcggcaaggctggagacgagcccatgggagacgttcctgggtacgcgcgaaccgggggacgcggcggcggcggtggcgtcgcccgcatgttggcaatcggcggcgagctcactgcgccgccgccattgctgggggatctcggctctgctcctttgccaggagccgggttgacggcttgacgctgcccctgcttcgagatttgcgcaaggaacaccaccaacggaagcgattttcagattccaatttcgggagcaactattttctgccgagattcatataaaaatgtgtcacattcctttgtagatttatttttaaaaaatggatagagttttgattttaaacctggtataaattaatgtattacatgaagcaacgatgtaaagtactgtatgaattacgaatggaggttctataaaaaaaaaatatgtagcgcaaacttcatatgtattacaaatatagaaactatcgtaggacaaagaaatgagcacttgacatttgcccaatccatttctatatcctacgtatttcaagtttacgctacattttatgtgaagtgagcataactcaatcggttatttttcttgtggtgaaaccaacccacatggtacttgcatttatagctaattattctttcagtagtatgcgatgtacctatctgtgtgtatacgctcatagaggtgagtgcacgcgcgttacggaaaatactttgggatctagaaatggacacctaagatttagctacgtcaccaataattgtttcctcggttgtgtttgagacgagaggaaaaaaagaatatggagaatatatgtaaaacgacgtgagttattaacacatgattaattgagtattacttcctccttttcacaatataagtcattctagcatttctcacattcatattgatgttaatgaatctagatagaatgtgggaaatgctagaatgacttccattctgaaacggagggagtaactcatttaaatttttttaaaaagtaatatgatcatttaaagcaacttttctatataattttttttaaagaacaccctgtttaataggtaagaaagcgtgggcacggataacgatataattcttctctcaatccgtactctctcctcttattacggcagacgatccggatccctctttcttgcttgtttctgacaagtggaccaataaaattatttattcgtcagaaccggttgcttcttctgaaatgtctttttcttagagcctcgtgttagtttctctactactatctccgtaccaaaataagtgcagctattagtttccacgctcaactttgatcgtccgtcttatttaaaatttttttataattagcatttttgttgttatgagataataaaatataaatagtattttactcgtgacttatgtttttaatttttttttaaaaaattttaaataaaacgaatgatcaaagtacaatatttaggacggagggagtacaatatttgagactggttttatgttcattctctctctagtaccaatccaaagcatacaaatgcagaaaaaaaaaaggcgctcttccagtttgcatggatgttctgtgatagacagaatgaatattgtgatatcaatggttaaatctagtttcagttaataagtacattcgagattctagtcccagtattttcccttgatcaaatattcctcaaacactaacagcccatagtaacgatctaatcgtccatattcatgatgctctggcacatttcaggaaccaataggacatcagaatcgatctcttacgaaggcacacatgaaataccttttcctcttgcattctactagtagttacctttaaatgtccaaatgtaatgataacagtgatatctgcaccgaatcatcaaccaaacaagtgatgacaaacttctgtagtactaattccagtcattacacgctcaagtcaaacaaccaacccttgggaaaattaggattgccagaagaccagattgaccagtccagcggtttcttctataattttataggagctttgctctagagtggcagcaaggaatgagaagcagttgatcaagatggaagtaaacagaagcaaacagagcgtcatattacacaccctttgacagaataaatccagcattccggtacaccgtactagtccaacatgtaaggcctacaaaactaaattcagagggtgctggcatgccagaattctgtcactggtacagttcgcgccatggttcctgaaagacgggtgatttttcgatccccctctgaagaacggtttctttgctgaattccaagttgatgtgcttagccaagtgatcacctacacactgcagcacctgaagcacaacaggtaggggtcggggtgagccaacaaatgcaagtataaaaactgcgatatattttgaagatagtggcaacaggtacagagaagttgaagttcctgggtgggagtgtggggcagacaaaattacgcaagaatccttatataattaccaaaagactagctccttgcctccttcacagaatcacagttgctcgaaactaaaaaactatttccttttcctacataatttttactgtcatgtatattgcttaatattgcagacttacatcatgaaatggaagtgctgaaagttcagatctctaaccattataatattatttccgacatcatgatgatatacatacaattatttggaaacatcatggtttctggatttctatttggaaagaagaggacatagagcacattttcctattactggacacatattttatagttcaacttcaatcttggttctaacataatattttcaagataccaagtttacaggttaaccttttctcatttactatattaccataaaattgacttcaagcttagccattaaaactgtagtagtttcctattctgcacttatcttcatttagaacaagagaaagaagaaataa

SEQ ID NO: 28349 - DNA, 5765 bp, Oryza sativa
atgagggttggctgaatggatggagcttccgaagaaaccgatgctaaaatctcattcatagcacatgctgcaacaggaggcttatagtctggtaggacaaaaaaggacacctggcaaaagttaacagaaattaaatatatcagaaagaaatgaacactcccaagtataataaaaagaaatggtaaaaaacttatatagttggtcagccagtcattcagtatctattggtcatcaaagaactgcagaactgtataaagtgacattgaaagagagagtgcatgacaacagttctacgaccttacaattgcataatgtgaaaactgcaaaagctatcaggtgccagctgactagcagttaaccataagacatgaaaattaacctttcctaacagggcaaagcaacatgaaatcaatagatctagggcacaaggtaaacctgcccatctgaaaaaattatgacaaccagtaaatcacaaaaaagtagccttttgcactggattgcctcaggttgttccaccataatatgaggtaccatttaatcaactgtaaaatatgtaatttttgcgctgaccaaatgcaacaagataatttagagcgctacatccataaccatgaaaacagaagtgtctattctatgtttgctagacaggaagtacaaagatcttcaccgacagaaataagcccagtatacatgaacgcatgcttatataagtcagttcaaaatgaagggtaataggctcgcagcaatcaaaagagtgacaactgacaaatacaactcaggcttcatatatcaagtgctcaaactgaatcatgatgaattgatgataatcagttccaaaaactcagatacaacacatatgttcatactgaaaccatcagttctctcttcctcggcaacaaagttttctgtgcctccaaaacacactcgccagtaagttgattggtgcataccacatcaaaccccaagacgcaagatttactaagtgactaaaccatatcgtaagagtaagttatagtattcacgcatttcagtaaaattgcgacatataggccgttttggtttgaagcctaccaaagttgttgtagggcaagaattggcatcaaacaaaacaacccatagattagcattatagatcggcaaattttggttccaatccaaatggccacatagtaccaattgaagctaccatttataactggtagggcaagaatcggcatcaaacaaaacaaccctatatctttcggttcactgacattgctccaaaacttctaactataataatcataaaaccaaacgaaaatatcctagtatgcagccaaacagaggctaatctgccagctcaacacagtacatttgtgcacgataactaatttccccctacaattgcttattccaggaaccgtgtggttcattcccccaaaagaaaatgctttccatttagctcaagcagctaattgttgatccaaaaccttcacaccacgcgaattggatctatcagacggggccaaaagccaaaaagggacgcttacctgcggatcgccactagaatcggagaagttcacgagctcgccggaggccttctccccgtcgaggccgtacttggcgagggggagctccaggggcgtggattccctgcaaaagcatccacgacgacgggtcagctaccgtaaggcgctggattttggtccttttgtggagagagagagagagagagagagagagagagagagaggctagggttttagaggggggacctcgtgagccccggcgttgggcggagcgcgtcggcgagggctgcgccgtaaccggcggcgtcgcggacgaggacgaggaccttgggtgccacccgcatggccgccggtcgccggtcgccggcgccgccgccgcgaatgatcggagggagagaggagaggggagggaattatcggttgagcacgcgaagagccagagatagagggtagaacggtaataacgagggaattcgttagaagtttagaagtccatccaattatttgtagtctcttcaaatttgaattcgtagtagtatttggtatccgtgtctgaaaaaaattcagattcttgattgttttttattcatcttatattttacagcatataaaagtttcttggatttgttcacgtcaccgtgaacaaaattggttatgaaacgtatgaatttagggccctttgaatcgcaggattgagaaaacgtatgaataggaaaaacgtaggattttgatagaaatgtaagtgtaaaatagaggattgcaaaacgcaggaaaaacacaggaatgaccgtttgattaaaccacatgaaaaatacaggaattggatgagagatagactcaaaggaaagttagcaagaggttgaagctcttgctaaattttctccaaaatctctataggattgtccattccataggaatttcaaagtattggataggattcaattctttgtttcaaagggcttcataagaaattttcctaaaatcctataggaaatttctatatttttcctccaaaacaaagaggcccttaggtttttatgattggagtataaaagttactcccatgaaagatacgcttatggcagtatatataataagttgtgttactgtgatgagcacagcaatatgcaaatagttcaatttgaaaatgaaaatgtaacaacagaggaagagatcatgctcatcaaacattaagatcaaacggttgtattattggctttgaatgtaatcacgaccatcctcaaaatttgcttctcttaacacctaactagcatggtggcccgcgcagattgcgcggctagcatcattatatttttctcatataatagcatatatgttttctcattatattattcaaatatattaaaataacatcataattttaaatttttcaataactttacgaaactacaaatgtgtaatattcatattgtattttacatatgtgttagttattaattatttttaatatcaaattttagttatttgtaaattatatatattcctatatggactctagactcatcttttaatatatttttttaattccgaattttctgtaaattgtatttctatatagactctaggctcttcttccaatattatttatttttatttctgaatttttattatttctaattgtatttctatgtggactctaaactcatctttcaatattctttaatttttaatttcgaatttcagttacttctaattatattcctatattgactttaaactcttcttcccatgtttttcttaatttcgaattttagttatttgtaaattgtatttttatacggactaaaactctacttttaattttattatgtttattccgaattttacttagttttaaattcctatatggactctatactctatttctaatattcattattttttaattccgaatttctatatttttcttaattgtatttatatatggactctatactctacttctaatattccttatttttaattccgaatttcagttatttcctaattgtatttctatatggagtctagtctcctcttctaatattccttattttttaattccgaatttcaactatttctaaattgtatttctatatggactctagtctcctcttctaatattccttatttttcaattccgaatttcagctatttctaaattgtatttctatatggactctgctttttctttttctccgattaatgtgacaatttctaggccatgagagcgaacgtggaggctcatttttctattcctttaataatataatagattgaaacatagggtttatattggcttcctaattagtgaggataagttactattggttgaatttagcgaatagtcgggggcgtggagtcatgggcgaatgacttcattcgtcggagtttaaattctggtacccacaaatattacgtttatgcagataggtttctaacgagattgtagtgagattatggatgtactactgagtatcatcttacgtgtgcagtgatgtgtctgcgtgtgtgtatgtcgtgtaattgtaaaagaagcccatacccaggcatagtcttttgatgctcttcttgaggtggaaaaactggttttggcattcactggttggagacagtgaaagcatcaaacattggattggatgtccaaaaacattggatatattggatgtcctagtcttgaagatggtacaggagaatggtacatatacactaagtgaaaaatttgtactgattggattttgatgacgattgtacaagttgtaccctttctttgaaagcgttattgtaggaatgaagcttgaaatatctcctcgctaaaaaaactattgcaattttgtggttggtcggcctatggtttcaatgacaggttcagattttttttttccatttcagaccagtcttagcattgataagtttttatcatgttgttctttcttcttagtcgttttaggtctcaattaacatttagctaatgtagtggtaatgtgcatccttaagttgacgtcggatgcagataccagggatttatacctttcttatttaaaaatgaaaactctcatattttctagagaaaggacaaactactgttctgttttttttacttgaataattcttcattgaaaatacttacgaacaagttcaacagttgcaagtattccaacaatcatgttggttgtccaagtttgttctagagggaatatatcaaggagattcgagtatgtcgtctccccctaatctactgttgtcatttcgtgacatgagcatgcatgatcggtacagctagctatcctatttgtcaacaaaataaacccaatttcccggtggtccatctcaccatgttgaaaaatgaacgtgtgaaaccgtcctaataacctaagcgtttaattgactcttggagcaaacatacaacaatccttgacttgacttcattcacggaacggcagttgtcccttggccactgatcgctgagcctaaataaggatttaaaagttatctcggtttataaaccaaaatggtagtgtataagttgagaaaagttcattagccaggacaccggaatgcggcttggtttatgataaaagtaaatcgaaaaaacgtaaagagcctttcccacccaaaagctattcaacgaggtgagggaccaatcaaggataacctatatattataatctaattaagcaataggatactattttctatctcactctcaagtactagtactacttcaccgcatcatctgtactactctatcttatcctcttcgttcatagccattcaccgcatcatctgtactactctatctcatcttttcccccaatcttctagaggcatcgagagcagcaaaccgatggtgagcttggtggatggcgtagcgagctcgcgtgcgtggccgagctaggtaccggccgaagcaagcaaggcgacagtcggccgacgagctcgcgtgcgcggccgagctgggtaccgggcgaagcaagcgaggcggagcaattgaagcgggcgcacggtaggagcgagctgccaccatggtcagcacaagctcgagctgcgtggtttgcgactttgccccaccacgccgccgtcgactccgccacatagcgccgcccatgagctccctccggcttgagctcgaggggaacaggagagaggggggagaggggtgaaggggaatatggaggtggagcacccgtcgccgcaacgcgtgcctcgagcccgtcccctggccgaaaaagaggaggagccgcgtcgcccaagcag

SEQ ID NO: 28350 - DNA, 1467 bp, Oryza sativa
caccccaaaagctacccaatgaggtgagggggtcccccacttatatattaggccacttgcctttccacaaccaacgtgagattattcaacagatatgtactccatctgtttcaggttataaaaaattttgctttaatcaaagtcaaacggttttaagttgactaagtttatagacaaatatagtaatatttataatactaaattagtttcatcaaatctacaattgaatatatttttataataaatttatcttggattaaaaatattattacttttttctataaacatggacaaacttaaatcagtttgactttgaccaaagtcaaaacgtcttataatctgaaacagagggagaataatttagtaaataaacttgtaaaattttcatttcaatttataaatttgcgtagtgcgtgtaaataatctgctaaatttgagatgaagcttacaatcacccaatagtttaactagggtggtttttgttttgtgctaccttactactgacaattaacatttgacaaatctccatttggaaatcagaaacggagcctagaaagctgatcgggactcaactcaaactaaaaagtgaaagtgctgaaagaatttgaagtccagccaagaagcaatgccggttaactatcccttttgcgtctggcatcagctcaaggaattaaaatagttcagaaacgggggcgcgacgatgacgatcggttgctatgtttaatcgatgtcgagtgagtgctgattggattctcgggatgcttcaatatctatcttctctgactctctgtactgatggtgacttgctacaggaattttttttttgtttaatcttctgaagctgcaatttggtttccatcaactaatccaaacaattaacggtgtgcgtatctagcaagttagcttctacttctacagttctctattccttgatctttatcagttattcaatttactgtcttttgcagttccctgttcctttgatcgtttactactcttctgtagtctctaaccgagatgaattgtaaatctgggagtagttttgcatcacaatctttaatagtacaagacaaagctaccactcttctgtaataggagaggggttgttcttgcaagaacttcagataatctctgaagaaatccaagcagtaacagagttttacaggtacagtttttacgatatacagttttattattatacatggttaattcactagggtgtgcagcaaaagctgccaggttaattaaccgcaaaagaaagcagcaaaaggttaacgaccttcaaaaatggaaaagaacaaggcaagaaagcaacaagcaaaatcacacatatgtacatgcatgcacatatataggtaattttatggatcgagattaatttggtgctagagaatgcagcaggcgttgctgtcgctctcgtggtggcggcgggagcgggacaccgccttgaaggtcttgccgccggcg

SEQ ID NO: 28351 - DNA, 1254 bp, Oryza sativa
cagcagggacgtaaaaaaaataatcttgaattactattataaatgtgataggtgtgaatgtgccttccagcaagatacagacaaaatatccataaaccgcaaagaaagaaacataatattcctttttgcaaggggcatttcttatattaaaaccagggattaatctcaattgcaaagtaatgaaatagcttaaagaagcttaccagggttaagaggataccttttccgtgacagctttgccatctattacagcgagaaattcagcatccaagtatacctggaacagtggattcaacaaaatcaaattgagcactttgatgtctgatgataataggaatagcagatacctgtcgaaatacataaccagctataaagagtgtttgcgtgcaaactagaactatgttccataactcacaaactggttaacgatgaatagccaaaactctgtatggaatacaatatgagcacccaatctatatcattagccatagctaatttttttggaagccagcatgttctatatgttaaaaggcatagacgttcatttatctatttttgttgaaaaagaggattttttttatcattcaaccaaaaacaaaatggtgggaagaatggccattagagattggagaagcaattgttgcaaacttcagtagagcacatcacaaaactctgctattataatcctccgtaatataactaaataatgtttcaggctcaaaaccctgtgaactaattaaggcatagaagtaagaacatcggaatagtgaatatgagtgttcatgtgaaggcctgatacaactgaagcttcatcacagatggactttgcaaagtgaagaccaaatggcacaagcgtaaattcatgaaattaccaaagtgattaagattgatagaaatatgtcccaactgagtattcctgctctctgacatacgcgattctccaatgtaacttgttaccatgtttcataacagatagtagctgaagaatcatagctactccatatcttacaggggaaaacaaaacagaaaattaattgttttaaaagaacatggaaatgctatattaatatgaaagaaagttaaacagaattaaatatatttttttcttaatctagttagttccacatacctgactgaaacaagattcaaataaacaaacagaatcctcaaatgtgtgagacacggagtcatcccaaacaatagttgacgataacatggaatagccatcaaattcactcagctcaacctgtaaat

SEQ ID NO: 28352 - DNA, 2625 bp, Oryza sativa
cggcaggtgtagtgttcgaaatttttaagcaatttttaatgtgaggggataaggtttctgggcccacgtggacagaattttcagatttccggcctacacgtatatatgggctagagatcggcccaatcaaaatatctcaaatcgtccatgccaaatataatgttcattcaatttttcctcagaaatattcgttatacaattttttttgcagaaatatattatcgatatcgtacaaccgttacgcgaaaataacatggtgacgtcgtggacggtatcgcacgatgaaagtacgagataacgcgagaccgcgcggtctcgcggaatgaaagagcgagaccaaacgctctcgtgaaatcaaacagcgaaattgtccaatatctccatttgattagtaattaattaatcaattaacaatcaactagtaataattagtgattaattatcctagttagcaattaattaataattaattaatcactaattaggataattaatcgctaattaaatcataatgcgcgcgtatagatcacggggtgagacatcgcgaacagtatcgcgcttagaataagtgagaccgcgcggtctcgcgtcgcgtcgctacgcgagaccgcacggtctcacattttctttgcgcaataccgtccgcgacgtcattccacgtcattttcacgcaacggttgtgcgaaaccgacggtatatttctgcaaaaaaatttgtatcccgaatattcctgagaaaaaattgaacgaacaatgtattttcaaatttaattctggttataatagggttagagatgggttgatccatcaacttggactaaatagatgggtaatttacagggtcaatccacttgattaatctattaagtgaatttatggtttgatttacttgcatccatgcctggtaggtttcatactgaacttaaacttttgagtggaaccaaaactaaacttaactttttagtggaaccaaaactaatccatagataaacatcgctttctaggttgatctatattatccatgggttattagggttgatctaacttgatgtcggtagccttgtcacatcatagtagaaggagcaaccactccatacaactcaagctcctccatcttcaacattgctaagaccataaacaaatggtgatcatgttgacgatatagctctaagcctctaactaaaagggacaatatcaagatgtgctaaggtttaactcttttattcttgtgcgtctttagtcgagacctttattattttggattgatatgactctctactacttagaattgagtataaagacaatagttcaacactcgaacagttcctatgcctacaaaacataagaaaaaaaattactatagcataaggggaaactttactgtacaagttatatctttaaatactttattttagaaacttaaaataacatacttaagggggaaaacgactatatattctcacacatcatgtattgttcttttgcaatgttctatttacatcgtaatcctcatatgtgatgcacttattgacttttgtacttgagtactttaattttttttacaatagaagtataacttcgggtgaatgtattaaccaatactctacacatagtcatgcttatgggcactatgatctaaatcttgttatatagtagattaatacactcacaattcctagatgtgcaatattcatgatttagaagttaaactaactttgtaggaatacttttaaaatgaatcttttaagaatatctctaacaaaagatgtatcagtgctgttaaggaacaataattataaacccttaggacaaccacaatgtatgaaaagataaccttaaaataacgattgaagttataaagtgagtcatatacattgtggaaagtagtattaccttatggtataccttatgcttatgcttaaggtctaccacaagaaaaagaaatcattattttcctctcgcattcacctcattaatcagagccaaagcatttttttatctcatgtgggtctatcttgtgaccaaatcctatctatagaattgtgagaattgctttaacaatgatcaattatttatggatacatgttaaggttacaccaaaaaaaaaacaccgacattgccttgtggtctaatatttttctgatcttattttttctccaaatgcatttcctttgtatgataacatttatattcagctgtatgaataagttacaaataattcacctattgattatttacaaacacacaagaaatatacaattatttttgaatctcgatgaatcctacccataggataaaaaacccacaaaactcgctaaacaagttatcataaccattttcggattattaatcatagtacaccaagtcaaaaaaaaaatgtcaaaaatggttgaaaagtcaacctggctacaattcccatctcttcttttcaacggtagatgcaatacaattcccagcttcctgggattaggggcctgtttggtttccacggacttattccaagtccatgtcacaccagatgtttgaatactaatttggagtattaaacatacattaattataaaacatattccatatccttggactaattcacgaaacgaatcttttgagtctaattatgtcatga

SEQ ID NO: 28353 - DNA, 3228 bp, Oryza sativa
atccctcaaaaactagaaatacctcgcggttataaatttgcaaattgcaaccatctcattgcagtaagaatagttgcaaccgccacatttattgtatgagtagtatacctttccactgggctatctgtaaccaggaaaacatttgtgtcgtgatgttttcttgagattttttttagataatcttgatatgtatgttgaggtatatgttagcatgctattcatctttatgttacataccattatgttatttaaaaggtaattctgatcattacaagtcatcaggacggagaactaagacactagtgagggagagttctttcacttctaatatggatggacttaagcacaagcacacaatgatgccttctttatgaacatttactaactcaaagtctaggttggagtgcgatacctaagttgattacatatagcttttttcacaagaaaattatttagacagatgcatgactacaatatacagacatcacagggtactgcaattatggcacatggccatctggttaccatttgttctgtatttgtttgagacattttttttgtttgctagatgagatcatttgcttcactatgagggttattatgattctaaagtaatttatgcttcttaaatacatgattggtgaaaggttgagcacaacagctactttaattctgtattccgaacccaccagaaaattactcttgttcctgtatagttctaatagattctctcaggctccacgttgtatcatagatatttttactttaaataattaacattttcaattgttaatgtaattctaaagcttaatgttgacactttcattgtttttcttttattttcgtttcagtggattggaagaaaacttatatttggaaaggaaaaggttgattatgagaaggaggaaacaagaaagaagataagaaaatttaaggaatcagcttggaaatgtgtctatttcctatctggagagattttatctttgtcagttacatataatgagccttggttcacaaacactaaatatttctgggttggacctggtgaccaggtttggcctgaccaaaagataaagtaatacgaattggtcctttattgcttcatgttcttactagttctcaggctggtgtatatctaacaattttccccttatctacagatggaaacttaaggctgtctatatgtatgctgctggattctacacatattccatatttgcacttatgttttgggaaacaaggcgttcagattttggcgtgtcaatgtcacatcatgttgcaactgttgcgctgatagttttatcttatgtgttcaggtctctttttgtctaacttttaatttttgttgtttcttgaatatgaactttttttaccttgattcaagcattactctatgagttagtagcacagggccttaatattttatcttcactgagtttatttcactcatttttattaacacttaactaatttatttctgaaatttttcttcatgaaccaggtttgctagagttggctcagtagtattggcaattcatgatgcaagtgatgtgttcctggaagtagggaaaatggccaaatatagccattgtgatttgcttgccaatgttgcatttcttcttttcgtcgtttcatgggttcttctccgtctcacatattttccgttctggattctcagaagtacaaggtaaatgtgatgtactgaccttgttgagatatgcctagaaaagtcagccagaattttgtgagaaagaagtttttttgaaaactagcctagaacccgtgcattgcaatggaaaacaaattgagtttttagcttattaaatcaatcaataagcacttatttgttctaagtaatactatgatttttcttattgaacaagtgattttgaaatttaggggagccaatagtgaaatgggggatgacttgttgaaaggtggtgtaatagttgtggggttcagatgttagtggtaggggtggtgtggggatggacaccaccacttctaacattttaagtactatagatgttgtgaattgtcaaaagcaagcatattatttactatgcgaaatttgtaccatatgaactttggatggtgaattctgctgttcttgccaatgccttcattttaaggggagaaaagaaacccaagccaacaagtaattcagttagaaaacagtaattgtatccagtaggaaaaagacctttgaacatagcacagtatcttatgcctcttgaaaacaaacttatctagatcatgccaccgcatgctgaaattaattttggattttatttccgatcctttctatgccatgataatcatacttatattgtacaaaatatatgtgtgatagcagactagaatactatgtacaatagtatcttgctgtcccattgtcccagcatgtaacaaaatggtgttttcattccttatttattagaagttacatgagctgactaagtcccgattgcttcagctatgaagtcttgttgaccttggacaagaagaagcacaattttgatggtcctatatattactatgtgttcaattctctcctattttcactacttgttcttcacatatattggtgggttctgatatatccgatgcttgtgagacaaatcaagacaagaaatgttggagatgatgttcgatctggtaagctctgcccccttagaatcttgtttttgcacaggatgagcatgcaaaattgcatgttcttattttcagtcccatctgcattgggacaagacaaagtctgcttataacatgcattactccaaccaccattgtgagttgaaaattattttgagtttgctaccatctaaaactgttctgctttatgtgcagactctgaaggtgaagacgagcatgaagattgattgctgaaccatctggtttctatcttctcatgatgctaggaacgccaatatctcagcttatgatgaattcttttcctggatgagggaacatgtgcagattgtttggatatgagtattattgttcatgcgaattcgctacagagccgagcaatcattcttgtcccggtaggatattttgtggttgatgcattgtatgcacgagaggtcgcactccgaaccttccctttggctgatcatcaccaaaaatattctttgacttttccggttctggaaaaccttacacggcaccaaaaggtgtaccagtagcgaaaatgtagtatataattccagaaatgcagtctacata

SEQ ID NO: 28354 - DNA, 475 bp, Oryza sativa
cgccatgagggtaaatttgctctctcttcagaattcagattgattgattggtcttagtgaccatatatgaagatgaattgaattttcttttcttttttttctaatggatatatgttggtgtgttcttcttgcagacggagatgcttatcaggatgcaagcgagctcggagaaaaatgggaaccccaaggccatgaaagtggcggcggcgatggaccgcgtccagtccgtgacgctggccggggaaggtcggaacctgctgcgggtggtcggctccggcgtcgactccaaccaccttaccagccgccttcgccggaaggtcggccacgccgacatcgtcgagctccggaccctgcacgacacctacccacgtggcgccgccgccggcagctacgccgccaccttaacgagcgggcgccttggcagcagcaacggcggttactactacttcttccaactcttcggcgggcgcggggg

SEQ ID NO: 28355 - DNA, 572 bp, Oryza sativa
caaatgactaaggttcaggaaggttgcttacacataaggacaagttttatcctatccatactatcagaatattttgttgcatattttcaagataactaccctcttatggaccataccgctgaattcagaaccattaaaatatctgaccatctgcttgtctttgtttggaaattacactggcacagactagcagcaaattcagttatagtagcctggattctgtgagtgacaacatgtgaaggatcatggcggcatgggtgtgcatcaattaagatgtaagaagacggggagcaggactcaagatatgttcccactcgtttgctagtgatccggcttccaatctgtcaagcaaaaaaaaaaagaaaggtgtcattataaatatatcacataatgaaaaggaattcaaatgattaggtaatgcaaaagtatggaataaaaagaagaatcagtgaggagatgaacctggacaataacatctggagttttccagcttttaacagattcagacagtagaatttgatctatgtggtctataaaacaaatgctcttatctagtcctggaattgatttct

SEQ ID NO: 28356 - DNA, 308 bp, Oryza sativa
aggcatctttataacgtaagtcagacggaggttagtgctactgcatatcaagaagacgagtgctatgatgaggaggatccacgccgaccagtttctagcattatatatgatacgcctttaaatagagatgatgagcgtggccctgtttttgaagctgctgaaattgctcggttgatgaaagaatctagcaaagaagtgaatgtcattggtgatgaagatgaagatgaagaagatgacacacttatggagtattttaacgaagaagatgactcagttatggaggtcgatagtgacgacgaatagttctg

SEQ ID NO: 28357 - DNA, 1093 bp, Oryza sativa
agctttctgtagtaagccttttcctacagcattttctactttccaatttaaaaaaaatgatgcatataattagaatatgatataattggtgggttagcttaaaaacagatagtatgtaatttgctctctgtaattgaagttgtacttatctaatttttttataggatttatgtttgcaaagcaacaaaattgaatctttcattaggagatgctctaacattaatttggcatgggcatccttcatagttgaagaatttgtcaggcttggttttacggtaagcttaactgaatacatagctctagcgtttttaccatgctctgacctggtttgctttagtacttctgtatagctccagggtcgagatcatccccacttgcactttctgcttcagtccatcctttgacaacctgcatatcatgttatgatgagcgttcacttggatttcatgctcttggctatgggagaggttctcggaagcctgcaatagtaattacatcatcaggaactgctgtatcaaatctccttccttcagtgagttggaacatttctctttcttactttttttatttccttacttccagcctttacagaaatacccaccatttgctgaaatcacaattcaacaagtcttgttgctataacttcatctgtgtagtgtatacctttatgctctctatgtgctactacaggcaatccatgcagtaatggatatatcaactattgagaaatagtctatagtgtttaatcaagattcatatgtaggtggtggaggcaagtcaagatttcgtaccacttattttactcacagctgatcgtcctcctgagctgcaggatgtaggagccaaccaagccatcaatcaggtattgtaactgaatacaatattacaaaaactaaaagtttctggcaatagctcctattctgaaaagagcttcgaatcagcactgttaattcagaattttggctaccttttaattgccttaaattgcttataagtattgtcatgcacataaagccaatcatgttgttcccttaactatgttttagtgtttacgttatttctcagcaccatcaaaattatgtcctacctgtac

SEQ ID NO: 28358 - DNA, 1988 bp, Oryza sativa
ttataggttttcattagagagaatttatcatgagatacttaagaagtaattttcatggtgaaggtctgaaaagaaaataaaaacaccgttgttagtttgttaccttcagtccgaacacctttcgccgaggagaagaagaagaagaagaaatggaaagtgttaaaaggcaacccaaggtgtatttctctggaaactgggccatgatcttcatatggttctatattgggccgttctcgcaagaagtgatcattaatgggccaaatcacctcttgaaagaaataatgggccaaatgatcaaatccatgggcactagcccagtaatgatttattcttctttgtgaagtttctgaaatagaaatttcgttcttttcctcccttctgaaccattatacttatttcctaaggaacatccgaaaggcaaagcatgtgttaaaaggaaatcttacatcatatgggttctgttattctcttcaaggaagagaaagtcccaccgaacacgtgttaaagtagcagaatcacaaaagacggttgattattcctgggaaattttgttttattcgggagacatttcctggttcaattctcttctcatttttttacggagaaagtgagagctttttactcaattaaagatgctttcgttcaccaagaattaaagattcaattaatggccggtggaatatcacccaaattacctatttaaccaaaccgctaatccagctgaggaattttttttttagaatgggaaatcgcaaaaatatagatcggttaggcaaaatcgtaagtttagcaccctgtcaaacaaccgtggtttgacggggacctatcaaactgcaacagttcaatagggtagttggtcaaaataaaaataaaaaaagtacataaacagtgacgctacagtgattggtaggggcatgcaactacccatgttcgatatgtttgatgaacagtgccactacagtgataattctcttttttaaaatttttttatcacctcgacaagtaccatgtcgaagatagataccctgtcgaacaaccgacctatatttttgtgattttcgtctaaccgacctatatttttgtgattttacttaaaatcgtattatttcttaaaataaattctgcagctgagtgctacactgttttgctctctccgcatctttgataaagtcgatgtaccccatttctgtgaagatataaacaacattcacaaaattagtacgatcaattgttacgaacttacaaactgaatcgcaaaaccaaaacggtgttcagccaacagaaaattaactcggggttttgcaggcggcagcttgcgctgcatcacggaaacatccgattgtgcatcacgcacgggttaattaacaaaactcaacttgtttctaagtagggaaaaacaaactagagaacgaaagaaattaatgtttgtttttgaaaaaaaaaaaagagaacgaaatggaagagattgaagatcatgcatgcatgaatcgttgatagtctgatgaagttggattgaccaaaaaataataatgtcaactcctaactccaacctccactggatgattttttttttttgagccgataatcatttgagttatcatttttctcacctgcactcgagcttatcactttcagctcaccaaaaacccgaaccttgtaacccatttttgtacaccccgatcggaccgtccgatacaccgactgtcctgcatccaacggccgagatcgatcgctctgcaccaatcaaatggagtacaagcgacacgtacccacgtaacatccattaaattacctggagtcttcctcgcagtcaaccggccataaaaaattttcggctccccgcgtgttcgttgataattggttcggatccccgctggttcgtcgcaaattaaaagaatctcttgaaaaaaatgtgccacccaacgccgcacccgaaaggtgaattggaattgccctgaaaccggtagtagcatctgtgtgcacgcata

SEQ ID NO: 28359 - DNA, 1672 bp, Oryza sativa
taacgtaacgtggaagctagtcagtagtcccttagatatacaaattaagcaacagaacaagtcgtgttatcggtaaattatcatctcttgtattgcacatttgtcttctggggctaatgacaattgtcaagagttcgggtgattcatagtcacaccaaacgtagataattggatgatttgatgtgttagacacagagacaacgacagagggtggatgggagatcagtcttagccatcgctgtattgagttgcctttctgccaggctccacaatattgggagaaggcagagcacagataaaaggtcttgcgcaatccaagtgagaaaattgacatttgtcaacaaaatggaagaaaaatatggcttatgtatttaattaaacctctgcagtattacacagagcatctttaataagtattgaacggaaaaatatatagtgtccagtataaacttcatgtacagtacaaacatgaaaactatatatcatcagatacatgaatgtacacacctaagatggagagtaaaaaatttactcaaaataatatggacaaatcacatatatctatttgtgcatcctatgatagctttttagtttacactacacagtttcccgtgttggatagagtatctatcattaaatatgttgtttagaaatagagcggattttttttactttggaccacactttattatcaaaaattttgttttcgatcctcatttgatctatcttctcactttgtaccaaataattttatatttgttatactttagtccaccttaactctcttttcaagccatatctatcaaatccttaggcaaaaatatggctggggcatggatgagggagtttattgaggtgtgagtgatccaaattaaaactttgttaataaaatatggtacaaagtataattaactcttagaaatatactaagtcgtatgttaacagtttaattttgagcttgaccaactattaattaaataatatttaggtttttcaaaaaaaatattattgtattcatgttcaaaaatactagcccatgagtatggttctataactttgagcaaaattgtgtaagagatatttacaatcaaatttcattgttaggcagttaatatagtacgtgatgtgatatatttcagtactataaatcgatgtgacatatgctaatatcatgaatctgaacatttatttattcagattcgtgatactgagatatatcctactccctcatcccattttaagtacaaccataagtttccgtgtctaatgttcgatggagtatagctagcttttggtcgggaaagcattccaaggatcgaaacggtaatttcccgtctgtacaacgatgcgtcgtcgatgactcgatggcaaccccacccggccagattaagcaacgtcgcgagcacggttaagttaaccaacatacttgcgcaagttgcacatggacatacccgtgcagttaattagtttggtcgcacgcgcgcgatcctttctccgccccatagctgctaattaacatgttgcgtcatcggagacgggatcggagaacgtgttttccgtgacgcgcgcgccactgcgcctcgccgaccgcccccgatcgacgacgtataaaaacgagtacgacgacttggacatgagtccgcgggttttaattttcgcccgtcgccaccgg

SEQ ID NO: 28360 - DNA, 1126 bp, Oryza sativa
ttttttttaaaaaaaaacgaatagggtatatttttatggaacatggaaaagttatcgaccaacatgaattattttttataaaataattacacgtgaccaaaacaatactactacgacgacgacgaaattcaagtaaaggcacgtggtggtggacgtctgctcccgtcagcaaggagatcctggcatgtttggctgatatatctcgtatgatatttgtgagtggatggcccttttgtttatgcataaacaaaatccatatggattgttttgggggcccaacagtgagacatgccctgtataataatcctccccttcgagataactacacacaaagccgagccaaagtctctaggtcaaagtcaacagttaaatatgcatttctctcaaggtctatctaatcagtgtgtttctttcgcttggctaccaagtactagtaccaaataaacaagatattatggtattgtcaaataaacaagatattatggtattgtcacacatggcaggtacaaaccactgagctaaccacagtagctcacaggccattatcctgtcagtacttaagagaagtgaaggcacgcaacacccgggtgctaatctccttagccctctcctccattggagctatagctagcaaactttttttttttactgagcaaattcagttagcgaagcgaaaaccatgaaggtaattaacatggttccttttctctcatgattccgtgttttctgcaagttggagtccgaattgggtgtgtttataatttctacgagttgcaccacgaattggtgcgtgttttatggaggtttatttgcagagtttaattggtgtttcctctgaaagtttcttctacgtacatattttgctttggtctgcttgaaactttttgtccgagacacaggcgagattttagttaatccatgtctgaagaacttatctgtgaaatccatgcgttgaaaatttcagaaggagatcattatcaggatttccgtgaaaaccgacaaatgccagaagaaggccatgaaagaggctgctactgtcagcggtaatcatctttgttttgatcttgttttgaatgcgaaatcgtggttgtgttcttgttgatttcatggttgatttgattccggt

SEQ ID NO: 28361 - DNA, 769 bp, Oryza sativa
cattaaaaaaatgtcttaataggctaacttctatgccatttttctagatataagtgcagtacttgtgccactcatgcatgttcagaataggactttctttgcaccaccggattactttgaggaccccaccacaatcataaaaaggctaacaagaaaaattcaggtgtaaaactgtttctgttgtctgacaatatgatattaaaccatgtaaccaaatttatacagggaatgtcatatcacagaacttcgaggattttccttgctaaattcaaaatggcttgtacacatagtctgtatctcgcaccaacttgataaatattcaggtagctagagtagcaccacagaatactgaaagttgttacctgaggaataaagaagtaaaatgaaccaattctctcctctaaagacaatagttccttgtcatatttaacacctactgatccataggctctaatcaagtgtgaattaaacgaaagatatctgcagggacaaacaggtcctaatttagttagaaacaccctgcatcacacgtacgctacggaaagcaatagagaggaggcaccttgatatcaaatcaaacccattatctactcgagaggaaccatgaaagcaaattgcagagccagcgccagagatttcaagctgaattgatgaatcagtggtttgcttcctcgcaaataaaactgaggaaacaatgatgatctcttaaactgtgtgcacagccatttgagcgccttcgtactgggtggaacaagcacctgcaccgttg

SEQ ID NO: 28362 - DNA, 2619 bp, Oryza sativa
caatgttggattagatggatagaagttgggtgcacagcaaactatttcctgattacatggacggcgtcaaaaaatttatgagtttcattcaggggaaatccattgagaatgttgaattcctatgcccatgtaacagatgccttatcagaagtaccaaagacaggctgttgggaagaaaccccatactgatgaatggtatggaaactacttatactcggtggattcatcatggagagagcttagatgtcaatgttattgacgatcctattgatatgaatgaaaataatgatggttccacaactatggtgacagaggatgacaactatggtgatcgtttggaaggaattttaggagacctacagactgcagcggcacaagcaagaccggatgtagaaaatcaagttggtgctgaagaacctcgtgataaagagtcatttttgaatattgtcatgagagaggcaaagcgtcaactttatcctggttgtaccaaattttcaaggttctcatttgtggtaaggcttcttcatatgaagtcattatataggatcagcaattctgctttttctgcacacatgaagctattggctgatgctttcccagaatgcaatacactcccaaaatcatatgatgaagcaaaaggcattctaaaggaaatgggtcttggttatgaatcaatacatgtgtgctacaataattgtgtgctgttcagaaaggaatatgagaagcatgacaattgctcggtttgtggtctctcgagatggaaagatgcagaaagaaagaagattccacaaaaagtgttgcggcattttccattggcacctaggctaaagaggatgttttcgaccaaagaagcatcagaagcggcacagtggcacaagttaaagcgacagcccgttgagaataatatgagccacccagctgatggcgaggcatggcaagattttgaccgtgaatatcctggttttgcaaaggatgcaagaaaccttagacttggcctagctactgatgggttcaatcctttttcagaaaagaacacaaaatatagcatgtggcctgtgtttgttgtgccctacaacctagcaccgtgggagtgcatggaggaatcaaactttatgatggctttgcttattccaggtccgaaatcacctgggaaggactttgatgtatttttacagcctcttgtagaggatttacttgagctttgggcaggtgttgatacttatgatgctattactggcaaatcatttaaacttcgtgcagcggttttgtggtgcatccatgattacccagctttgagtactctctcagggcgtacaacaaggggctattttgcttgtctccattgtgacaagcatcctctttcatatgccttaaggagcaaaattggttattttgggcacttccgtttccttccaaaggaacatcctttgaggagaaacaatgagtttactggacttcacgaaagcaatgatccaccaggtaaattctgtacagaagagttgctggctgaattggagagagttaaagacgtcagacctgggaagccacaaggaactgggaaaaggaagcgttccaactctgaagggggtcatgtggaaatttggagccggatggttagtttatggaagttgccatattggaaaaaactaaaggtgagacataatcttgatgtgatgcacattgaaaaaaacatatgtgagaacctaattgggacaattctcaatataaagggcaagacaaaagacacagctaaagctaggcttgatttgaaagatttgggtattaaaaaggagctgcaatttagagaggatggagagatgcctcatgctagatataccttgtctactgaacagaagaaggctttgtgcttttttacaagaggtcaagtttccagatggatttgcttccaacatctcaagatgtttaaatgctgagggaacaacggtacaggggctgaaaacacatgattgtcacattcttttgcaaagaattttgcccgctgccatgagaggatttctggacagtgatatttatgaagcaatagctgagttggggatgttttttaggaaattgtgcagcagaactcttaacaaggatgtgctggttcaaatgaagaaagaaatccctataattttggtgaagcttgagaaaattttccctccagctttctttgatgtgatggtacaccttgctatacatttacctgatgaggcattgctcaggggtcctgtgcaatatgggtggatgtacccaattgaaaggcgactatatactttgaagcgatatgtgaggaataggtcacgaccagaaggttcaattgccgaggcttatattgctgatgagtgtctgacattttgctctaaatacatggacgatgttgaaacaagatttaatcgggagccaagaaataaaggtttctccaatgaagaagcttatggtgttgatgtttttgggcatggagttaattttacttctgcacctgaatatgtatatgatgaaaatggcattgatcaaatggtgtggtttgtgctaaacaactgtgcccaagttgagtattacgtcaagtatgttctatatacttacttttaaacttcttctatatgctacctttgtgttgca

SEQ ID NO: 28363 - DNA, 2953 bp, Oryza sativa
tcttcaatttttataatagtagacacttggtgatgggtactagttgagcctaaaaatgtttttaaaattataatcgtgatgcaccactccttaggatatgtacagcaccacatgacatgataaaccatgtgcggtgcttcacatacagctctcgccggacatcggggatcgccttgtttggcgttgggcgagtgacctattgtttttagtgcttttagtgcctgattcgactgaccttctttaaaacaatcatatctttttcatacggactcgaaattagacatataatatatccacagacatctacagaaaaagttacatccgattctccccgctttgccgggttcggtgaaattagaactaccaaattccgcttacaaaattatgttttctaggcgagaagctccggaaccccttggatagaactttgaaaaaattcctcatgcttcatcttttgtccgtttgagctaagaatttctatggttggttgcagtgtgctccgagactcgaaaaaaatatcaaaaaaaaaaattcgcatatctctcctcagcactagagagagaaagcaacattgactctgtgcgttcgctccgtaggtttagtacggtgtgctgtctcctcccagctgatcatgttgtgtaacataaactctgtacatattgaagtgcaatccttttgcgtgttcgcgaaaaagtaatgggatcatggggcttgtttggccaaaattcctaattcctaaatttagattagtggaatatgactaataccgatggaataagatagattcaagggaacaaatttgcttcatgcattgttttataccacttactagctagaagcactaattgggaaattatcaacacctatatagttttattaatcattatcaacatttttttaagataataatcatcaacataagggatcataacatgatgaactatgtgtatcatatatggtgcttgtctaacctgattttctaattccaacaaaaaaaattaatggagtatgaaggaatgagacagattcaatcattcaaggggaacaaattttacatagtagcaaatctcaaatataagacttattataatatatactcatctagaaggttccaaacaaaacaagggctttgagttttcaggataaggggaaatcccgcgcgcccaagcggcttggcgcgcttgatgtgcgccagcccgaaatatttcacagtccgaattaccttactacccttaggttcataaaatataaaatatagagaacacttccatcagaaaatttctcaagggtacatcgtaattatgaaacagcacttcccaattcctccaaaaacctagccgccactcatcctccaaaacccatcttccagccgccacccatcttctagccgccacccatcctccaaaaccctagcagccacccatcctccagccaccttatctcaccggcgcatcaaggcctgcccgccgccacgcatcctccagtttcccatcctccagccccgatggaaccctagaacgctgttggaaggttccatccgccgcccgcgcgcccatcgtcactgggaggctccgagcgcggccaccaccagcatcgctgttatggcgccgaagaatccaaaaggaaatcgggtagcaggtatagtcctaacatcacctcgctcttgacttttttgtggcgtttggatttgtggagaagaccggtggatttgggaaattgagggatgatagatgcaaagctctgtttgctggattatagttagaacttccatttgcagtgttggtcattttacctgaaaagatagggtacatgcttctgcctttgcagtaaaaaataggttcacaagatgattcttgttcataccctacagttatacatgaatatggaatggaatggagggggagagagtcatactttgcttaattactggtaaacaaaaatcaaagagtacaataattcatttagcatatggcactttcagtcttgttgacaaattcctgatcagttcatctattctcctgatgcttgtgcatgcaattcatgacaatattttaaacaacgtttagttgaaaggcatctcaaagagccagcagtatatatcatttttttactagcaatatatatctttgagtccactaaccattaataatattccaattcatctgtacctcatccaagacatggtgtgctattgctactcttgtggcttatctattgttcactgagtcagtaacacattaatttattgttgctgtctaccatccaccagttcatctgagtccatacgaattggagcgcctaaaagaatgcatgaagaacagtgcaaggctgaaggagcttggacttcctgatcgctacaccccagttttggaaggctatgttggtgttcattctgaccagaatcaaagtggagattcggagtccgagtatgatcctttaaaggatgatactggtgaaggagatttgattgatgatgagaatgcaaaggttgtaattcctttatgttgacaagtcttaacttgttatttttcttcctaattcaatgtaatactatgttgaccaatccatgcttttctttccagcagtgctctaaggagaagactcgcaagaactgtaacaacaaaacttcaagtatccagactggtggagtcaagtttcggtctcgcaagagagtttatgcagagcaaatgactcctaaagttacaaggtcaaagaaaagcattgcccaacaagatgcaagtctcacaccaagtgatatttgtatgccagctacatcacaagctaacgctggagatctcgatggcaacttagatgaccacacacaggctgctgttgaaggccagttctactgccacatttctttggtacattccattaacatgagtcagctataaaaatgtttaacttgctgatctaagtttatggtttggttaccttttgaaaatattaactt

SEQ ID NO: 28364 - DNA, 768 bp, Oryza sativa
tggatcttgatagctaaatcactaaattcttattgtttaagatgttgaaactgtataccattattgttatagttgatgcgcctatgcctcagatcacactattcatcaccaaagaacaaaccttaaatcttaaaccattatactccctgactaaccactgcagcgcaacacaacaggggcccctccgtaacaaaaaatcagattcagagtaccagataatcattagacaagagaagaggacgactctccaatacagcaatgccatgatgtaccagcacatctctcctgagaatccgagcgtttgatctctccccccacaattccaggaaacgcgaaacgcatgccaagctagcccgacaagcaatcattaaaacgctaaaaagctagcagcgcctttgtttccccccacacacataaactaaacccagctagctagctatccaacgcgatcggattggttggtgattcctccaacgcgaaatccagcccggagaagaagaagggaaaacacacacacaccagcaaaacaaaagcttcgctgctttccgcacccaacaggtcaacagtaacagattcacctcgaagacgaagcagtcgaggaggtagcggacgacgaggaagaagacggcgaacaaggggagcgcgaagaagtcgcggtacgccgggtaggcctcccgctcccagtccaccgccgccaggagccggcccgccgccgccgcgacccccatccgcgcggagccgaatcgagtaggagcaagaaatcgatct

SEQ ID NO: 28365 - DNA, 6391 bp, Oryza sativa
tttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagcgcctgtggtcgtcgccctagtcttccgctgtttttcgttgtctttgagtgtgctgggccttcgttgcccatgtaataattctatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagctatattttcaaaaaaaaaaaaaaaaaaaaaatcctttattatttgtgaaaacccgctattctctctttgtcttgctgcttcatttatcgtcaaaatctggtctttaaaatgttgtttctctttttgtttttgtttgtagatggccggcagcgttacccgtcgtggtttgcacatgactggcttcgtcttggagctgcggggcatgtgcgtggtcttggggtatccacatggagtggattaccaggccaggccgctcccggagcaagagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgccaccgtcgtgcacctggcacgcatggtggaggcgtacgacgcggctcgtatcgacttccaccagatggtgagccgtggcatggtggagaacaacttgaagatcctggagctgcgtcaggagaatctgcagctcaagaaggacctcgacgcgttggaggcgcagctgcaccagctcaagatcgcccagggagagatctgccgccccaagcgtcgccgcgtctgccgcagccagaagatcaccgcccgcaagagcacctccaggcctgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgtttttcctcgtttgtcttttttgagttgtgtggggcatggttacgccggtgtgtggtgtaactatgtcggagcctgtcttattttgtttgcctaagcaacttgaacattaatgaaccaatttaatagcagtaataaatttaagaataatagtagtcgtgggtggttagttttaattgttagctccttctctgtttgctggttctgggtggggttttcagatggtgacgaccaggagaaatgttaacaccggtgaaggcaaccaacccgaaggcagcaaccccaaccaccaaggcaatccacctccgccaccaccaccagacaccaacgccattctcacccagatcctcgcccagcaagccaacatgatgaatgctttcctccaccaccttcaaaacccgccacaacagaatgctcccccaccacctccccaacactctaaactcgccgagttcctccgcatccgcccacctaccttctctagctccaacaaccccgtggatgcgttggattggttgcatgccgtggggaagaagttagacactgtgcagtgcagtgacgaagagaaagtcatcttcgccgcccatcagctgcagggacccgcatctctctggtgggaccacttccaggctacgcagccagagggacagccgatcacttgggcccgcttcaccgccgctttccggaaaacccatgtgcccgccggagtcgtggctcttaagaaaagggaattccgagagttgaagcaaggcaaccgctccgtgatggagtatttgcatgagttcaacaatctggcccggtacgctccggaggatgtgcgggaagatgaggagaagcaggagaagttcttggcgggaatggaccctgagctgtccgtccgtctagtctctggggactatcctgattttcaacgactggtggacaagagcatccgcttggaagccaagcacaaggagctggaatcgcacaagcgtcgcttggcgaatttccgcaatcaacagggtgctaaccagagggtccgctacaccaatccctacccagggggatcctcctcgcagcagcagcagcagcagcagcaacctcgcccagcgccccgacctcaattcgtggtgcgcgtcccacagcagcaacagcagcagaatcagcaagggactcgtgcgccccgtcctcctacgccagctgggcagcccgttcaaggccgcagggacgcttcaggtccgcagcgtctgtgcttcaactgcttcgagcccggacactttgcggataaatgcccaaagccaaggcgtcagcaaggccaagcgcctccccgccccaacaacggtggccaggacgtcatccgtggtcgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttagaaaccctctgcttatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgaggcgcactgtcaccctgtaccgagggccagaacaaccggttgttttctttgcacctccaacctctgtcagaagttcagaactgcagcagataggtctgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaactcaaaggtgccactgtattctccaagattgatctccgttccggatatcaccaactacgtattcgtgaagaagatattccgaagaccgcattcactacgcgatatgggctgtatgaattcacggtgatgtcgttcggcttgaccaatgctcctgccttcttcatgaacttgatgaacaaagtgttcatggaatacttggataagttcgttgtggttttcatcgatgacattctgatatactcacaatcagaggaagaccatcagcaccatctccgtctggtgttgggaaagttgcgggaacatcaattgtatgccaagcttagcaagtgtgagttcgggttgtccgaagtcaaattcttaggacacgtgatatctgctaaaggagttgctgtggatcccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatacaggacggtcatgtggtagcctatgcttcacgccagctacgacctcatgaaggcaactaccctacacatgacttggagttagcagcggtggttcatgctctaaaaatctggcggcactatctcattgggaaccgctgtgaaatatatactgatcataagagtttgaaatacatcttcacccagtcggatctgaatcttcggcaaaggagatggttagaactcatcaaggactatgatgtgggaatacactatcatcctggtaaggccaacgtggttgccgacgctctaagtcgaaagagccattgcaacactctcaacgtccgaggcattccacccgagcttaatcaacagatggaagccctgaacctaagcatagttggtcgcggattcttggctgcgttggaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccggatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcaggacaccagcgaccggccggacttctccaacctctccaagtgccggagtggaaatgggatgaaattgggatggatttcatcaccggacttccaaaaacccaaggtgggtatgattctatatgggtaatagtggatcgattaaccaaggtagctcgattcattcctgtgaagaccacctatggagggaataaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgctccgcgcatgtgtcctagatttcgggaagacctgggataagagtctcccctatgccgagttctcctacaataacagctaccaggccagcatacaaatggcaccctatgaagcgttgtatgggcgcaaatgccgaacaccactactgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcaaacgaaagggaagcttgcacctcggtatgtgggtccctttcgtatcactgctcgacgcggagaagttgcttaccagctggagttgcccgcctccttgggtaacgtgcatgatgtgttccatgtgtcgcaactcaagaaatgtctccgagtgccatccgagcaggccgactcagagcaaattgaagttcgcgaagatttgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaatctatcctcaaaattgtgcaaaagaataagtaaaattcattgtgaaagcctccaacaattaaaatgtgcaaagataaaagtcaaatgaggctcggcaggatttttgtatatttcctaaaagcctaaaatacttaaataaattttagtggaattttcagagcacaaat

SEQ ID NO: 28366 - DNA, 369 bp, Oryza sativa
gatacaaacgatgaagctcccgaattggcataattgatgtataagaagaaataggatctgttgtccttggaaccgggcgcggccctctttccgctattatgagcgggttttgggttagccagagcgggccaatagggataaacaaagtatggaagtagttgtgaggtaatcagattgaacaaagcgtgctctcgatgctcccgcagttgactcatttcccgacgttcttgttgctcgaagcaagctccaaaagctgtgcttaaggctgttgttgttcctgggctggattcgactggcgagatagactactttgtttgcgactttccgtgctttactttcaaccgcgatgaggtcagcgtttcttagcgg

SEQ ID NO: 28367 - DNA, 421 bp, Oryza sativa
agcatacttattataaaaatatataagaaagtctcatccctaataaataaatgaaagtagatttacattcttattctatttctagggggaatgttgaggcaaacttacgatgctgacaagctggttaggtgccgagttggattagacatcgcaggttttagtttaagaattgggaagaggttaagaacctagtggaatccactgcgaggggaagtgctgaagtgaagaaaagccccattccttcgatagggattaaccctgctgcttacctttaagatcctaagctacaccactgcgaaatctaccaacgtcggggattctagcccaagatcaggaaagagcttcgttccctcctgcctgccggctagagttataccttccacccttgcttctgactgtgaagtagcgtaaaaccctctct

SEQ ID NO: 28368 - DNA, 306 bp, Oryza sativa
gttccctgggattggctttgggcctttctgcgcagcttaggtggaaggcgaagaaggcccccttccgggggggcccgagccatcagtgagataccactctggaagagctcggattctaaccttgtgtcagacccgcgggccaagggacagtctcacgtagacagtttctatggggcgtaggcctcccaaaaggtaacgcaggcgtgcaaaggtttcctagggccagacggacattggtccttgagtgcaaaggcagaagggagcttgactgcaatactcacccgtcgagcagagacgaaagtcggc

SEQ ID NO: 28369 - DNA, 693 bp, Oryza sativa
ttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatacaaataatcaatcagagcgcagggagccatctcattatctttccgtaaagaaaaactatggtggactaactgatctttctatcagttgataaaagagcccaatgcaaaaaaatgcatgttgggtctttgaaacagttcgaatcatttcgataataatccgtttgatctgttttaccgagaaggtctacggttcgaatccgtatagccctaatatgtccttttttagattttaggagagatatcctacgtttcctttagtatagttttcatttccctattagcacttgtttatagactggacaggcgcctgcgccataaaatagagataaaaggattaccagaggctcattcatcgaaaatatagagacaggaaaagaaaaatgaatttctatcaaatcaactgcaagatgttctccatcttgcaaattcctactttgtttgaagtatattactttgcttatctatatctatagattacctaaatctaaatcaatctacgttctgaaatagagttctttatttttataga

SEQ ID NO: 28370 - DNA, 169 bp, Oryza sativa
ccgtggacgaaccttgcggaggaaaccttgggttttcggggcattggattctcaccaatgttttcgttactcaagccgacattctcgcttccgcttcgtcgacccccgctttcgcggttgcttccctctaaggcggaacgctcccctaccgatgcattttgacatccca

SEQ ID NO: 28371 - DNA, 445 bp, Oryza sativa
  unsure (1)..(445): unsure at all n locations
gacttgccatggtaagggggagaaggggaagaagcacacttgaagagcgcagtacaacggagagttgtatgctgcgttcgggaaggatgaatcgctcatgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagat

SEQ ID NO: 28372 - DNA, 340 bp, Oryza sativa
  unsure (1)..(340): unsure at all n locations
tccgttcccttaaccaagccactgcctatgagtcgcgggctcattcttcaacaggcacgcggtcagagatcactttcccctcccactgcttgggagctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctactcgggtcagagcgtaagctagtgatgctttcggctactggactttagccatctagggtgcggcactcaaccgcttccctagcagcacaacgc

SEQ ID NO: 28373 - DNA, 11351 bp, Oryza sativa
  unsure (1)..(11351): unsure at all n locations
attctttttcaggtggtctacgagctgccgctcaatctattagttatgaaatcccattaactttttgtgtactagcaatatctctacgtgcgattcgttaaaataggatctttttcctctgaaattcattgaatatttatcctccttttcttattctatattcaggttagtaagttaaactagatagctatatgagtgaaacaaaactgcttattaatttgtagtaaaaagaaaaaatctcatttcctatgtacaagaaaaaatggaagtaaacataagcggtgtaaattctttaccccaaggttgagattttttgattagtcatcatatcttgaagcgggcaataataagggattcccgatacagaaagttgtaatcataagggaatccatcaaaagttagtgagggattagaaacactaaagtacataaaggattagtaatgagggaatctaaagcattagatatttttcctcataaaaggaatcataataaggacttgaaattggtggaaatgagcaagtagtactttcttcggattccgatccagagtatgttcccattcacttgttaaggaaatggctatcaagaacgaattaaccctttattccttttttctttttaaatacccctcggggaaagaagaataggacaaaagatatggaatgcaatacaaaaaaaaagatctttatttattctttccgtcgtttatcatattcatacagaattcttcatgaactaatacccaactcttttcgtttattaattgttataacgagtgttttattccaagattaagttattgctgaacaaagaaaaagtaccattatattataaaggatgagatgaattccgaagcgttttttattattctagcagacagaattcctttggtctaatttaggacgttgaaatcgattttatcttagataattctaactacgcccaagaagataataacgaaatgaaacagtactttccttttttctgatcatagaggagccgtatgaaactaaggtttcatgtacggttttggaatagcggtgggaactgtgatgttatcgtcgactatgattatccaacagttcaagtacagttgatatagttgaagcacagtcaaaatatggtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatggtttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatctttattacattaactaaagcttatttatttctcttcatttctatcacaataagatggactttacccaggatgagaatggatcagttattaaatcttggatggaaatttcttttacctatttccctgggcaatctcttattaacaacttcttcccaacttgtttcactataaaataagataatacaataacagtaagaatattttcaacacaaaagtcctctcaaacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgngccaatacatgacattcttgtgctatttgggggatttgttcttctactagggggtctaggggtggtattacttaccaacccaactttttctgctttttcgctaggattagttcttgtttgtatatccttattctatattttattgaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaactcatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagacccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacgtatcttgtctttatcactttatcatgagttcttttccttggttaacaatacttgttgttttgccgatatttgcgggttcattaattttctttttacctcataggggaaacaaaatcgttaggtggtatactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccggttacccggaattcccgattattctatttcctgatgctagcaatgtatagcggtcaaataggattattttcttcgcgagaccttttacttttttttatcatgtgggagttagaattaattcctgtttacttacttttatccatgtggggggggaagaggcgtctctattcagctacaaagtttattttgtatactgcaggtggttccatttttttcttaatcggagttctaggtatgggcttatacggttccaacgaaccaagattagatttggaaagattaattaatcaatcataccctgcaacattggaaatactattttattttggcttccttattgcttatgctgtcaaattgccgattatacccctacatacgtggttaccagatacccatggggaagcgcattacagtacatgtatgcttttagcgggaatcctattaaagatgggagcatacggattgattcggatcaatatggaattgttacctcatgctcattatctattttccccttggttagtaataataggagcgatgcaaataatctatgcagcttcaacttctcttggccaacgcaatttcaaaaaaagaatagcctactcctccgtctctcacatgggtttcattattataggaattggttccataaccaacattggactcaatggagctattttacaaatattatcccatggatttattggggctacactttttttcttagcgggaacggcttgtgatagaatgcgccttgtttatctcgaagaactgggaggggtttctatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattttgaggattccggcccgcgagaactctttcttttaatctgtatctttttaccagtaataggaatcggtatttatccagattttgttctctcgctatccgttgacagggtagaggctctgttatccaattattatcctaaataggattttttttcttctactagtccgctctatattccatagtggaaatactcaaaaattcagaaaaaagtaaaagagtctaattagatctatctcgaatttttgagaaccctttgagaaggcgttcaaggggttctcaaatcaaacacaaaaatggaagttttttccatttcattaaggttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctttaggatcccaattccagtaggatccccacgcctcattagcccatactgctccacaaagaatacctatggttaaaagggtaaaccctagactaatgacacgataactccaagaatccaaacgctcaattaattgatatttgtaataatttggaaataaaggaaaaaaggtgctttttaaagcacttctttttgcatagaaatattcaatctcattaaagaaaaatgttttgcttaaaacatttttcttctttttcgaaaagaaatctaaattctttcgaaatctaatcattagaagagcggcggataataaggatccgcacaaaagagtcgcatagcttagtaacatcatactgacatgcatcattaaccactgagattgtagagcaggtactagtattgtggattgatgcatttcagttaaaagacccgacgtggcaaagccttgcgttaaaatagtactcggcgtagttattgtgcttaaatcatttttagagttctgtatcttaggaatcatatgaagaatatacagagcccatgaaaggaagatcaatgactcatataaattacttaatggaaaatgtcccgaagaagcccaacgagaaactaagaatcctgttatacagaaaaaagtggctatcattcctttttctgacgaatcacgcaatcccccaagttcacgaactaataaggttattaaatgaatcgtaatcacaattgaaattgttgagaaagaaatatgagttagtatatgttctaaagttgcaaatagcataaggagaaggtcccattacaaaattggaaatttcgaattgaatccattttattttataatctattgtattctttttcgagactgccgccactcggactcgaaccgagatgcttgagcactgcttcctaagagcagcgtgtctaccaatttcaccatggcggctaagttgaaataacaggtttattaaaagaatattaagttattttctcgcgaatcgtcgagattggaagattccatagaatttaggacattagaatcttcattaaaatagacttcgtttggtagtatcgttgcgaattttttaacaaaaaaattcttgctttgcccaatagaaactttgaaagagttggaacaattttttctcagttgcaatatagaactaatttttttgttaatttaggataagataggtagaagttgtaagtcttattgcaggaatactctacttttcataatagaatcccctttttttatttattatacggattctattacgaaaagttcattgataggaaaagaatatttaggtcacagtataccaaaaaccctttttttatatatcagagaggtttgttctaagaatattgtaccgaggaattcgacacataaaagtaaactcattaattaatcctaattattcctaattattcatattaaataattggaatttttgggggataggtcaattcatattatcccaaaaccctattatttgtttgttgccgagaaaaaccctttggttttggatgctcgctgacgccagaaaatgatcttgattttgctaaagaataagattgtactatggaaaaataagtctttttcttccaaagatttttacgaatacgcttttttgacatcgaagtacgtttttttggaactgccattcaaaaaggaaattacttttttctagttgtatgtgaaagacatctattgccgcaaatcaatccatctttcttctttttcttagtatttatacttagatactaaaagatattgaaattctgaattcttttttacttcattttgtctaatgcggataagacaagagttttttaacatattatatattttttttagactttgttttaataatatagaatatatacaaaggttttctatttaaatcaatttatatttcaagtatactctccatatacagatataaggtatgggggcctatcccccatataagacgggaggataaaaggaagggaaaattcaatcaaatagttaattaaagtattccagaattgaattccaatcaatttgagttacgaaacaagggagctgcttcattttaatacaaaaaaatattaaagtaaaatgattcaatcttttttttgtattttaataaaagtccttctttaggtaataactaggtaacgaagttatttcattaactttttgactttaaccaacaaaacctattcttattttttgattgtttcaatgagaaaatttttgaaaaattaagaattctagtatttttttattccttcagaaatagataagaattagtttggtgaatcggaaacttttttcaattttatagaaaaattgaagtaaaattttcaagtaaaaattgcaatttcttttcttatggaacatacatatcaatatgcatgggtaatccctcttctcccacttccagttattatgtcaatggggtttggactttttcttgttccaacagcaacaaaaaatcttcgtcgcatatgggcttttcctagtgttttacttttaagtatagctatggtattctcagttcacctgtctattcaacaaataaatggaagttctatctatcaatatctatggtcttggaccgtcaataatgatttttccttagaatttggatacttaatcgacccgcttacttctattatgttaatactaattactactgtaggaatcctggttcttatttatagtgatgattatatgtctcacgatgagggatatttgagattttttgtttatataagttttttcaatacttccatgttgggattggttactagttccaatttgatacaaatttattttttttgggagcttgtgggaatgtgttcctatttattgataggcttttggtttacacggccaattgcagcgagtgcttgtcaaaaagcttttgtaactaatcgtgtaggggattttggtctgttattaggaattctaggttttttttggataacaggtagtttagagtttcgggatttgtttaaaatagctaataactggattcctaataatgagattaactccttgcttactattttgtgtgcttttttattattccttggtgcggttgcgaaatcggcacaattccctcttcacgtatggttacccgatgctatggaaggacccacccccatttcagctcttatacacgcagcaactatggttgctgcggggatttttcttatagctcgacttcttcctcttttcatatccctacctttgataatgagtttcatttctttaataggtacactaacacttttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattattcttgggatccggatctgttattcattcaatggaacctcttgttggatattcaccagataaaagtcagaatatggttcttatgggtggtttaagaaaatacattccaattacaagaacttgttttttatggggtaccctttctctttgtggtattccacctcttgcttgcttctggtccaaagatgaaatccttagtaatagttggttatattcacccttttttggaataatagcttcttttactgcaggattaactgcgttttatatgtttcggatatatttacttacttttgatgggtatttgcgtgttcattttcaaaattacagtagtactaaagaggattcgttgtattcaatatcgttatggggaaaaaggatatctaaaggagtcaatagagatttcgttttatcaacagcgaagagtggagtttcttttttttcacaaaatctatccaaaattcatgttaatacaggaaataggatagggtcctttagtacttcattggggactaaaaacacttttgtctatcctcatgaaccgggaaatactatgctatttcctcttcttatattactgctttgtactttgtttattggatctataggaatccattttgataatgaaataggggaattaaccatattatcaaagtggctaactccctcaatcaactttttccaagaaagttctaattcttccataaattcatatgaatttatcactaatgcaatttcttctgtaagtctagctatttttggtctattcatagcatatatgttttatggatctgcttactctttttttcagaatttggatttaataaattcctttgtaaaagggggtccgaaaaagtattttttccatcaactaaaaaaaaagatatatagttggtcatataatcgcggttatatagatattttctatactaggacctttaccttgggtataagaggattaaccgaactaacgcagtttttcgacaagggtgtcattgatggaattaccaatggagtaggtcttgctagtttttgtataggagaagaaattaaatatgtagggggaggtcgaatttcgtcttatttattcttttttttatgttatgtatctgtgttcttattcttttttctttcttaaggaattcccctatctcctgcctaagtagctttcctatttgccgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgaccttttcccaaagtcttcggagacctctttcccatgaaaaatcttttttgtgtaattccaaatgtgaagcaagtctccgtatcttattggggaaactgattacttg

SEQ ID NO: 28374 - DNA, 4487 bp, Oryza sativa
ccatagacttcttttaataattccaagttcgaaaaagaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaaagactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgatggattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtaattatgcatcattcgcatacctgtagcagcttcaaatagatcatatattaattctctctctctaaaaatataaaaaaaaggagtctgcgcaccgagatctgccataaaaggtccaagccataacaagtgagaagctatacggctcaattctaacataattaccctaatatagctggctctttggggtatttgaatattctccaagaattctggtgcatttaccgttattgcttctgtaaacatagtagctaaataatcccaacgtgttacataaggtaagtattgtataatagttcggttttccgcgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgacgttttcccaaaagtcttcggagacctctttccgatgaaaaatcttttttgtgtaattccaaatgtgaagcaagtctccgtatcttattggtgaaactgaatacttgaaattcaacagaaccccagttttcttctttttcttctttaaccataaatccaaaaatttttctacctcctttctttttcatgtatttttctgatcaggaaaaataaaaaattatgtcagttattttgaagttattctaatctcgtacacacaaaaatttgcaattattcatctactactggaatttggatttattttatcgatgcaaattggatttggatagaagggtacattcttttattttagatagaagaaaagtttcttctatctaaaataaaagaattttgctgatttatttattgctatatccaatttatggaattgatacaccgtttaattgatatcatttagcaaaatgaaacatagcatatgcatccatctttcggctcgagaatttcacgggatagagatatggtataagaaataggctattaagtaactctaaatgaattgtggatacatctgtatccttaacatactgaaacaactgccattattcgtatcaaaccaatagcgattcatacaagttaaatcttctaatcaatggtgggccaataatgaatttttttgcatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccattccgcgtcttcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcatttcagtcacattcagatccgttttttgagtccatgatataaccaaattggatggatcttccacccgtttagctaagaaagaatagatgcagaggtggataatagatcgatatgaagatcatgagctgccccataatgaaaccaccaggagtcgcgaatatctccttcttccctaatccaagattggagaaagaagatctaagagggacccatggagaatgtggtcagaaacccataatagagtccgaccgcaacgaccgaattaattatcctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttgttcctcagtagttcagtgttagaggggtcggctgttaattgattggtcgtaggttagaatcctacttggggagatttgattcattctttaatgtaagaataaagaattgaattaaagggcttgctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagatagatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatgcttctgtcgctccatccccgtatgggtggagaacccgtcgctgtctcggctgtgctaccggaggctctagggaagtcggaggagagagcactcatcttggggtgggcttactacttatatgctttcagcagttatcctctccgcacttggctacccagcgtttaccgtaggcacga

SEQ ID NO: 28375 - DNA, 1170 bp, Oryza sativa
gtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcgga

SEQ ID NO: 28376 - DNA, 243 bp, Oryza sativa
gccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaggggtacctgt

SEQ ID NO: 28377 - DNA, 15222 bp, Oryza sativa
tgtttttgttcccctgttaggccctgttgatgtttccttcgtttgcaaaacttagatatgttagtcttttgtttccttcatgtttagctgttgtccccagccctcaaacttctatatcccaaactcgctctcaataaaatcaagggccctgccctttatccaaaaaaaaaagttatatatgaaaacgattcaacttgaatatccttaggtttaatgaagtgaaaatttaacagttaggacgaagcatcacctaaattcttttggtcctttttcgtattaattgtgatgcactctagtcttatttacacttcatctcatttgttagtatgatccaagaaaattactgtatggctcgagtttgtccatggcataatctgttataatgtatcatttgatgaagatgtacaaaacatcacgttgcctagttcttcttttgattgttgatctaattattgggcacatcatagctgaaaataggacttgattactgattgcacaaggtttaaaatctttctatctcatggccgttgaattgttaatcttttccctgtacacatgattttttttctaattgcagctcaaattcataggtggtatgtttttccttcaggtataagctgcactgtaagaagagcaaagttggcaatttaccttgaaggaaactcatgataaatgtgaatcaagagaaaattgctataggtctctccagttgcttccatgctgagtattttagagatgaaataacactctttgcaattctgtggctggtggatcaattaatacatgtaagacagatactaatgcatattccaacttttctacataacattcaaagtcgatctctatccaaaaatagaaggtacaaaatcttcgttaggtcaagctttgcagacccaactaagttgttcaaggtctttttgaagaagcctgaagaatcagtgggaatgcaatattcagatccagaagggctccacaataagaggtatgccattgattattgattcagttgatctttgggataaccaatacattttctaaaaagcactatggcataatacactactatctgataagaataagactaaatggataagacaatgtttcctgttatgcccccacacctcttctatggtcaatgatcccttgaaacatgaacttacaaagcatattggtgttgatgcctcctttacccggtctcattgccatcagaaaacaattgctcttcagtattcccttagaattgcaagtagcagttttttttttcactaaatcgcaaactcgagagcatcatcggcttccttcatttactcaaaccaatgcttcagatcctccccttccaccttgagtttgaaggggggtgttaagtatatcaaacattcaagcacatatcttgtaggcccatgtggctcatgaggactctgtataacatcatcatccctgagggataatggtctttctcaaatctccaaggtaattaacagaccttagagggagcaaaatacaccatgctaaagtagacgatcaggctatcactgtaaaatcaaagtgtttttgattattattctgtgatgaacaattggacattggagattattggttttgttatttagaatctattcacgaagtggtttttgagatgattggattttacaggtgaatcgcaggatcgtcattttatgtgaccggtcagaccgggtagtgtgtgccggtcagaccggcgtgtaatgcgcggtcagaccggcgcaacccacggtctgaccggccgacactgtgtcggtttcggttttgagttgtttatttggatatccgaatttattttatgattatgacttctagatgactcgatgtcaagttggagatagcttggtctcggaatatagtttctttgtttatttcatgtgtaggtgactcgatgtctcgggagagtatttgcggtgatggaccgggagtcggcttggggataagatgacgtccatggtggtcagagatcatgtgggatacttaggctagagttgatgcacatggttgatggagattccatatggcatacgatggagttattgtgtgcgtatgggatgcggagtcgaatttggaaggagtctaaatttggtacgattggttatgtaaagtttctttcttgtactagaggatttcctaaggtgtttagaactcctagtatgagtttggttcgtggctttaggctgcctacctcatgtataaatagaaggggagcgtgaggcctcccggtatcgcttttgagagcaatagagttgagttttgagttagggtttcgagtttagtcgagatttttgtaaggagtgatgttggtgcactttgaaaacacagagagaatcaataaagtcgtcatgtactttaagagttcttcgatttgtgtttcatcgagtttcggcggtctaaccggcgatctaccggcggtcagaccggtgggagcacggcggtcagaccggcggcggcgacaggcgcggcaggcaatctcggcggtcagaccggagattcaacaccggtctgtcacaccccaatctgataccgccgtacaacggcacctgataggagcgtgtcgtagggaaaacagcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaacagcagcagcagcagcggaaccaacggtctaacacccaacaccacaggcgacggctgggaaccaggacgaaaccctaatcttcacttcactttatcttctcttcagggcggaggaactatatatatatttatatagagcaagggtgagtactttcgtactcagcaagtcacgggaacttaggtgtttaatgcaagcttggaagagaggcaaggttgttttgcaaatcttttatttgaagatattttgaaatcactaagtgatttatttctttctaagtttgggccgaaaagagacttacgtctcgtttcgaccttaagagatgtttttcaacagctcatttggtaatgtaccgacctcccgggtcagatcattacttctcggctcccagagccattccacttgattaatcggctcccagagcctttttcattttctcggactcccagagtccagctgcccagcagcacaacaatccgcttctactcgggaagcctagtctatgatgccctcagacatcccgaatcacacagattcgtttctgaccactcaggtcatccatctgtcacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaacataggcctttttaggcgttcacaaatcaaactccaaccaccttgatcggtaagtgagcaagcttctcgtccttgccttactaagaacccggtttgtccgaccccgccccggcgttcccaactattggcatgcgaggcttccctgaatcgactagttacttagccagggtgtcccattccaccttgtggttgcactttgattatgttcgatgagtttcccacaggaatcggtccttatatgcgaatacaggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgccagttgcaaacaaaataataatgattttccaattataggagcaattggtcaaagggtgacttgtctttctcaaggtcttcacgaagctttacgaatcttcgagaaatcccatgatcgacgaaaatccgataaccgcaactatacgcaaacaatcgaaaacctaaacaaaagaccaaaagaaagatcctatttagactaaataatagtgccattaaacagatctcaattttacggaattattggaagtggaacggagtcgatcggagctacggatcaagggatatgaattttggaggtctaaatggattttctggacaaggaaatgttttgtcggaatttatggaaataatattctcaagaatattattgacagtcactgaccaaggaaaatgattcatggaattttggaataaggaattgatttctgaaagagggaaaaatgatttattgaatttatagaaaagagaaatatttgtggagtattggaaaagatattctcaagaatatctttgactcattgacaagtggggccaacaagaagtgagagtgagagaggatagatgggctgcggtccaatgggtggcggatgtggtagggggaggacgagggagcaaagttagactttgttccacggcagctggtttggaagagagacgcaacatagactttgttccaaggagcgaggagagaggtgaggcccatcagctagcgagagagagagagagagaggagatgggccggctcgggttgggcggcccacggccgggtgggcgtggccgagccgagccaggcctgcgcgcgcgggcgacgctgaccggtcgctgcttgacccggcaagctgggccggcgggccagggtggcggccacgttggcacgggagagagagaggagaggagccgggccggagatcggacggctcacggcgcgcggcggaatccggcgaacggtggcaatccggagcgagcggcgggcaccggaagcgagagggggtcacggaggttccatccaccggctcggatatgggagagaggcgcgacggaggccggcgacggcggccgtgcggcggcgggatgggtggcatggcgcgggagcaaaagaggaggccggcggcggaattggcggtttggggtggttcattggagctcaaggtgggtggcggcgaggggattcggcacgggaccgaccggcggcggcgcgcgactgcgcacggcggcggcgggagcaaggcaccggcaagggcgcgatttggaggacgaacgcacaaactaccatgccccagtgctgtttaggagtcgctagaggatatagatgagaggatttgggcggggagctcacccatgagcgggaacggcggggcggatggagtcgcggcgaggcagacgtgacggcggggcggcacggcgcggagagtgagaggggagggcgcgggctttataggcgaggaggagaggtcggtttggaggagggaaaccgacattggcggtcaagggagctcggctggtgttcacgggcggcagcggcggtttcgtgggcaaagcgaaggcggcgacggtgtggatgcgttgggcggcgaaggcggtggatcgagcggcggaaaatcgaaccgcgggagcgggaggattagcgcgggctggcgcggtcaaggtgggggcggcgagctggcgctggcgtctgtgtctctgcctccgagcgctagcggccaaggagcggaggcatggcgtcgttgcttgggagggaaaaagagaagggaggacggtggaaaggggggactttaccatgccggtttgggaaaaaggaggtgggagagggagtgctctgccttcgggatttggatggacgcgggtggagcggcttgggcacgcgctgcagagcttgcggcaggcagcggggccgagcggcagcatgacgcaggcgctaacggcggcggcgaccgggcggttgcgcggcgcaggcgcggcagggctgacggcagcaacgaccggccggtcggccacgcgcgagcgcgggaaagagcaaaggcggtggcgagttttgggcggcgacggcgggaagcggcgtcggcgcgagagagagacatcgagagagagagagagggagaaacagcgagagcgagagagacagagagagcgagcgacggctctctctctctctcggctcgcatgcgtgcaacgcacgtgcgaggggggggagatgatgggctgggaggggagatgggccggggaggagagtcggtccatccaaaaacatagggaggtaaagtagacttttacagagaaaactgatttggatagaattggagagatttagggtttggattcgaattcaaatttgatattcaaactcgagggtttagggatatatcaggggaaactcaaggagaagtcatggtaaggattcaaaaggaatacttggatatttgttctcgggaacatagggtggagtctaggaaaggattcgaggcgggatttgaataattctggattcgtagaagtatttggcgaggattcaaaggaaggatttgaatttcagaatttgatttcagagactcgaatcggaagaggaatttggatgagggggaggatttttgatttcgatgagagggaacaacgggattaaattgggatccttggcacaacttagactctcacacagagaacgaaaattttcgcatttaggattttgccgaattagttttttaacgtctcacgaaaagcggagcattacacggtcagaccagcggcatccactcggtcagaccagcagatcaatctcggtcagaccgacttccgtcgatttcgagggtaacttttatttccgctaaaagttttcggtttttgggtataccaaccattcaacccccctctggttggcttagttcttgtgattcgatcctacaatcacccctcatggtaacctctgcaccaccaggaattgtaccttaaaatatagcaaatgaagtgaattaccttttctaaattcaggcacaaatggaatctctatgtgtagttactttattgatcgcggtttatcattgacttcattgtgaactggagatatgctttatgtaccagtatttttactgcctattacagagagcagtgcgcatcaatatctgtatgtggaacctataatttcctattcctttttgctaaccgtggcattctttagatgttttgctgggggatgcattcggacatcttagataagtggtctataactacatgtgttcctactcatagtcatatgattcctgatataaggtagagaaagggtctaggttcttaatttaacagatggataaaattatttcttacttaaatgtaaggtgaatgtattcctgtttaggactttctataggcaggtattagagccaatcccttgggatgagcttttaattcatttttctattcatcgaaagggattgtgtgaccccaagcagtcgctatgattttggatagccagggacaagatgatgatgagacaataattacacaaagttagcactagtgctgaccataagaatttgatgagatagtttcagctatatctttgtagcatcagtctactattcagagttgaggtattgattagtgcttgaccatcaagcaggtggtactttcccagtttcacatgttcaaaaacagacgtgtcaacaaatgccagcttacagtgagaaccggtcaacctgaacatgtttaacaactgtaaatgatcttgttagggatttaccaattcgagtaatcctccaatattaatgggtacaaatatagaacgattccatgcactggtggagaaatactttttagtcacggttcgcaaccccctgtagtcccggttatctttagtcccggttcaaatacccgggactaaaaatagatctttagtcccggttagtaacaccaaccgggactaaagagaggggatctttagtcccggtacaccaaccgggactaaagagagggttgcggcagtgagatgatcccctttttctttttttttcttttttattttctcccaaatcaagtgggatacatatcccaaatcaaacccccaatccacaaatcgaagtaacatctcaaatctacatcacaaatcaaagttacttatacacacaaataaatacatcacaaatcaaatacatcacaatatcctaagaaattactcaaatacatcacagatccaaacaatgaatcacaaatttgtaacttctcagtcaaatacatctcagtgaatcatcacaaattaaaaaaaaaagaatgccgttgccaccgccagtcgccacgaacgacgggcgcggccccaccggccgccgggcgcggcctcgccgcccgccgcccgccgccctccgccgggcgcgaccccgccgggcaccgccccatcgcccgccgccggccgggaaggggaggaggaaggggagagaagggggaggagaggaggaaggggaggagttggagaagagagttagagaggatagatctgaggagagagggtgagattcgatctgttaagttgtaattgtggaggagaggataagggatagggattatatactacgtgtttaattttagtcccgattggtactatcaacctcttgatctttagtcccgattggtgttaccaaccgggactaaagatcaaaatttttataaccgggactaaaaacaatctttactcccggttctttttggatccgagactattgtggattttgccggaccgagcaaagatggtttctccaccagtgatgtcattccttgaataagaaacacatgaggaacaatgattcaactaaagtactccagcattaggaaatttcaagttactatttgcatgatgaatcttttttgctctgctgtggaaacagcaacatacagacttatcaactaattttggaagaacgagaaagaatcaatctggtttggtggggaagatcagctccggcatcgtagggcacaggacaagactgtgttgcagaggttggagacgtcccgtggcttcacttatggactaggccaaagagatgtaagttgagtggagggaggtagcggactgagctagggctaaaaagaaaggaaggaataagctttcaaccccaaaacaaagcaaagatttaatgtttcaatttaggaaagattttcacatcttatactacacccttcgttctaaaatatgagagattttggacggatgagacactttctagtacaatgaatctggacagagagcaaattcagatttattatattaggaagtgtcccatccgtctaaaatctggagattttgatgtcccatccgtctaaaatgtcttaggacggagtattagattgtactcactactggattgtttttattttggtatgaagtacagcctacaggcgagggtgtgtttggttgcatgcatgaaacctggctcgcacgcgtggatgcagtaggtcgctgtttggttgcctgcagctcgctcccagcctggtcgagcggatgcaaaaaatcccccacagccaggctgagcagaaacgctcaagttgagcttcgctactcggccaggcccgcacgatgcaacgcgctgcatccgcgcatgcagcgccccgcacccgcgtgtgcaagggcaagcgatggggtcaccactccgccccttgctcctcgtcattttcccccagcaatcgacatggcgaagacgagctctgctagagggagtggcgcccgacgaatccaacttgctgctgcatccccctcctcttcccaccgtctcccaccttcaatatccggccaccgccttgcccacacgtccccgctgatggtgtgagcactgccagatccaactagtggtgaggcggcaaaaagcttgacggtgacgagctcagcggaggtcgcggcgacgaggacggcggatccaccttgctgccgcatccctcctcttcccatcgtatcccatcttcaatcgtcggccaccgtcgtatcccaccttcttctgtgccggtcagatctggagcagaggagcggcaagcggcggatggagaggagcgcaggaagatgggtggaggaacggcgagcggcgggcaggtgggcatgcatgcggctgcgggcggacgggagttgatgacgacgaagcgacggctgcaacgccgatccccttcctttctctctttcgtttcttttttctccccgggttttctgttttctttttctttcgtttctcactagcaagtactccagcaacagagaagtcaatgtatgcagaattactactaatagattaattagttccactggttcatctagcttaaagaaaaactagcatggtggcccgcacagattgcgcggctagcattattatattttctctcacgtaataacatatatgttttcttattatattattcaaatatattaaaataacatcataattttaaattttacaataactttacgaaactacaaatgtgtaatattcatatggtattttatattaatgtgagatattaattatttttaatatcgagttttagttatttgtaaattatatatattcctactctagactcgtcttttaataattcttttttttaattccgaattttttgtaaattgtatttctatactctactttaatattccttattttttaattacgaatttctatttttttcttaattgtatttctatatggactctatactctacttctaatattccttatttttaattctaaatttctattatttcctaattgtatttctatatagactctatactctacttctaatattccttatttttaatttcgaatttcagttattttctaattgtatttctatacggactctatgctctacttctaatattccttatttttaacttcgaatttcagttatttcctaattgtatttctatacggactctatgctctacttctaatattccttatttttaacttcgaatttcagttatttcctaattgtatttctatacggactctatgctctacttctaatattccttatttttaattccgaatttcagttatttcctaattgtatttctatatggactctatactctacttctaatattccttatttttaattacgaatttaagttatttcctaattttttttctatatggattctatactctacttctaatattacttatttttaattctgaatttcagttatttcctaattgtatttctatatggattctatactctacttctaatattccttatttttttaattccgaatttcagttatttcctaattgtatttctatatggactctagtctcatcttctaatattccttattttttaattccgaatttcaactatttctaaattgtatttctatatggactctagtctcctcttctaatatttcttattttttttaattccaaatttcaactattttctaaattgtatttctacatggactctgatttttctttttctccgattaatgtgagaatttctaggccatgagagcgaacgtggaggcttatttttctattcctttaataatataatagatagataacctttttcttctttttcgtaccactgattcggtgtgaaaagttggccgacttattttatgtagataatagagtgattttgcagtatcattcgcatatgtaagtgaatattcaattggttaaatcaaaatactcttattatttgttatatatattgtagaggtaacctcacccaactaaatgaagaggtaaacaacactcacatccatgcaaccaaacaaacaaaatccctttcaaaccgtatctctcatacaagtaaccaaacaaaatctcatgctagcctggctagaccaatgcaaccaaccaaacaactgcatatgtatactcttagcaaggtcaaactcagcctggatgcgagaaatgagccaggctaggggaatatgggcaaccaaacacaccctaaagagatgcacttcacttcagaaaggatatatgattggttgcaagctgaccagttcaggcaacaacgacaacaaattgaacataagaaaaaaacgacaagaaatcgatctttggaattaaaattcttctagcttcagaaattggaacttcaaatttacaaaaaaaaaagaagaaattctactactattacgtgactctccatttccaacctaaaagtctcagaaaccctccacctatgggtcacacttacttttaattcgaatcagacattctgttaataacatcaagcttttaaaataaaatctcaaatatttaaataaaattggttgcagccaaacgatgctttttttcagcacaactatatacatattttggaggggctcataaaaagtaggatgtgctcccttcaaaaaaaaaaaagtaggttgtttggacacatgcatggagcattaaatgtggatgaaaaaaccagttgcacagtttgcatataaattgcaagacgaatcttttaagcctaattacgccatgatttaacaatgtagtgctacaataaacatttgctaatgatggattaattaggcttaaatagattcgtctcgcggtttacacacggaatctgtaatttgttttgttattagtctacgtttaatacttcaaatgtcagtggtggacgcaagattttgaagatgggggtacaaagttatcaaatcgttgttccataaagaaactgcttagtagtaggaaaagtaatgagcaagtttttcttgctacaacaaataaaaatagaaacattgcaaaatagctaaagatttgcgcgttcgtgaaaagaatagctaaagaaaaattaaatcttggagaagagatactatgttttcatcccaaacactccataaagatttttgcactaccatctaactctttttgactcctctaccatataaattcagatatgcacattaatcaaatttcctaaaagcaaccatcaattgaatcaaacatgaactacaggaagaatagttgggagcctaaaaaaatatatgatacgaacacattcaatccattgagccatgaggttgcttctccagtgcagcggcttgtcgatcagctgcttgttcttggcttctctccgtgaccacgagcagcgcctgcacacggctgcaattggttggttgttccaaaccataggaaggcatacgatatctcggtattctggttgtaagccccatatacaaaccagagattcaaggtcatgagacgagatcgatgagcttgaggagcttgtgttggtctgcctgagccgttttctatgagttgtattgtaattttaggctaaagaatagctgttttgccccaactaatgatatatatacaggtaatatacctattaatccaaagattatttgtcaaattttttggggtacagctgtaccctcatgtcccacactagattcgcccctgtcaaatgtgtgtccgtatacattaaaattttttttttgccaaaacaactaaacacggccaattggttgcaagctacagctgacagtccaatcaccatgacgacacgaaatctattgattttcgaggcttcatgtcattttccttgtcggttggacacattacttggccaacctaggggataactaaatgtgataacctcttgtctctttcatatgtcgttttcatatgtcgttgttctttaatttgaaatcatcagtgaaaccgttaacttggatatttgtacatcctcgagccaaaaaagttctttttttccaaagaaaagtgtatgtagtcaacctatttggccttagttatttttaagaattttttttataaaaataatatacaaagtgtttcgttacaaatactttcatacaagttataagacttatttatatataaacggaaaagggaatttgttggtcaaaattgttttctgtttatttcgtgaaaatcctttcctgaccaacaaatggagcaatttttttgaagctcatgtgacgccgctcatctgcacgctttggttcgtttcaagctcacgtggcacgtgttgactgagtccaagtgcaaatataggctcaagaaagggcctttctgtaattgtgcttgtaatcttggactcttggtcctctttcatgacctgtttagcttttgcatattgggattgtgaaaccgacctgttgtatgatcatgatggtgacttcagttttgcaatgtcattcctggtcgaacaccctgaaagaagctgtaaaataaaaaacctgtatgtcgttgttgctgttaccacatgaaagcaaaaggaatcatcgttagttgtttactagtgtgtttcttattcaaggaatgatatggaagttggctactccgcaatttgtgcacgttaatactccaagatttcttgaaatggtaaattcctagcaaattcatttacagttttgcaattcatgttcaagttctggattgaaagctggcattggtagagagacttgagacatcacatatgttttcactcagcaattggacaaaaaaaaaaggtcaggtgaagttgcgaaaagcaccacctgcttgatggtcaaacatcaatcaccacctcaactccactctgtagacttgactgatgctaagatgataaagctaaaactgtctcaccaaattcatatggtcctcatcttgcacctacggatctccttcaccaccaatgtccatcatctgcccaaaaacgtccaaagaaaaacattcatattagtgcaaaccaagagaataaccaagtgctgtcagcatccaattaagtaatcagcagtcgtactcagtactgttctcagctaccacaaagtactgcgagagaacaaggcactctgcggttcatctctttttccaacaagaaccacaccaaaaaatacatcaaataaatgaaccagataaaatcatgttaatcttgtatcataagccaggcccaacgaaagttaggactctttggcacggctccaacctctagctcctagcttcttagcttgaccattgaagttggagatgcattttctgaagttctttttgaggcaaagttttttttttttttttttttttttgaagtttgcaccataaagaa

SEQ ID NO: 28378 - DNA, 1231 bp, Oryza sativa
gctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtca

SEQ ID NO: 28379 - DNA, 10335 bp, Oryza sativa
  unsure (1)..(10335): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttcaatatgttatagttttctttccatagcaaatatgatataggtataatatagcaaggcattttatttcaaactatgctgcatttgggtggcttctgcaattcatttttttccatcaaggtctcaggctacaaaaacaggtagttcgtctgagaattgctactctcattggattttgattctctttctgatagagtttcacatttcctgtggctcgctactgtcatgctctgaatgccaatgattctgctgcgtcttctgtgctttcaacgactgaacataacaatgtctatcttgtttgctggggtatcagatgacggcaggacatcaggctgtaaaaaaacatttaatttaaatttaaggacttaacgtttcctgtcaggcagtatgtgttcatgtcaataatcacaggaaagacatcgatagaccaatcttcatgtagaagttatgcaaatggattataattctttcaggttgaacgtttcagacgaatggtcacattcaaattacagtattcatgaattatttcagatgcaactaagcaatttaaacacaaatccactatgaatttagagtcgatgaatttactcacgaatgcagttctccatgaagagtgctccagggggagaaaagaaacacccaaaccttatcatttcatcaacttcgttacttgcaaactcatatcgcctaagcttcatgtcagtatctcctgtaagcaacatcttccggcttcaagattcagaaaggttatctctgtattcctttaggttaaagaattcagaaatgtagtaggtcgcccacgcgtgggcgactcggggggaaacctagcaccgccgctgccactctctcctcctctccctcccctcgcagctaccggagaaccgagcggccagctgggacggcggcggcaaggccaaacgtcgacggcgctatgtgcatggaaggcgggccggcgcgcggagcagaggttgaagacacggcgtggaggcggcagattcagcgccgccgcggctggatccggcctccccatgggtggatctggatctggccggagcaagccgctctcgggcagcgacgacgggaggcgaaggcggcggcgtctggtggctggcggcagctggtgaaggaggctagcgcgtgcgaagctgcgaccggcggcggtggagactggcacgcgcggaggacgcaatggccgccggcggcggaggcagtagaggcgtggctggcgacggcaaaaaccggcgtgtgcaaaggcgcggccggtggcagcggaggccggcgctcgtggaggccacggtggcagccgcagctgaagctggcgcgcgtggccggcaacaggagatgactaaacggcgcgatggagcggctgagggcggtgtaaagcctgtcggcggtggcgacgctcccggtggttggcagtggacggtgaggaggacggaggctgccgcagtgagagaatggaggcgacgacgatgcgaccaggcacccgttggaacacgagcgccctggtcgaggcggcgacgacggtcatgttgtgaggggggtgttgaagcctacggccttttgcggggaagaggggatccattcttttctcaccctctccctctccaacccaatcacgtgggtagcggaagctggtgcgcgtggccggcgacaggagacgactgaacggcgcgatggagcggctgagggcggtgtaaagcccgtcggcggtggcgacgctcccggtggtcggcagtggacggtgaggaggacggaggctgtcgcagtgagagaacggaggcgacgacgatgcgactaggcacccgttggaacacgcgcgccccggtcgaggcggcgacgacggtcatgttgtgaggggggtgttgaagcctacggccttttgtgggggaagaggggatccattcttctctcaccctctccctctccaacccaatcacgtgggtggacttgaagcacgacaagggttgagactcttctttgatggccggccggcggcgaggcgtcgacgtggtggttgcgcatcgaaggggattagatggtggttttgctgaactggcatgcactctttagcgcgggagagtagaacaatgggtgagccggcaatggcaacgcctgcgggcgtcgttttccccttggggcattgttgtgttttctatcgtttcccaatgggttcttcaggtgaaaacaacgtcctggttctcaaggacaggcggcggtggcgcttttggcgtcgttttcctccttggggcattgctgtgttttctatcgtttcccaatgggttcttcaggtgaaaacaacgtcctggttctctaggacaggcggcggtggcgcttttggcgtcgttttcctccttggggcattgctgtgttttctatcgtttcccaatgggtccttcaggtgaaaaccacgtcctggttctctaggacaggcggcagtggcgcttttggcatcgttttcctccttggaagcgtcgtttagaagacatattccttgggggtgttgtgtgcatattttgttttgttttagcagtatgatcaaacgtagacgcgtggtgtggtgaacgcacgaactttattagcttcaaaatgtttttatttcctgatacaatgcacaggctattctattcatcaattttcgttgtttgtattactatcatacgaaatctataaacaacatgtgatgtaattattattagtgccatattaaagttttcatcataaaagaattacacttaataattatttattaccttactgtgtggttttaaatcggtgtataacttttacctggtactcgtgacacatcctaaaactgtgaatttggaagagagcatgtccaaatttctacaactcccaactacctaatcacccataagcaaatatcatttaataggatattctagtattttaatcttacccagtagagaataatcccttatattatagaatgaagggaatatccgggaagttgggaagtatccagtgcaatagtacttctcggtgggagaatgcgatatcctattgctagcctttagatttgaaatggacgcggtagattggagcacttcctattctcttagttgacaaatgcaaaaaaaaggaccctataatatgtgccaaaatgttacgagcccttccgttctcttctactctaatctatctatggctatatttagttccacaccaaaattggaagtttgaagaaattagaacaatgtgacgaaaaagttaaaagtttgtgtggctaagaaaattcgatacgaagaaaaagttaaaagtttgaagaaaaaaaaaagttatgaatctaatcgggcatagcctatgcctgaggctctatctcccttgtggccttatctgaatcatttttcattgttcacctcttgttcggatacttgtcccctatcttttcccccttccctggcgtaaaagaaaaaaaatatctcccgtctccactccactccttgcgccatctcgcggctgaacaggggagtggaggggagggccgcctatctccatctggcgagcagagcaagagcaagggaggggatcctggtgtggtgagcatccacatcctcttcctgattcatctctctctctcccaccgggactacttttgcctggaatttgctttgctttcgttaagctcctctcttaatttccgatacttaaccttaatacaagtagtaacagtttgtttgttcgtctcaagttggattctcgctgatgtttcttgaaattctctcagtttcttggtgcttcttgggaatttttcaggtgttgttgttgtcgttgttgctcgccggatgttggaggtctgctgctgctccggcgtcctcggcgggtcgccgccgtcgtcgaggactgcgggggtttcctcacctggactatcgccgtctcggcccagtaagcggcgaatcggccgcgcccgggtgcagccgcgcgcgccgccgccgtgcgacgagcggagggcggcggaggacgtcatccacgcgctcaggtcggcggatggccccgccgaggcgcttgagcggttcaggtcggcggcgcggaagcccagggtggcccacacgaccgcgtcgtgcaactacatgctcgagctcatgcgcggccatggccgggtcggggacatggccgaggtgttcgacgtaatgcagaggcagatcgtcaaggcgaacgtgggcacgttcgcggcgatcttcggagggcttggtgtggaggggggactccggagcgcgccggtggcgctgccggtcatgaaggaggccgggattgtcttgaacgcgtacacgtataatggcctggtttatttccttgtgaagtccgggtttgatagggaggcgttggaggtttatagggtgatgatggtggatggtgttgtgcctagtgtgagaacctactctgtgctgatggtggcgttcgggaagaggagggatgtcgagacggttctttggttgttgcgtgaaatggaggctcatggcgtgaagccgaatgtgtatagctacaccatctgtattcgagttcttggacaagccaaaagattcgatgaagcttatcggatacttgcgaaaatggagaatgaagggtgtaagccggatgtcattacccataccgtgcttatacaggttctttgcgatgctggccgtatcagtgatgccaaggatgttttttggaagatgaagaagagtgatcaaaaacctgatcgagtgacctacattactctgttagataagtttggtgacaatggtgactcgcaatcagtgatggaaatctggaatgcaatgaaagctgatgggtacaatgacaatgttgttgcttatacagcagttattgatgcattgtgccaagttgggagggtctttgaagctttggaaatgtttgatgagatgaaacaaaagggtatagtgcctgagcagtattcatacaactcgctgatatcggggtttcttaaagctgatagatttggtgatgccttagagctgtttaaacatatggatattcatggacctaaaccaaatggttacacacatgttcttttcataaattactatggaaaatctggtgaatctataaaggcaatacagagatatgaactaatgaagagcaaagggattgtgccagatgttgttgctggtaatgctgttttgtttggtcttgccaaatctggtagacttggcatggcaaaaagggtatttcatgaattaaaagctatgggggtttctccggatactatcacctacactatgatgatcaagtgttgcagcaaggcatcaaaatttgatgaagctgtgaagattttctatgatatgattgaaaataattgtgttcctgatgttcttgccgtgaattctttgattgatacactctacaaggcaggcaggggtgatgaagcctggcggatcttttatcaactaaaagaaatgaatctagagccaacagatgggacttacaatacacttttggcaggattgggaagggaaggtaaagtcaaggaggtaatgcatctgcttgaagaaatgtaccacagtaattatcctcctaatttgataacatacaatacgattcttgactgtctctgcaagaacggggcagttaatgatgcacttgatatgctatacagtatgactacgaaaggatgcatacctgatctttcgtcttacaacactgttatatatggccttgttaaagaagaaagatataatgaggcattcagtattttttgtcagatgaagaaggttcttattccagattatgcaacactgtgtactatcctcccaagttttgtgaaaattggactgatgaaggaagctctgcatattatcaaggactacttcctccaacctggctccaaaacagataggtcttcatgccattcactaatggaagggatactgaagaaggctggcatcgaaaagtcaattgagtttgctgaaatcatagcatcaagtggtattaccttggatgatttctttttgtgcccattaattaagcatctctgtaagcagaagaaagctcttgaagcacatgaacttgtcaaaaagttcaagagctttggagtttcactaaaaactggattatataattctttgatttgtgggcttgttgatgaaaacctaatagatattgctgaaggcttgtttgctgaaatgaaggaactcggttgtggtccagatgagtttacttacaacttacttcttgatgccatgggaaagtcaatgcggatagaggaaatgctaaaagttcaagaagagatgcatcgcaagggatatgaatcaacttatgttacttataacacaatcatttcaggtcttgtaaagtcaagaaggttggagcaggctattgatttgtactacaacctgatgagccaaggtttctcacccacaccatgcacatatggccctcttcttgatggtctgttaaaagctggaaggatagaagatgcagaaaatcttttcaatgagatgctggagtatggatgcaaggccaattgcactatctacaatatactactgaatggacatcgaatagctggtaatacagagaaggtctgtcatttgtttcaggatatggttgaccagggaataaacccagatataaaatcctacacgattattattgacacactctgcaaggcaggacagttaaatgatggtctaacatattttaggcaattattagaaatgggtcttgaacctgatctaattacttacaatttgctcattgatggtcttggaaaatcaaaaagattagaggaagcagtgtctctattcaatgagatgcagaagaagggaattgtcccgaacttgtacacttataattcactaattctccacttaggaaaagcagggaaggctgctgaagctgggaaaatgtatgaagagctactgacgaaaggctggaagcctaacgttttcacatataacgctcttattagggggtacagtgtttccggcagtactgatagtgcctatgctgcctatggtcggatgattgttggcgggtgcctacccaattcaagcacgtacatgcagctcccaaatcagctgtgactaactagttagtgactgaatgtacttcttctgtatagttttgtctataaaaggaaaaggatcaactgtagatagtccacttcaatatatctgagggttctgctggttcttgttctacactatatttttgtacttgatggaagaaaattattcaatacacagctgacttgatcacttgaatcatctgttcaatttaactgacattgtgaggttacagttgttaaactcttatcaagtccatccattatatgtggttcaagtacaactgatctgtgtgcacattacccattttctttctactggtatgtctcttcagccaaatgcttgtgacatagttcagttttactgcctgtataggtttactgatgtgtgcgcatctttaggaagttgagctagtggttcagtttcacagtgttacgctgcttagcaacaatcaactttttccctgattcacctttttctcatatgatatagcactgccaatggactgcttgagaaggttctctattgttgcaatacatggaaatgcagttagatgcttcctttccaaaagtttctttgttcacatgatagtgaattggtagcattttgcatactttgggtcaaaagatgtgctcatttcttgtagaccataattacaacactggaatggccaatttccttcatgaaaattttcaatgagcagccaatgcaaattcaaatttactatttcctttagtttggttgtgtctaatctgtaagtttatggtgatttttactagaaaaggtatcgctaagtttctgaaattattttcatttctcttcagtctagaactctagattaatttgttgatcttgcttatatgccaatttgtttgactatattttcctgttgtatctatgatatgctctctctttgttttggggtttatcatggtatatttctatattttatggtgttgagctgttgatcatgagaaagtaaacttgcatgttaaactgaagtaattgacagtttgacattcgtaataccttgatataccctgatcaaatgtatttttgttccaaactcaagctactactagggaacattcatcttgatctatttattcaaagctttcttgtggtgctcagttttgttttctggttttagattgtaattttgtctggtaacaagctcttcttttgatatttttccccttgaaattcaaagaaaggtgtattttgcttgcctacctaaagagaagtttgcagttctagttgaacagttgtgcatctgtgaagtttgttatggatgtcccctttaggatgcgtttggagtttggtattgaactgaagaagctattaattttagtgacctaacttcttgagtgtttttcattcgtttggtgtggtatatccatatgcagaagttgtggatgatgcgtattgcttctttttaaccagcactcttctcttgtcatgatgaaggacaccacagattcaataaagccatacatattctgttctccaggtatgttgtagcatctccttccttcaatatgctaaaacaatttgagcttgtagatccatggaccgagaaaaaaaacagatgcaaaagaatgaagcatagtttactcctctgcatgctattgccaattgtgcctacaaaatgatgttgtatacttcgattcaaggaaaatttactcctctcatggttgcttcttgcttgttttctcatgactcatgcattgggcgtcaatgatgccctgctttgtttgcagttggagatcacctagacacttgccactaaacagtttggtctgcttgttgctgtgatgcggttatgcccttttttcctgaggtatttttagaagaaaatttctacatgtttcatattgcattatcagggactcttcaaactgttcgtccccggaagctgtcggcacagtgaggaagcagatcaccagccatcgtagctatcacaatgccaaagagccaacaacaaaggtcagggtcttgatctcttgtatgcccagtaacaggttaatcctcctggctctctgtactgaaacaatttctctggatctctttcccttttgttttggaccttatacaacctgctgatggttaataatgatgttcttgaataatagatcatgttaagctgtttgcatggtctgctgctgtcaaatagttttatgcggtcacaactcttactaactgatcaggttgacttcaagcattgggctaaaaactaagattatgtaacttaaataacatatatgccatcatcttcaatttaagtgatattgtgtcaatcttctgatcaactgtttacatcttcgggttatgtagattcatgtcatcttcttttactctgaaatgctatatgagattggcagaatgtcctgatttcccaggcatggcgatggctgtccaagggctgcttaaggagagctgctgctggaaatgcccagcaaattgctgatggatggaggatgcataatcactcagtgtggtgaccatctgatttagcatggcgtatttcgcaaaaggtttgaaattcaaaacagtgtctcatcggatacgccatagtgattttcagtttctcttattggcgtacctctgcttgtggaaccctcctgatctgaatattgcattcccactgttccatctggcttctccttcaggccggcaaagcattgcaaaacagacctaacaaagattacttccccctatttgtcgtaagaaactttggatgttatgtagaacagaccttggtatatgcagttcttgaccataagttcactatctgtcttctgcttgtaataattgatccacctagaattacaaagtggtcttattatttcatctctgaaatcctcactacgaaagaaactggagaagactattgcaactgtcatcacagcgacctcagttttgcttcgacagct

SEQ ID NO: 28380 - DNA, 501 bp, Oryza sativa
cagatatgaaactttgggtattcagggaaacccttgttattcccaataagattgcccgataatagatcgattcatccaaagcccgccctgctcctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagagatacgactttgggctatggttaactcagctccaatcaagaatccccaaggacccccaagaattcttggtatacgctcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctcc

SEQ ID NO: 28381 - DNA, 164 bp, Oryza sativa
gtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttg

SEQ ID NO: 28382 - DNA, 287 bp, Oryza sativa
ggaaaaggaggattccaaatccttttttcttcagactttcccaaacacaaaatacctgcttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaattgaagtaggattgacgaataagaaataaacataatactgtttattagtgtcgcataaaacccgaaatggggcgtg

SEQ ID NO: 28383 - DNA, 1532 bp, Oryza sativa
tttaaaattatgttgtcattttaatatatttgaataatataatgagaaaacatatatgctattatatgagagaaaatataatgatgctagccgcgtaatctgcgcgggcaccatgctagttacaatttaacagatctttgaaatataccattgcttaccactttgctgaaatttctaatttttgtttaccaaattgcccttatcttcttcctccatcctcttgttcccctttctctcgtcttcttctccatcacgctcctctcctctcctctgtgctgccgaagctgctttctaatttttggtcagaagagagaggaggggtgagaggagagagagaaataggtgggaggaagaaaaggaggaacaagacgggggtaatttgatcagaaaagtttagaaatcacggtgaagggacaagcagtggtacgtctcaaagacatgttgaatagtaatggcatgtttctaatttcataaatagcaatggtatttttccaaacctacaattttataatggcatggatccaattaaccccttttaaaatgtggcaattaagaatttgctaccatgtgagccctcatgtatctataacgtgtgggtccagtagcatatccttaattgcaacttgtaagagtggcaaataggtaaacatctcgtcttccggaggttgaagacgttgtgctagttgggcttgcagcttcacttatgggttgggctaaagagaggcaagctgaggagggaggtagcgcaggggctaaaaaggaaggaataagctataggctttcagcccaaaacaaatgaaagattttcattataatgtatttagcgatcttaatgtttcaatttattgcttagctcctaatagctattataccagaaaaaacgcttttacccgttgtgtgcattttttctagtctactattataaaaattgaaaatgcttttgctggaactttggtacgtcatccgtgtatgagtcggtttttaacttcgttcgcttttggaaatacatatccgtatttgagtcagtttttaagttcgttaacttttggaaatacagaaggagtcgtataagaaatctctttaaaaaactcgcatgctaacttgggatgatcggactcctaattgcagcttatgattttataaaaaatatatatatccaagcaaattctcacagtgaatttcaccttaatttacccgtataacaataataagattaaagtcaccctcacggcctcacccgttgcaacgcacgggcatttttctagtatagtaaaataaacaaagttaatacaaaatgtgactactaaaattaaaaaaacaaacctaatacggaatacaaaatatgagtaaacaaacctaatacgaaatgtgacattctactagtacaaatctgaatagacgtgaatacgtcacatcttatactactcctttgtcccaaaatataagagattttggatggatgagacattgttgatgcaaaaaaacacacactggcctgagagatttgttttactctagtgcaggtctaaaga

SEQ ID NO: 28384 - DNA, 736 bp, Oryza sativa
ccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaataggtaagcggggaataaccttatttatgacaagtttcaaactggtaaagtatacccctaggataaagaagaagaagagtgggctaaggaaactcgcaagaaaagtaccaaccgatcgtctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggcagcagcaaatgctactcattatagggatttcgacaaagcaaatttattcatcactaaagccgaagtcagtaggagtactattatgaataaattcagacctcgggctcgaggacgtagttctcccataaaaaaaaccatgtgtcatataacaattgtactaaatatagtaaagaaatcgaaataatctttagatccatctaagatttgattcccggtaaaaa

SEQ ID NO: 28385 - DNA, 43750 bp, Oryza sativa
  unsure (1)..(43750): unsure at all n locations
caaagaatttattggtacacttgaaaagtaccccagaaaatcgaagcaagagttttctaattggtttagatggatcctttgcggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcgttccagaaaggttccggaagaagttaatcgcaagcaagaagattgtttacgaagaaacaacaagaaaaattcatattctgatacataagagttatataggaaccgaaatagtcttttattttcttttttcaaaataaaaatggatttcattgaagtaataaaactattccaattcgagtagtagttgagaaagaatcgcaataaatgcaaggatggaacatcttggatccggtattgaaggagttgaagcaagatatccaaatggataggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgaactaaatttcttgttattagaaccaataatttcgacaagttcggaaccatttaatccataatcatgggcaaacacataaatgtactcctgaaagatagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcattttttaatacaaacccctggggaagaaaaggagtctaatccacggatctttttccgctccttttctatccaatttgtttatgtttgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggtaagaaaaaaattagatagaaaaactcaaaaaaataaaggcttatgttggattggcacgacataaatccagtcaaaaataggattaagaaagaggcaaattatttctaaatagttagacaacaagggatactagtgagcctctcctagttttttattcatttagttcttcaattaactcaaagttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggacgtgcatcgaatctaagagtttataagagaaaaaaattctctttaataaactttatgtctcgtgcagaatacaatacgattcatctttcgtttcatcagaaaaaatctgggacggannnnnnnnnnnnnnnnnnnnnnnnnnnnnnnnnnnnnnnnnnnnnnnnnnnnncacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaaaactacatatannnnntnntaccacactttagagtctttctattatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgcccagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctcttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttatgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccattaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagaattccccaaaccattattggttaagtttccacttttcgggaattttttggcgggaaaaataatccgtggtggtcttggttctttagtccccttagtagttcctataccggtcatgtgtcttggattatttacaagcggtattcaagctcttatttttgcaacgttagccgcagcctatataggtgaatccatggagggtatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaccaaatagaaatatgtatagtataggaaatccgtaaaatgtcagatcttaattattaatcttagctattaacttggtcgaaattggaagttctacttagaaaaaaatactagaacttcat

SEQ ID NO: 28386 - DNA, 2058 bp, Oryza sativa
accagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttggctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattca

SEQ ID NO: 28387 - DNA, 934 bp, Oryza sativa
tcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatacttt

SEQ ID NO: 28388 - DNA, 19935 bp, Oryza sativa
  unsure (1)..(19935): unsure at all n locations
caatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaagtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcacccaaacagaaactaaagcaagtgttggatttaaagctggtgttaaggattataaattgacttactacaccccggagtagaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgaggaaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattgggagcataatataatatctaataaatagaaaatcaaatagtagataatctgttatgaaagagagaaaacattctttgaagatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagnntncnnatntggnagacttnttacttnnnttagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatat

SEQ ID NO: 28389 - DNA, 3726 bp, Oryza sativa
atctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggaacttttttttttactttttagaaagtcaagttcttttttcgaaagattacccctgtctttgtttatgcttcggattggaacaaatgactttaattcgtccacgcctacgaatc

SEQ ID NO: 28390 - DNA, 3393 bp, Oryza sativa
ataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattcttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttct

SEQ ID NO: 28391 - DNA, 12672 bp, Oryza sativa
tttttcattatcacaggggatcttcaaaaaagaagactttgtatcgactaaagtatatacttcgactttcatgcgctagaactttagctcgtaaacataaaagcacggtacgagcttttatgcaatggttgggttcggtatttttagaagaattttttacggaagaagagcaagttttttctttgatgttcgccaaaacaacttacttttctttccgtggatcgcacagtgagcgtatttggtatttggatattctccgtatcaatgatctggtgaatcctcttaattaatcattaaacaaaactaataaactagaaatgattgataaatgatcaaggtaaaactttcacagtttccattctgaaatgttctctgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtaacaaggaataattatctactccatccgactagttccgggttcgagtcccgggcaacccatatggaaactagaaaggagcaatctgagttttgatttttcactcacttcatttacaaaattttttggtttggtaaattttgttgtatggatatacaactgtcggggctggcttggttgacattggtatatagtctatattatactgttaaataacaagccttctattatctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacatcggatggttcggtgttttgatgatccctaccttattgaccgcaacttctgtatttattatcgccttcatcgctgcccctccagtagatattgatggtattcgtgagcctgtttctggttctttactttacggaaacaatattatctctggtgccattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccaccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatggagagtt

SEQ ID NO: 28392 - DNA, 1698 bp, Oryza sativa
ttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggggatatagctcagttggtagaactccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctgg

SEQ ID NO: 28393 - DNA, 32146 bp, Oryza sativa
  unsure (1)..(32146): unsure at all n locations
aaaagggggagagagagaagaaaggaggggagttgggactctggcgaagggtttctagagcctgaactctctttcgctctcggcctctcgggattccttcacgcaccgatccaccagaacacaggagtagggtgttacgcttctcagcggcccgaacctgtctacgtcgcccgtgtcttgcgtatttcctctctcgctgacgttcctcagatcgagggcgaagaatctcacttagcgcccccggccgaatcggcaaaggggggcctgcgcggtctcccggtgaggagcctcacgctccgtcatctggcgcaccaggtagggggcgcgcgtatttttctaagccctcgtcctctttcgtgtgcgccaagcttctctcgctcagcccaatggtcgaacgggcagtggcgcacagcctctctccgaacgctagcggtgacgatggggagcagaacccgcgccgtcgggctcgcaccccaccgtccccctctcgccgaaatcctgggcggggggtggcgctcggggaggtcgaaagatccgtgacttcgccgcccgcgggcgacgggggaggacggcgagacggggcgcgtcgccgcctcgtctacggcgatggcggcacgccccagggcgcgctccaggctgcgggcgcgctcctgcgtcacccgcctgtcgtccccgatccaaagactccagcccgacgttggctggatgacgtggccgacttggtcatgacggcgcagcggcgcctaggcgccggcgggcggtcctccgccaccgaggcctctggcgctgccgccgccggctccatgtcgtcgaggcggagggcgcggcgagcggcggccgttacccgccgttcgtccgccattccctcgtcaacgcctccgacccaagaatatgtgcgtggggggccggatgcccgcctcgatatcgagcgccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagcctttggaacgtccgttagcccccaaggttccggcccaccatcaccgaaaaatacaacggaagcgtcaaccccgccgagtttctccagatctacacgaccgggatcgaggctgccggggctgacgacagggtcatggcgaatttcatccccatggccctgaagggtcaggcgcggggttggctaatgaacttgccacccgcgtcggtccactcttgggaggatttgtgccagcagttcaccacgaacttccagggcacatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcaagaagatcgcctccaaggagccccagaccaccgcgcaactttttgagctcgcggaccgtgtggctcgcaaggaggaggcctggacctggaactcctccggttctggtgtggcagctccggccgcccccgggtccgccgctcagtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctccccgcagggagcgcccaaccggcaagtggtgtaccgtgcacaacaccttcctccacgacctcgcggactgccgcgcggtcaaaagtttggctgagcggatgaggaagtgggaggaggagaagaggcaggagcgccgtgagggcaagaccccggcggctcccgccggcaaccggcgaggtaaggccaagcagaaggccaccgccgaggacgtcgacgatggcgacgatgacctggggttccaggagcctgaggccatcgtcgccaccgtcgatgggggagcgtgcgctcacgcttctcgccggagcctcaaggccatgaagcgagagcttctgaccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgcgccggccgtcccagccgatcatcggtgtgacgccggggcacacctggctgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactatgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcgccacctccgtcccggccgccccaaggcagcggatggtcacgtgcgacgaggtcccggtcaaggaggttgccctgggcgacggcccgtccaagaccacacgaatcggtggtcttctggacgacaaataggaaggcgcactagtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgacaacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatacaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccccagcaagcttggggatgtgcagtgcgtcaccggctgcatggccgccctaagtcggttcatatcgaggctgggagagaaggcactacccctatttaagctcctcaaacgctccgggccatttacctggacggaggaggctgagcgggccttcactcagttgaaggcgtacctcagttctcccccagtcctggtcgccccggagccagatgagccgttgctactctacctggcggcaaccccgcaggtggtcagcgcggcattggccgtggagcgcgacgaggacaacccccactccgcgcatccccaccctgcgtcgactcgacccgggagagagtagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctccgaccccgaggtcgtcggcacagaagccgagtgtgccccgcgtggcctctcggacaaagagcgccctggagatgcggcccctggcgaagaggatcggccccgtcgaaaggtgcagcggcccgtctacttcgttagtgaggccctccgggacgccaagacccgataccctcaggcccagaagatgctttacgctattttgatggcttcgaggaagttgcgccattatttccaggcgcatcgggtcacggtggttacgtcttaccccatcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacttggtccgcctcgactttcgggcgaccaacaatatggcggagtacgagggactccttgcgggactcagagtggcagctggactggggatccgctgcctcctggtgttaggcgactcccagttggtcgttaaccaggtctgtaaggagtaccggtgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccgacggtgcagggcgtgccagttccacgccaggcaaacccatcagccggcccaggccctgcagaccatacctctttcgtggccgtttgctgtctggggactcgatatcctgggtccgttcaggcgggccccgggcgggttcgagtatctgtatgtcgctgtcgacaagttcactaagtggcccgaggcttacctggtcatcaagatcgataagcactccgcgcttaaattcatcaggggcatcactgctcggtttagggtgcctaaccgtatcatcacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccaaaccacgccaagccgagcaaccggggaaatgcctttcttcctcgtctacggcgcggaagcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgtgtccaaacgcatgctggactgagcaagctctcaccaatgtgggagggtccgtatcgagtgatcggcgtctcccggccgggctccgttcggctggccacgggcgacggcacagagctgcctaacccgtggaacatcgaacaccttcgtcgcttctacccctagtgggggtcgggtgtcatgtctcgggctcgggccaaccccgcatccccccgggcgtgcagggttggccgggggctaccacatgcatatacttaccttttttctctcccgtatttcaataaaagcattttcgatttcctgaggactgcgtctgtgccatcgtttccttttgaagaatcgtggcttgaattagcacgctcgtgctcgaccctgccctcggtggcccgggccggctaaaatcgccaaacgggtcccagaaccgagccgtgtcccggggcgtggtgaactccgggggggaatcggcaaaggcccacaatcgggtcatccataaccctcggtcaccacgctcccggcctggccagtctcgacacgaggatctccccaggcactagccccgacccgcgccgtttgaggctgggacctgggcacgaggccttgttcaagccaagacacagaaggaccgcggcacaggccatcctcgtctcatacacacaacaaacagagctgacgcagaaatctcctctttacttgattgtagattaaatcagtctatacaagaagggggcccgaaggcctcggaagaagaaggaaaagttattaagattggcgggggcctgggggctcactccgacgcgcccgggtcgttggcctcgtcgtcgctgtcctccgcaccgtcgtcaccgccctcctcgtcggagttgagcgcgaacgcgagccgaggggccgtaccctcgaagctgtggacgatgtggtcggcggcgtcccggacctgcgcgcgcgcgccgtcctcggttccgggagggaactcttccagcgctgcccacggagagaagtcagggtccctggcctggtagcttgccagtacgagctccaccgccccccgggcgaggtccctcgaggatgacttgatagtctcctcgagctcctcggggagccgctcgagggccccggtcatttctgagaggcgctgggcgaggccccccctggttggcggcgtacttcgcgtgccgcccgccccagaggcccgcctgccgcccggcacggtctagacgggagacggcgtcccgaagcatgccgggccctacctcgctcgccaagcggagggcctcgacctccccggcggacgagtccagtgcgccctgcagctcggcgatggtgtgttcggcggctgcgagacgggcagctaggtcgctgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagctcgcccccgctcggtgagcgcgtcctcgcggaggcggagtgcggactcctcttcggcgcaggcggcctcgtgcgccgccagtgttgcctcccgggtggcgacggcggcctcgcggtccgccaggtctctctcctacgcgtccagggcgcgggcacgctcctccagcgccgtggcgcgagcctcaagggcctcttcgcgctgccgggacgccgcctcgttctccgccgcccgccgttcccgggcagcggcggcgtcaagtgctccccgggcggcgtcgagcttctcctctagctccgccacccggctcccgtattggaggcggaggtcgtcccgcgcctcgtcgagcacggcggtggcgatgagggcagtctcccgctcctcctccacctccctggcgatctccgccaggtctctacgacgggcctcgagctgtgaagcgtgccggcggtgtgccatgcggcccgcctccaccatggcctccaccgagcaccgcccctcctcgacgcgcgcccacgccgcgtcgagctccgcccgctccgcctgcagggcctccatctgggcacttaacccgtccagcaccgtgacgttcgcggcggccaaggcctgcaggaggggctccgcgcttggtggggcagcggaaggcagaggggagagccccctcggtgtgggtgccgcgcagctcggcccgccgatcgacgtgccggactcgggggcgtcccccgaagctggctcgtcccaagcgtcgcccgaggggtcgggcccgagcggcgcgcccgcggcctcgtcgtgggtggcctcggaagtcatcgtcgcctcgggcggagtcgggtcgggggtttggcaggccgcctcgcgtgcgtgcgccgcctctgcctcccggatggactccccggcccggcggagtctggcctcctcccgagcggcctcctcagcctggcgagcccggacggcctcctgggcagcctcctcggcttcctggaggcggtccgcggcttctcgccgatcagcttcccgcctccgggcctccgcggtcgccgtctcctcggcctcagaccggccggacttggaatggcgggggagggggggcgcgacgggatctcgctgaggcagaagaaaaaccagaagacaaaaagaaacgggtgagtgaaaactcgccttgggagatgggagaatgaatacggccgcggtgggcgcagggacgaacctgcggggaggtcggctaaacgaccacctcgggggcgagatgaggctccaccggcatggctcggtcccccccatcttgcggggccgtttcttctttcgctccccctcgggctgcggcgtcggcacggcaccctccgggcgcctgctgctagcacgcaccgccccgccccctcggggaggagatgggggaggggtaccctcctgcttcctcttcccccgggcgtcggcagggcggctgccccccgggcccccgtcgcggggcctagaagcacgaccccctcccggggtagattgtttccccctgctgctcccgcccgcgccatcgtggcctcagggggcccgctcccccgacgccccgaccacctgcatgatggtcaggatcttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggtccggtgtactcccagtcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccggtcgctcttccagtcgtcccactttttgcagaggacgcagggaacgtagcggttcagcacctgcccccgcagctggaagtagcagccaccgactaccgtcggcggcgacaccggctgtacggtgaagaaccaccggaacagccggagagatgggcgcaccccgataaacatctcgcacaggtgtgcgaagatggccaacgtcattatcgcgttgggcgtgaggtgcgccatctggagatcataaaactccagaatatccatgaaaaaaatagagaatggcgggaccagccccgccattgcgaaagagaggaagaagacggaccgccccgggtagtgtggcgccgggcatccctcgcccagcgcgaccacctcccggccggtggaagattccggcatgaatcggcgcggcagcccggcctgtctctcgctcacgatgcgggaaggcggcagcacgctaccatcgagcggtgcggagccccgtgccatgacgccggcggaggaggagcttgagaacgagcgagtgcggcgagggtagggcacaggaaacgaagagttagagcacaagtggcgaaggcaaggggaagagtggcgagaggaaagaaactaatcccttcctcggcgtctttacacccttgccaacgctatgcccggctcctcgcttcccgcgcccactacctcgccccctcgtttctcgcgcccacgcctctactaaccccactcgcccatttgcggcgcacgcggcagacgtgcggccgtggcggttgagatggggcagatcgtgcgcgcgttaactacgctcgccaaccgtgaaaaacgccatcatcatgtctccaggcgaaacgaaccggctcgtcccgattcgcgcgctgctcgagtaatgtagcggtcttgaagaggccgctcattactatcgatcggttttcccttgccgatgcgcgcgatttgcgaccgctgggtttctgcccgcctgtagggaccggccccacctgtcaccgggcctaaggagtggcgtcacgctcgagcgcttccctcgaggggggcgatcgccctggcgtaacgccgggggctactgtcggtgacatggggccgggggtatcgtgactagaggcttgggtagccacggtcacccacgtggcctgaccccctcgggggggtcgggcccgaggatgacgtggccacccctccctctgtctccccgaggggtcggaccgctcccgtttcggccccgagggctggggcacccccgtttcggccccgagggctggggcgcccccgtttcggccccgagggctggggcaccccgaccccctgtggttttggcgccacgcgtgtgggttaggtgagcacagcggggctcacctaaccgcatttatagcgggattggacgagtgcgccacgccgcatttaatgcggcgcagcgcacacttatccggtccgtgactggtcgcggtgtgtgaccggtcacagaccggtcagatcgcgggttaggtggcaacaggcggtctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggagacgtgcgctctgcttgtcagaggtcacttccggctgtagactagccctcattgtaaaaagcatgtttcccttcttaggcagctagaggcccatgtggtgacccctgaccagataaaaaggaggcccaggcctaggaaaaaaagggggagagagagaagaaaggaggggagttgggactctggcgaagggtttctagagcctgaactctctttcgctctcggcctctcgggattcctccacgcaccgatccaccagaacacaggagtagggtgttacgcttctcagcggcccgaacctgtctacgtcgcccgtgtcttgcgcatttcctctctcgctgacgttcctcagatcgagggcgaagaatctcacttagtgcccccggccgaatcggcaaaggggggcctgcgcggtctcccggtgaggagcctcacgctccgtcaaaaaccaactccatattatttatcatctattccaaatttaattactcttacttttggatatttatatactatatttttctatggattcttctaggtatttggtcttcacttatttaattttttcttataattttgtttcaaataaaatgatatttttaagtttatttgtaattattattgaaaatacaattttagaatttactttattttttattctgatttttgcataatcttatgttgtgttctagatgtttcaaattcttttttttcctgaatttcacttttttaaaaatgaattcctagttgtactttctttttatccaattaatgttggaaatgtctagcatctgggtcgagtattttttatatttttatttcgattttctgtgatttctttaagtttttttaaattcgcattgaaaatctaaatttatgatatattttatcttttattttgaattttaattaatctcttgttgtgttctaaatggaccattctttaaatatttttttatttcaaatttcagtaatttctaaattctattcctaaattaaactcttattttccttttttttcttcttcaactaatactaaaatttctagcatctaaaacaatattgtggccttttgagatgttttaataatagatagatagatcgatcgatatatagatagttctgagtgtcgcaccttgcgcgccaccgaagttgacagctgccttacatttctgacctctgtatgcttgtgcatacggcatagcggcatgctatatgtatatatgttgtttaattgtttcttttctcctaaatattgcatggttatatatttacagcgtatacatgctctgccacttattaatttatttttattgctttgaagaacactatattttttccaaccaactttgagcgcttaggcagtgttatttgaacactttcctaacttctgcctctcgtttttcacgcacgcatattctaaactattaaacggtatgtgttttgcaaaaaaattctataaaaaagttgctttaaataatcatgttaatctattttcaagttttttaagctaatgcgtaattaattatgtgctaatccgttgttccgttttatgagttgagaggaaaagggttccaattaatcctcactaaagaacactgccttaatacaatacccctatttgcttgtttttgccatgggtgagtacgcagtgcagatctcttatatcacagtgtcaaatgctatatgcatgcggacatgaaacatgcaagcatgtccgactcctaattggattgctccagctgcctccagcaacatatatgttgtctgattcttaatgagataaaacccttaattgcttatgactttaccattataatataggaaagaataggctagcctcaatcggtctctttaatgttttctacgtggactctgcatattatcttaccttttttattccgaattttagtatattttataaactgtatttttacatagactctgtttttctttttctcgattaatgtaggaatttctagcctccacagcgaacgtggtacctcatttcaaagctgttttaataatataatagatagatagatagatttggattttattttatttttatttcaaattttgattaatctcgtattgggttcttatatggaaacttctttcaatattgcttaattttaatttcgaatttcagctttttttaaattgtattcctacttggactctcctttccttttctaattttggattttattttaattttattttgaattctgattaatctcatattgggttcttatatggaaacttcttttagtgttgcttattttaaatttcaaatttcagctatttttaaattgaacttctacttagattctcctttttctttttttttctttttctacgattaatatgggaatttctagcccctacagtgaacatagtgccttctttcaaagttattttaataatataatagatagatagatagatggtgcaaacggtgagccaatcatggtgtcccccaacatagacaacctcaccgcgaacactttcagcatcaccatgccggcccattaccctgctgtggaattctactacaacggtgtaggcggtgagcagaacatcgaggaattctactacaacggtgcaagcactgagcagaacatggcgttccccaccatggacacacacgcagcgaacattttcagcttcgatgcgtcaatcaatcactctgctgaggaattccgccaaatcagtgcaggcggcgagctgaacacggtgtgccccaacatcgacacccccctcgccgcgaatgcgttcagcttcgtcgcgccggtccattactccgatgccaatgcagacctccatctccatgtggtggatgccggcggtgagcaagacacggtggccgccattgtcgacgtgatcggcatcccagcatcaccaccatctccagcaccggcaagcatcaccaatgccaccgtgaagagcgtgtggcgggagaactacagggagcagttcaagctcgtggtcgacgcgctccaccaacctcgtcgccacctctacatcgccgtcgacatggagttcgccgccgacgccaccaccaacatccgccgaaggccggtaacctccaccggttgctaccatcacctgcgcgagtttgtgaatcgcggcgacatagtccaaatggggctcgcgttcgtgttcgtcggtgacggcgaacaatcctcctcctcctcctcgccgccgccgataacactagagatcaacttcaaaatcaacatcaaggcgcgcaagtannnnnnnnnnnnnnncgcgttcctgtcccgtcaaggccatgatctgagggagcaccggaggaggggcgtctcgccgcgtcgcgtctacgatggccgctccgtcacctggctagcttaccacggcgactacgacctgagtttcctcctccacctgctgcaacgcggaggccgccgccgcggaggcggcgatctcccgcgtcagctagccacgtttctgcgccggctacgggagaatttcccggcgttctacgacgtccgcgtgatcaggcagatgcggaggatcatggcttcagcgggaagctcactgggctcgccgagcacctcggaatccggcgtaccggcggcgccgcgcaccatgccggctccgacgcgctgctgacactgtcgtgtttcttcaagatcttcagatccctctcaggacagcagctgcatcagctggatgctcggcgagggttactcgctgggttagaggagtggaacatggcgatcaaatgtgctcgccacattgacgatcacactagaaacatcaaggtgatcgaggtggtggcagaaaacctcggcgaagaggcgcgacgaatcggagagctggtggacagcaacttcagcatcattggagtagaggtaaatcaggtagtaatccatcctcaattggacaggaaggcttatgaaatgatcatcgcgttcatgaaccctgaaggaatgttggcttacgggcgtgcctggaaattctgcatcagtcgtttcacgtcagacaacaatggcaatgtactgaatctgaaacagcttgttgaacttatgcaatcttgtggagcaaccaacaaccctgatgtatcctgggtgacattccagggatcagatgtgatctacagacttatcaggtcagccaatggtggtgttattccttcattgatcagcggagagagctacttccctagcttgtatgatgtcgcattgatcgttggtggattccatggcatcggcacactcgctacaactgatcgcaaagtaggtatttttgatgttgctcgagcgctgaaactgaaggccatcaaggccgacaaggaggcagagagggttcttcttactttgagatgcttcatgagattggcagaactgatcccctgatttcccagacatggcgtcggctgtccaatggtattagcttgtggcgagcttccgcgatgctggagcgttcaatgtgcagtggtaccaaatccttgctgtgactgtcaacatagtgttttagctattttgctgatgatacgaacttcttcttctcagactcatacgagtgaacttcatatatgtatgtaacagtgtgattttgtagctctaatttgtgcttatatgacttcccttacaacttgtacaaattcctagcttggaatataataatacgggtgtacatacgtgaattgctctgggtttgtatgctggtgaaaaaatatagattaattaattggatgttaatggtggatggaaacgaaatgcatcacgttgttcttccgtttggaatgtttttcttccgtttggctggaacatgttggcatctagcatctgccgttcgatctctccgtagtttacagcgcttacttttttcttttcaacaagtgccaatcgaaattgaagaaaaagagagctgttctactaaaaattaaaactttaaactcgaaattaaaaaatcaaccaaaatttaaaactttcaacacggaaattgaaactttcaaatcaattttaaaaatctatcaacttaaatttgaaattgtcaactcaaatttcgaaacatttaacccaatttccaaagtaaaactcgtaactcaaaaaatataaaaagaactctacccaaaattttgaaactttctacaccaaattgaaactaaaattaaaattttttaaataaactatttatttattattctattttagaaagccattaaaaataccaaaaagtagccttaattatacgagactttttacgttcctttaggaggtaccacgagatactaggtatcacgaggtactactcacatcccaccgttggttagaaaggggtaagatgggtatcagatatttctataggtaggagtcctcgcggagtccgccttgcacagccgcgttaggtcgcgctcgcggagggagactacctcgccggtgcgcgcgtcgcagatgtggtaggagaccatggtggaggcggaggtgacaaaggatgcgtgccgagaaggaggagaaggccggagcggtcggcggcggcgcgtaggggtagcatccaaggcacgccgggagggagatgtggggcggcacggtgaggacggaggcccgcgggacgtcgttgcggccgacggagatgtcggcccaccacgttggggattgcggctaggatggcccaggggctcctgcgccggcggcggcatgactggatttttcggaggaattcaatcggttaacaggtccgtgtttccacgccgtgtccgagattgtggaattcactgccgctgccgccgctcgatgtgcatgccgagctctgcagcgcctaatcggagcgaggaggcaccaccggagttgaattgttcacatagccatcaatttgctctactggttggccacatataggaggttgtttgcaccagccaaggtgagcaaggaagcagcgcctcgctgtcgccattggagccacagcaccatgcttgccgctgccactggagctgactagcgtgcttcgaaaaatctagacgcctgaatcttctcccaagggcggggcaaaattttttcttaaaaaaaatgagcaagaacattggacgacaatgagtagaactttgcgaaaatttcactggcatatgctaaatggcgtaagtgggaggagggtggtcataagaaaagaaaatagatcggagaggaaagaggaggcagccctgagagagcgcacggggaagagggaggaagcggcggcgccgtacggaggggaaaggagggcggtcggaggttctcccgaagtcgctgccgtcaaccgatccgccgcctccaacaggctgcccacgagctctacgatgccttcccgctgcctccatcaaccagatttggcgcccggcggcggcggcggcggccggatttggcagcgtggagcgcgagcggtagaacgggcgcgccgaggggaacgggatgagcggggagcggggccgtccgtgcttcgacgaattgggtccagccgtccagatcatgcatgcgaaaatacctttatgccctttacaagctcggcacctggaggtaccgagtattctcgtccgtcagatgacgctagatggacgaccatgattttgtacctgccttcgtcgaggaatcacaggtagtttcactaactattcttacacgtgcgtatcttgatcaaaatcggattcttttgctgacattgcccttgtagtaaaaaagcacaccataaaagatgagaccctattccagactactcattcaggaatctactgaacattctacttcatttcagagtttcagaccatatttttttcaggagatactggtgtactgcacattatattacagagtttcagaccatgtgttcaggatgtactacacattgtactacacccattcctactcctatcttgcagttttgctgcgcatagtagcatgcctcgctcactgtcaggaagatccactcctctccgatgagcccgagaacatttgatttgtccaatttcctcatgatttcactccccgggttcgccagcgcaatctgcagacacaacatcagaaagtaattcaggtgatatataagccttgaaaccagagattttaagcaatttgaggtgctaatgcagctattagtttgctcctccttacctgaatgctactcctgtctaggttcttcttgagatcttccaacatcttcgtgccgctcgtgtcgatgctggcaacggctgcaggaaagacattggttgatcagccctcatgcagaaattcccaaatgaacaagttatttcaggttcagtgtttcagagttcagatatgtgtattatttcagtccagctgtacaagaagaacttaccacccatgtccaagactacacacttcaagctctccagaccctcggccttgatccggtcctcctcgtggtcgatccaccgcatgatcctgaacacaacaccagaaatttgctgtcaaacatgagattctccagtcaaaatatgtttgtcagatattgtacagtgcaaatgcactgtagcatttactctctttttacacacctctctcgcaggtagcctgaattggcgaagtagataggtgagtcgatgcgaagcacgagcaatcccggcacggccttcgccacggtgtactggtccatcctcctgaagttcgtcgagtttggcatcttcccgaggactgtcgtcttcggccgtgcgatgaacaataggatccggagaatcgatatcccaacctgcaaaatcgcacaaaaccacaagtttgatcacaaatgttcagaacgacaagcttcagagaagtatgatgatgatgtcagtcttgttcagctcagctcagactagagaaagcttcggagcatgtgctactcactgcaatggcgagtccgatctggatgtcgccgaagacgacgccgaggtaggtgccgacgcagacgcagaagtcgatcttgtcaaccttccacagccggacggcggccttgtagtcgatgatgccgatcatcgccgagatgatgatcgccgagagcaccaccagcggggtgtagtggaagagcggcgtcaggaactgcagcgtcagcatcacggccaccgccatcaccgcgttcgacatcggcgtcttgcacccggcgttgtggttcaccgccgccctcgagaacgggcctacaccacgccagccatggagatcggatcgatacagtgatcagtaagagctcacagagatttttgtcggaaacataacagtaactaatttgttacggaagagaagaagaaaaatctcttgtataccagctgtgaggtagcaggaggtgcaggagccgacgatgttcatcgccccgaaggcgatcatctccttgttcccgtcgacattgtagctcttcagcattgcgaagctcctcccgatcgcgattccctcctgcaattttatgcagacacgttacaagctcggtgagttgtctgacatagccgatgtcatttctgacgaaaatggagttcagctgaaagagtgaagcggctgcttacggcgaggccgatgatgccggtgatgatcccggtcctgagagcgaccatcgtgtgcggcgacgacaggaggagatcgcgcgccgacggcgggtttatccccttcttcaggtacccaatctgttaattgttcatgattcagtcacatttttatcactactgatcagtgcaaatgcgttatgtttcttggaaattaaagtgatgagatcttttgttttgctcgtgctcaccaccgggatgccatggcggtcgccgtggatgaggtagaccagaacgcttccggcgatgaccgacgccaacggcgccatcgctgatagcaagaaccacttaggcttcctcttgctctgaatgtacaacagattattacaaaaaataaataaatcagctttgatcgatcagagcatcagaaattcagaacattgggttttcttgactagctaaattaaagatgaactgaattcagggcaaaatgccaaatggatatagtagtctagattacgtctatgattttgtcctggatcatgtgctgatcgattcgtttgtcctagtgcgacatgatgcacggctccaaatatctcatggaagtatatattccttggatccatcactgactgtccggtagcaataacgatctgcagctagcttattcggtcctatactagcacaggttcaggaccagtactgacaaatgaaccacctaccactactactactacaatcctgcaaaattctagtaacttctaggcttcaaaagttaaaatatcaggaccagttaccgtactgcttagtctgtttggagagcttctaacagctgtagattctccagctgctagaagctcccccaaacaatccagatttttaccaagattttggaaatatgtagttataaaatccaaaaaagaactagactcagcttcttcagattctcaccagctgatttttaagatcttaagctccccaaacagcgcgctagtaggggtggaaatgagccgagccgagccggctcggctcggctcgtggaagctcgcgaaatgccaggctcggcttggctcggctcggttctccaaccgagctgtacattaggctcggctcggctcgtggtctggctcgagccggctcgagctggctcgtgagctttgcaatagcagcagttgtattgccagcagcagttgtgttgctttgcaatgacttggttattcagataataactctcaagtccctacaaagataattaggtatattgtatgcagccaacatataacaaattgatgggcttttttggttttcggccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagcccgagctatttgtccagccctacgcgctagtcctactactctccccaaatctcaagcatccagctctggatcctaccatagttttcacgtttacattgtatatgtggattacgctacctattttccctcactgcatatatccggccagttactactagctacacttgattatattttggcttcaagatttaccaaaacctgacttctttcttagtatatcattatcatttattagtttgatctttccacttttttttaaaaaaaaaaacacaatcatactagtagctgagatgaaaaaggcagcacttacgatgtagcgagcgaagaggaggaagatcaggaagcagcacccgaccacgatgctctgccatcgccactgccaacccaacaacacaacacaaccaagttagacacggatcgaacaccggagacaacaatggcgcggcggtggcggtggcggcgggcagctgacctggtgcgactgcgtgacgacggagcggacgacggcgacgacgtcggtggaggtggtgaagtgggcgaggccgagcatccccttgagctgctgcaagcacacgatggtcgccgcgccggccatgaagccgacgatggcggcgtgcgacaggaggtccacgaggaagcccagccggagcacgccgagccccgcctggagcaccccggcgaagaacgtcgccgtgaacgccagcgccgcgtacagctccggcttctcccccggcggcgcctccttccccagcgtcgccgcgaacagcagcgacgccaccgccgtcgtccccaccgccagctccctcgagctccccatcaccgcgtacaccagcgcgcggcacgaagctcgagtctgcacccacacacaaacacccatcacatcaacaatggcacgcatgaagaaggttggacggcggcggcggcgacgacttacataggcccatgatgggagggaggtcgccgagcttggcgtagctgatgccctgcggcacggcgaggctggcgatggtgacgccggcgacgacgtcggaccagagcgcggcgagcgagtacgacggcagccactccaggaacgggaacacgtaccggagcgcggcgagggcgcgccgcccgccgctctcccgcgccaccgcccggaacgggtcgtcggggaagaacgtctccatcaggttgcccccgatcgtcctcagcagcggcttcggcggcggcactggcaccctcgtcgtcgccgcagccgccgccgccgcggcgtcgaccacctgctgctgccctaccatggtcgaacacctggtgctcacgtgccaatgaacctgagaataattaagcgtacacaaaaacaggttacacacctttccaatttatagagctcgtgtgagaataggtgttatatgtactagtcctatttagttatggttggatttagaattataataggtggtaaggggccgagttagagtcggcctctgtaacccgacaactagttgtaataggtggtaaggggtcgagttaaagtactctcttaaataaagagaggggcactaccatataataatggcgactacaatgtagcgtaaacacgcagggagataatggcggcgtaaccatggactcgtaatggtaggagctatattgattggagaggagcgttcataatcagagccccggaggtataggcttcagctgaatttcgtgaataaatatcgtatgttcctatgtcgtcatttgacgtgtcttaggtacacaatggctgaatcgatcagagaaggctagtcgttattactaactttcataacagtttgtgtgcgtgtcaacggcacgattgtcgatcgatcgattcgtgacgtgattgaatgatcaggcgtgatggggaaattattcagtgtgtgagaattaattaccggattaaccataattaatccttattgctattgtggctattaatttatactttttcatagtttgggggctggtgtacgggtggaaacgataggaaccggtagcatctctttaaaaatgacgtttgatcggatggtaattatcatttaaaataccctattatgatattaatacgatgcaaaaataaattagaaaacaacaaaatttataaataacaaaaacgatacagtcggaaacgttatactttatacagaaacggtggtcagttggaatttttgtgaggtgaatcggacataatcaatcggttgaccgatttcacccctagctggtgaatcggacataatcaatccgtttatacgaagttaagactagtactctgaggtatccggatcagattatacaatggtgtacatggaaagcttttaggtggcaggataagaatatttaaggaaacggttatgaataggtctcatttacaaacacacaaataagttaaaaatggatttactttttgtggagtttcaagtacttctctattcctaacagcacaaaatacatgtactgctatttggcgcacatgtgcgttcccaacgatacagtaaagaattttacgtattttttaaaagcattgaggaaaataacatgcgacaataatctggtaaataaggggattctaggtgaggttgtgtcgcgtaatacaaccttttttttgtggtgaggatatttttaagttggtatagaagtgcaaatttgcaatcatagcgttggtggcatatcacgaggaccgagaatgtcaaaacatattatcaatctcatgggtgaaacattgaagaggcgaaacacctgcttgagcgaagacgggagccttggaatagtatcgtgaggcgaaataccaagccaaggggagatgaagcaaagaacctttgctagtaggcgaaggaaaccaagcctcaattggactggcccttggggaggccacggttggtggcctaggaatgggccctagggccaaaggctagttaaatagattaattgtttgtaattaccctgtaagtattcctatcgtaaggataatcgtgtaaatttctctgtacatataaatcctagggttgcttggactagtgttaggcctataaataaaccccaaggggtatgtaacggaggacccccaagaaaaatattaacacaaatatcatttactttttcatatcttcgagtgaatcatgtctttcgagaaacgatgttttcaatcgacaacacgtagtttgttatatgaagaaaattattattattagacaaaatatgcatgctagcaagtgtgatgtcactaacaatcatatgttagctttttctagtacgtgatgagtatgcgatcaaagaaaattcaattagcaaaatactataaagtatttctctttattttatattataagatgttttgacatccttgaataggcatgtaaaatacatgcatgaatctatacgaatctaattaaaacaatttgaatagacatatagaacacatgcatgaatccatacgaatctatttaaaatctaaaacaacttgtattgtgaaattataggaattaatctaagactatctagttgaaagtgacaaaaatccacatgaattaagcacagatttaacatatttagctcaattcttcaaaatagatcttcaatgtattcaaagctttaacacatatcatcatcgtgattacccctattacaagctcagcacacatatttaatctgttaaatatacatgtatttctttttatatgtacagaaatcgagacagattaagattacaactccgatacctatgtgtcgattaattacgtgtataaccttaccaataatttgttaaatatgattatgtatttagccgatgtaaactaaattaagtataaatgttaggatatatcaaatactaataaaaaatccattgagatggagatgaatgtagaaattgttcatttaaagataaaaagagaaaaacaggaagacccatacgtgtatgctcgattgcgtagaggagttgtttgcgtttcacaattgattttgacaaacaatttttgaaaagaaattttgaaacaaacgatgaggtttacattacacaataattgaaagtaaactttacatgagtaataattagaggagctatttttgttccacaattaggtttacattacacaataattgaaagtaaattttacatgagtaataattagaggagccgttttcgtttcacaattagttttgaaacaaacaatttttgaaaagaaattttgaaacaaataaggtttataatacaccgctatttttaatgtaattgaaagtaaattttacctgagtaataattgatcttcctctttctagcgtatgctctttttagccttatttatctcataaaaccaaactatttatctcataaaaccgaactgatagctgatggtttacttgtttcgagagatacaccgacagaacatacgatcaaatttgccagaacatgtaatctgatttgccagggaggaatttaattacattaaagttttagatttttgaaatgagaaaaattatatatgatgaagtgattttgagatgaaagctcatatctccaagggcaaatttgttacatggcatctaaaaacgtgtaattagttggtttacactacaagaacgcgtatatcctgggcatagtgaagaaaaggtacttagctgttggacacttgcggtattattttattatttctagaggaattggatagagatattgatgtgagaataagattatgcccctgccttcagggtttacagctaactggttttattcaaacccagacccagaccaatctcactctcctaaatccccgtctctctcctcaaaccctagaaattgagggcggtgaagtagttgcaacagcatggtccacgactagcggcgagttccgttgagggtgatgacagattgaagttgcgcagtggttgcaccgatggagctgtgagcctggtgtggtgtcatcgatgcttggaacgttggccctggggtgatgtataggatcaagatgtcgactagagggggggtgaataagcaatttaaaactaaatggcactttatcaaaactaacctaagttgctagacaaggagagatgcaaagttaactaagcaactaagttaagttttgcaaacctagggtgatatgagctcaaatacatctctaggaaagtaaatcacacacctaagttaagttttgcaatcatagggtgatatgagctcaaatatgtctctaacaatgtaaattgcacaaatgtaaatgcaacaaataaaatgagacaagatactgggaatttttcaccgaggttcggaaactcgccgatttcctaatctccgttgaggcgagcccaactccaccgatcaaccacaaagccaccgcacacccccttcgtcaaggggtgggcaaggtgggagccggcccacggagaggactacccaagtctcgatcactttggtagttcttccttcactccgaaggtggtgaactccaaaccactcacaaccgggccgagcctcctctactatctcctcggagaggtcaccgggcaacacctccacaagccgtttaggaggcagcaacctccaagagtaataagcgatgacccggctctgagatgatcaagtgacacactagctctacaatgaagcaaaagcacttgactattggctaaccaaccctcaatcacacctaatggatgaacacaagcactagagagtgtgagagagtgtgcaaggggtgtatgcaagtgaagcaagtgccaagagagctcccttgctgctagtgggggagtatttatactcccaccaaccaaaacatgccgttgggggtcgaaatcccccaactcagtgcactaccggtcagaccgccactgtgtggccggtcagactggactactatgcaatgcactgacacactgggggccagtcagatcgcaggtgtgcggccggtcagaccggccacaactcggtcagaacaccgtcggctcggtctgaccggctacggctctggcggctctagatcgccatcccagagcacagccaccagccaccagggggccggtcagaccagggttaacccggcggtcgtaccggccgctacccgccggtctgaccggcatatatgcctcggtcagaccagccctggtcagacaatctcaaatgtatataaattgaaagagtctaaatgaaaatgacctaatgtggcaatttgatcatctctttgtctaggtcattacccctcttaatagtacggcaaagctataaataaactagcacaattttgatcgcccaaatcctcgatcaatttaaaattaaaacactagtttaacgtcttcttttccttttgctttgcgccatcaattttagtccacgataatcatccatgcacacatataacgtaatcctatctcaaaatatataactcaaaagagcggttagtccacaataagcgcttgtcattaattaccaaaattaacaacgggggcctagatgcttcatgatgtcactgaggaagaagcccgtcgctaccaggttgaaaccaccgcgccacacttgctaccaggacatgtcggcgacgatcgctgccacagccgccattagtcatcgtctccgcccaaaatctagggtttatgatggggatcgattaactacaagagtcctcgaggctggtttgaaccggacccattcaggtagaaataagttcaaccaagggcaaacttgtctttaatggttgtttctctctccaattacttcgtaaataataaaataataccgctaattaccgatttttttacagtgccctatagcagatacgcgtttttgcattgtccactaagggtgtgtttggttgggtggatgagcctggatgggagatggccatccgattttctgtggtgtttggttggagggcagtgtggatggggcggcctggaatagggaatattccctcaagatgctggatgagtgcatccgaccgatttggctggatgaagccatccagttttggtctgggtgatgtgtcctattctgattgggtgtggttggtttgatttctccaaatgatttttcccctaaaccatttatctaatttatgatttgattacaccattatatttgttataattaaatctttaaaacaagatctcggatgattatattttgataaaaaaatgtatatgacaaatgggtcccactaacttatggcttttcccatcaatgctatatccctccaaccaaacaagaaattggatcgccatatccatacaaaacaaacaaaaaattggatcaccatatccaacaaaatatggatgaccatgtcccatccatgcatgaccgtgaaccaaacacacgctaaccaattacacttttttgaatgacctgtagtaaattttgcctatctgcaatcggaagcttcgttaaatcaagatgattaaaagtcttgtgcttaatttgtgctgacattttcgaattgaatgtttgagatttcgaaattgaaagttcattgcacatgttaagtaaatgttttaaatacgtggagcatttcttttttaaaaaaaggaaaagcggagtacaaatcctcagcacaaacagggaggctaggacttttctactcgtgcgtgcgcgcctggccctgaatcggctaggcgcgccgcgtgcacggcctaggttcgccgcgcacacgcgcaaaactagctaggcaacctgccccggatgaaaccagcagcttgctccttaatgagggtgatgttggcaatgcacagtacgtcgacatcttcactcttgactagccttagcttagctatccataggtaagcttagcttgggcgagtcttgagaaaaggaaataaatagaaagatagagagaagctgttggggagtttggacggacgctcatacatacgctgtcacgcatgcacgcacgaccaaaacatgtcaactttgacgacgagtatcgaccgtcggtttggtgattgttggttgcgttcaaatcgaatatgaccgcatattgtttgaccatgctgcttgacatggagcagatctgacagccatcgagatagagcagcttgtctgtagtttactgtcttttttcagtagcagcagcgatcgtcatcataggctttttttcgtgggtgccacgcgccgacgtgcgtgagcatctcttgaacgtagtcccaaagcaacgagcggcggccgttgggatggatagcttagctagctggacgccggccatgcatccgttgtcgtcgtagcccggcccggcccacgtgatccccgtgtggtgggctaggagtttatgttgttcagattgatgtcattttaaacgataccgatttttttttggtaaagttatcataaatgtgcattcatttagtttttatcaaactttagtaaatatataagaaattcagctaaaatttggcaataataccaaattgtcaaaatttggtaagatttatttcgactacaatctgaacaaccccttagtttcttcaagatttggacaatagatggcaatggccccgtttcccgtttcaccgaggtgaattcacccattagaaggtggggatggttagagttggtttttcatgagaatataaacaagagtagacatgtccctgtcggttttcccaggggcggggatggtccttcattcccattcctcgctcctagtggagaccagtggcgaagccaggaatttaaccctgtgtggtcaattactactagtttgtatttaagtggagtcttttctctaatttttctggatttatacatgaaaatcaaggtctataggggtgtttttcaaaaatctatggggtcagccaaccccatagcttatgcatatgcccgccactggtggagacctgcatagggatccaagtttaatgttttttttacttattttacctgattttattactggtaatctttgataaacgataatattgtgtttttatcatgtgaattagtagataatattactagatatatatatttatttattaatataaagtgagaatatatgtttaattgtatatataatttgacatatgcatattgttttaagtgcggacgaagacccctcgaggatttattccccgtgtgcgggatggggatggggacaaagtttttccctattgtacctgcgaagacggggacaaggaaagttttgtatcgtgggggtgtggatggggatgcattccttgacagttaattccccgttaccatctataatttggatattgcaatcttctaaaaatacttgtttaaaacatattgttataaaaaaataattttataaatgaactgcgaactcgatcttcaccaaacccgatgacattgagatctaacatcttaacgtcagatgcgttggcgctaacactttgcaaagaatggagcagctgatgctttgtcccgatgcagcttgtctcatagggtgagcttatggggccgatggattgagatccagtgcagttgttactatcactgcaactttagcagttgcaaggtagctgatggatcaaaaaccagcggctcagatcatcagaaaatactattcacgaatcactgtagcgtacattgttactatcactgttcacgaatcactgtggcagagcaaatccaagctattggctgcatcgatccaacggtcataatatgctatcactgctaaagttgcagttgttattacaactgtattagatctcaattcggggccgatgtggtaggaggtcagtgccaattggcctcctaacctcaacgcaaataagcctgatgccaaggtagggggaattaggcaccgctgtttattcttaaaataagtttgttctaaaagggttaattgtgaaaattttggtagatcccctctctccatagggagaaaacgacgagcgtggtgggcccactacgacgaggtcaaatggtcaattagtgtttgggtcgtttaggcccaccaaaatttagagagctccacccaagggctttaaagggaggcccattcgaggcccaattttgccggccctaatcaagcccaaagcgatataacactgcgtttcatcgcaactacagattgtacgtacctagagtcctagagtactgaagatgaaatcatcgatgaagattctgtggttcattcaagaactggatcgtgttcgctggttaattgcgcatcaacgatgaattgtagcactccgtagcccgtaccactactcgattcaattgatggcaaaattccgcacgatcgatctcgttaattttcatttgtccttcttccatcattcatcagagaaaaaaaaatcatgtacagattcagttcgaatctctcacatgcactgcccattatcgtacaaatcatccacgcattacatcgatcgagatcacacgttgtgttgctcacatctctatcaacagttggaacacggaatcgtttgacaagaatttgctcaaaaaacaactcgaaattgattgaaatttatacaaactttgacggaaatcggcgagcgagcaagtgtttggtcgatcagtagtggcccctgtggaggtctaagccgacgagggagcggcagtagccgacggtggtggcggcggtgaggacggagctcgtcgtcgacccgcactcgctgtccttgagcgacgcgctcgatctgtccagctgcttcaccgaccatggatactgcccgtagctgtagaggtggtggtggtggtagccgtgcgccgccggaacgccgacgtgcgacgacgaacgctgcatcttgacgctcctcggcacgccgccgccgcggcggcggctgggctgccgctcgaagtgcggcg

SEQ ID NO: 28394 - DNA, 11038 bp, Oryza sativa
cgagcagcgcctgcatgcggcggagcgtggcggtggcctgcttcctcacgaggttgcctctgatcagcgcttgcagcttcacgagccccctcagcgcgcacagcgccttcctcgcctagcacattccacaaattctctcaaatttcgcccaaatttcgatcgaatgggtgcggaatgaattagtgctttttgagctcaccaggtagcctctgtaggtggcctggatcatgacggcggcgaccacctcgacggcgctcgccgacacgtcgtcaccctccgccgcggtcgccacggcggcgaccgccatggcgtgcttgctctgcccctcgagatcagcgacgtcgcgcgcccgctccgacaccgacgcgagcccggacacgctcggctccggcgtcgacggcgccgtgaccgcggccggcttccccatcgccgccgccgacgccgacgcagacgaccgccggaagctccaccgcttcttctccctggtactcgccgccgccacctccaccgccggcgtcgcgtcgccgccgccgtgctgctgcctctcccctgatctcctcccacccccatccttcttccccgccaagaagctcctcagccacctccccgccttccccatcgccaagagaaaacctcaccaagatcgctcgctcacacgacagcagcagaagcagggacgactatataagcgctcgccggcgagggagaagatgaccggcacaacacccaatcaccaaccaccacacagtacaaacgcttctcagtcaacacgagaggtgatcaatggcgagccgggccggcatgtgatgtgatgtgagcgaggagaggaggatcgggaggaaggaacgtggaggtggggatcctaaattcccgagctacgagctacgagtacgagctaaaagcttggctgtcagaatctttcgccattaaactacacatacaggacgagaagatggcggagagccggtgagagaagctagtgtgtgtactgacactgtgtgtgctcagctgagcttggggccatgctcgcttccaatcatggccatgctcgcgaggaagacgatggattggctgtctgtctgtccttgtggattgtgatctgtgtgagctgcagcctgtagcagcgtaaaaggcagcaatggtctgaatttttcttggatcagtcactaaccatatacatagcactatgatatatctgtctgctgttgatctttcttcaacaaacctctccattccatattataagatgttttgggttttttcataagttaaacttccacaaacctgattaaatttgtacaaaaatttagccacatttttaacatagaaaaaatatattacaaatagagatttaatggaggttttaaataaaaatttggtatttttaatatgttttcttatagagattttttattgttcttgaggttgtgcagtaccaaatcccgaccgttgatctagcatcatccaacagttagaaatcgtccgtacctcatggtattgcacctcctcatcgaagtgataccatgggtgggagggtatttctgtcatttcctgtttcacgagagggaaaaaatcgtcgggagggcagcgagaccgcgagaggcaggggcagccagatgcgcgacggcggcggcagtcgatgcgcaacggcggcggagggatgcgcgacggcggcgactggatgcatgacggcggtggcgggctcgatgcacgacggcgcggcggcctagatgcgaaacgtccctggccagcacagacgaccagcaagagaagagacatcttttttgtttgcccgatcatacccctgctaatccaacggttagattagattggtacctcgtatctcatggtatctcatggcacctcctcaaagatgaaaaagatgagatttgctctggtcaaaaaaaaaaacctcgaggtactggtaaaaggagtatttgactgacagatttagtcaaaccgaaagatcaaacttagaacatcttataatataaaatagaaggagtatttgacagacagagaccatgaataaaaccgtaaatctcgtgaaatttcctgaacatgaaataaatttgtctcataaaatcctgaacatgaaataaatttgtctcatagtttgtacctgtcatgttggcgaccattttatcctcacatttcccaattaaacatatctgctggcgaaaaccgagacatgtgaccgtgtctgcgtgagttaaataataagatgattgccctgtccttactgcatttttgtatgaaggaaaatgttattattttcgcaagtgaatcgttgtggatatctgcatgtttttgtatggatgcatgatctgtaaccaggggagttgagattactggttggcaaccacatggttggtctcctataatggtttctattctcctgtgacccttgtgtaacttgtgtgtcgggtcatcagagacaaacaacactagtgcaggtactaaacccaattactaacaggagagaataataacaaacaaaatcgtataccctagatagttacaagatatacttagtaaatattacctcttattttggatttcttacaaattacaatctacttagtcttttaagacttactttacatatagatttctcatataacttattgcaaaaaataaacctctagcctaatgcaaagtaattgacaccgatactcttaaaaccctgtggttattggcgccgacctccgatgaccaataaggaacaaaagtctccacctccatccctctctcaccacctccatttgatttggcatgaaatagaccaagtaattaatatatacctttttctcatcccctatattttttttcattgtactacatgatgtttgagctcagttcaaacgtacctcctgcacctctcttttcaaatccagttaattttggcataaacttttttttcaaaatgaaattgaccaagtaatacacctccttttttttcatttccatgtgactttttctatttctattggatgatggttgagatgggggatacaatctagcctatacggggtgtgaaggtcggcacagataacatcggcgttgagggtcaacgctaacgatattggtgataacaatctctatgtcattagccatggtggactctatgccacccgcgctatgtttcggcgccaacaacatccaagatgccaggtttggaatgagtttgatagaagatctatttataaaatatgtttttaaaaagcaccaaattgctaaaattccatatcctaattgctgttcaagaggcaagacatatagaatgatcatttcacccaatgtagctaattaatccacaaaggatatgattgatgtggtaattaattgaagtgccgtcgttgtaggcaggttttgcaatggacatagacgaaaccagtggcactgtcagtcgtacgtgctaaggagtgtcggcaactgaagatgaaccatcatcatgtacgtgccccaggctagctaataaaagagcagaaatgcagaattcagggatgaacagtgtgctgctacagctgcataataagtttgtcactgtcgtcgtcgatcggtcgcacagcagagttggttgtgttcaacgtgtgcatgctaagtatagggtgtgtttagttccttccaaagttggaagtttgggttaaaattgatacgatgtgactgaaaaattgtgtgtgtatgacagattgatgtgatggaaaaagttgaaagtttagatctaaacacagccatacattcaggcagctgtgtgtagaaagctgcagggaactgcaggaaccgccctgcccatgctgctggccacaaattggccccgttcttttctccaacaaaagttgtattaagattaagattttcgtggcatgctttttaaactaataaatggtacgtttcgtgcgaaaatttattttcccaacttacctaactcatcttcctcgtttttcccatgcatgtttttcaaactgctaaatggtctatttgttagcttatcagttacaattgaaacttcagtttgagggcttttttttggatcgaaggaatttttttcaaaaaatgaaggattttattccttggaaaatactttctatgagctccttggaatcaaagaaataagggtagcaaagtcctatggtatggtttcttatgccctcatttcataggaaaacaaacatgaggtctaatatcgtcttttcatttcctttgagaactccaatgcacttactctctttgggtctgtttggggagcttaagattctgataagcagctggttggtagcctgcttctgaaaatctggaaaaactgggtttcccagcttctgacttctagttcattttctagattctacaactacagcttctcacaatctggaccaatagctgtattgtttgtggggacttctaattttgggagaagctgcagcggcataagctccccaaacagaccatttatgtctatacacactctctctaattccttcaaaaatcttgtgttttatttcctgtgaaccaaaggcattgcttctgatatcttttgttctgaagttctgtaggattctactgtgtatgacatcctattttttacgtttttcatgttcccgcgttttcaaaatcctgtgttccaaaaagaacctttaagacttgagttcatttacaggtttttattttcagctctaacattcctaaaagtaatacagacattaacacttccattcatggatcaattttggttattttgttttgaatttctatggcttacctgccctaccccaactgatcagagccaagtagccggtggttttgttgctggcatgtggcgccactgtgtcatgtgcatgcattgcgcttgcgcataataaggagagaagaggaaggataattaagcttgggctgttgcagagcagctacagattattgcagaggtaaggtataatggtgtgcatgtacgtgtgcagacgatggttccaggaaaagactatgggtctatttggaggagattctggcagctgaagattttctaaaaactacccccaaacaatccaaattttcactcaaattataagaaaccgtaattatagaatcaaaagataaactaaaagttaaaagctgggtttcaagattctacaaattctaaacaatccaaattttcactcaaattataagaaactgtaattatagaatcaaaagataaactaaaagttaaaagctgggtttcaagattctacaaattcttactaactagcttctcgttggctgtttctcagaatttaagctcccaaacaagatcctatgaattggccggcggcacactgttgcattgcacagcatgacagcagcacaggtcgatctgatctgatctgcggcagggcatgcagctgccatgcctgaatgccaggcagatgcatgattggtctattgggaaatcatttttgtaacttcaatcggcaagtatgtgtatatgctcttgatgttttcgctttgatgtggggagaaagtagattcaatgtgagattttcaattgttttcgagaattcatatttggaatagtaaaatttgaccggagtttgattgaaacttgacggaaaatgttataccactaggctacttataaagtcatctcaaagaaaatagggaaaatgtccaagggggaaaaagagatatttgtgcaaagaaaaatatttttgcccgctctaaaacaaaacgggacacttacagtttgctctacaacaaatcggccactgccaaaacttaaattttaatactttgtttcgaagttgattttacggtactttcaacatgatttctttttcaacattatctttacaagttgctaaaaacacataaatgttttatatgtgaaataactcagtggcgaacaggtggcgacatgccgatggggagagcgggctggctgccagcggcacaaagcccatagaaatgtatgaaaaggaataagttcactttgagtcccctcatcttgtcgtcaagtttagatcacattcttaaaccgtaataccagatataacgtactatccattaacttacaaaaccaaaatacacaaggtcttgagatagtattgagaccggttttgagtggcgcggcactgaaagtcaacaaggaaataaaatatctggtattgtggttttcaagtacgtaggccctgtttctttcagcttgggattattataatctagattattgagtcagattactataagctagattgttataatctgtagtagaataagcggttagttgtttctttcctagattatcagagcctagattattgggtttgcaagtctaaagagggagtggggtggcatggtgggtaatttttcacccaataatctggaaaaagctcacctaaatgagcttatcagattataataagctgaaccccggattataataagctacttcaataaattgtctgtttctttcagtttactccaaataatctggattataataatcccaagctgaaagaaacatggccgtaatccaaactggacgccaatatgagaaacttaaagtgaacttattcctaattaaaaggcccacgctatacagcccacagaagtataatgagaaggcccacgctaaacagcccacgtaataaccgcacggtccacggatccgatccgagcacggcaacctgcctcctcttctctcgtctcctctcctcgactccaaagtccaaactctccaagcagcagcagcagcaatggaggacgacaagacgacccaagaatcatcggcggcggtggcgccgccgttgaggagcctcgcggactacgccgtcggccccatcccgaccctcttctacgtccccggcttcatctccgacgccgagcagtcccagcttctccaccatgtattcctccccggattgcttgctttttattttttgtgtgtgtctctgtgatcttgtggttttgatgcgtctggtgctcgcggggggatgcagatttaccaggcgccagcgcccaagtggaagtcactcaagaaccggaggctgcagaactggggtgcgtgttactctcttctctgaagtctgatccctcgcttggaagagcccctttttttcccctttccttttgctttgcaatgggcaaggttttgagtttttgactgaattcgatttgttggtttctgcaggaggagtggtgcatgagaaggggctcctgccgcaggcatgtgagtatatagcaatcaaagcttgcaaattttagctcaactttgtggtttatctagtgtgattagacaggatattgcatgattgaagtgatatgaatttcgtggttttgttttatgtgattagacaagaagatattgcataacttaaagtgatccccttttaagttattgaccttttgattcattatctaaaaagatcttcttgttcaaactgtaagcattaacagcttgtctatattaagggcttggatgccacaaggtttcttgtctgaacactgcataaacagaactaaaatttgggtctccctctgtaatctgctcaaatgaagttccttaggtgattgagaattaactcctagaataaagcttaacaatcaccggggttgccgtgtaaaaccgtttcaaacagcatcaagctctttcttggccagcagagtagtttacagtaacaatgtcatgaacatctattggctagtttggcacaactcaagatttcccaaattaccttacttaagggcttcaatttacagcccctctgactggatccaacttatttgaggcttctagtgcaatgaggatttaggcttaaatgtaaggccttagaaaccttcacctttggcctagcttatctttaaaaaatgcataaactgaagcagtagttcaagctagtccaaaaaggttccctaaatgactatatttcttattttgtggactgcaattattttctggtattccatacttatttgaaaaacagtgatacttggatgattacaagtatgctcacattttactttttgaaatatgcaacattttattattgaagtatcaatctatatatcagtgaaattaaactgaatgtgcatctcatactgcagtaccttcatggctaacaaagataaccgaccgaatctgccaatggactggtttatttccttcagcaatcaatcatgttttaattaatgagtatcatccaaatcaagggatcatggtttgtagtttccagctccttattgttttttcccctggcttcatattattttttgccgtacactgaactacaagtaacattgcacatttcagccacaccaagatggtcctgcctacttccctgttgttgctataatttctcttgcttcaccggttgtgattgactttacccctcatcaaaggcttaaaggggaggactttacagatccccaaaatgcacactctggagagtcgcaggcaactacaacagagagcaatggttcccataatcttgaaggtgcaaatgaaactgaccctgcttcttcatcacttcttctgatgccgtgcagcctgctgatattcaaagatcaggcttatacaggttagatgagtacatttcttttctgctcatctaggcacatttgaaaacttttttatttttgatatttgatgagttttgcagactacctgcatggaatacaagataatgagctacaaaacctagacaaggtgccacagtttcaaactctgtaaatcacttgtacatttatttgacaaacatttgagcaaatcccgtacatagaaaacctaatacttttgtctcattggcaggtcgccaatatgttacagtgcccagaattcaagcatctaaattctggtgatgggcaggggaacacagatgagtcttgcagccttgagcaaagtggcgtctaccgtaggactgcgaggagagtctcgctaacgtgtcggctggtgttgaaagttcacaagaagctgttcaaaatgtagtctattcctgttggttgggttaacaagaaacagtgtagagtatattctaagagtaacctgtgacattatgctggtaccgaagactactgactggtgtacaaggccttgatctgcaagctggaacagcatgatttgtctaaattctgaaagaaagaaaaaactgtagttgtttggactaatgggcaatatgctgctgcatggaagagggccctgactcctcaatagtgtttagttttgagacattactgtgcttttaatgcccgtaggaattcaatggcatatggcattgtactattgtgttttttcagttttaactgctcatcctatattcggaaggagcccacactttcagttttaactgctcatcctatattatgctgttgggatcgtacagaattttgacaaaatcagtttaatttcttcagtaaccagacaaattctcgcggtatgtgtttgaaatcacttgagaacctaattgaattggaccatttctccctgtagtgcgtccaaaagagaaggttctgaaagatccaaaggagatcaccagtttgaggtgaagaaacccaagacccctaacctcgtttgaaccgatcaaatccacttgctccctctgtctcagattatagatcattgtttcagattatagatcattttgattttgattaaagttaaactactataaatttaaccaaatttatagataaatatactaatatctacaacaccaaattagttttattaaattatagatttaatatatttttataatatatctgtcttatgttaaatatattactatatttttttataaatttggttcaacttgaagcagtgagactttgaccaaaatcaaaaataactgtaatctgaaacggggtagtacataataacacctacacgcatcccatctttccctgatcgatccatccaaccaaccatggccgccgccggcggttgcttgcttcttctgctgctcggtgtggtcgccaccgtcgccgccggtgagtgcaacgacgacgaagaacttgcacgccggcgtaagtacacatgtcgctgcagagacatatatgatgatcgtgaacgtgcaggtgcaggtccggcgtgcgagacggcgaggtgcggcaaggggcactgcgtggaggagccggggccgttggggctggacgcctaccgctgcgactgcgacgccggctggtccaacatgttgaagctcatcccggcctcgccgtgcaccatcccaaactctacacccatatatatgccttctcacttcacagcagttcatatatatactccctcaatttcatagtactattataagctgttttaactttctttttaataaatttgttttaagtttatttaaacttataggaaaaacaaacatattgttaaattatatttaatgcgagatttaataaaattaatctggtgttttagatgttgtaaaacttaataaagttttcttgtgtggaaataaaactttattaagttataatgctagatttcacttttttttagtatccaaactttattaagtttaatcaagcttaatttaggagcgatggatttaacaagcctcgcaggcaccgttgacagcgcgtgcttcaacaccagcatctctctgcccaacagcccaagggcggcatcccgctcactgacagtatgtaagctgatccatgatcatatgacggattgtttcagtttttctgtaccatttctgccgatagtattttactacaagtattattgttgttatctcaaatattgatttatgagttccactgccagttagaaaaaagatattcgctccggtccaacaaaaagtacctcgaaatatcaatacctcacgtaccaaatcgttttcgatcgttggaggtaccgtgaggtactgatatttcgaggtactttttgttggaccagagcaaatctcgagaaaaaaattccactatcagcaattgatgtgttagtataaataatacgatttatcggatcagaaaaaaaacaaacaatctggattgcttctactgccattacatagcagtgttttgcataaacatttttttttatattgcagcttgc

SEQ ID NO: 28395 - DNA, 223 bp, Oryza sativa
ggttccctaaaccggggattcaccgaaacaaacaaccagcaaacagcttttaaagggaagggagatagactgtgccttctttcatttattttttcttttctgcaaggtagggagggggccttgagagttcctcttgtggtagcaagttacttcgcaacctgctcaatttggccttatagggtcgggaactaatgaataaaaagggttggataccgcccaacca

SEQ ID NO: 28396 - DNA, 736 bp, Oryza sativa
gatctctccgatctcgatctctctccgtcgccttcgacgccgccgccttcgacgccgcgcaacgccgccgccgcatgccaacgccacgccgccgccgccgtcgccacgccgccgccgccttcgccgccgcgcgcgcaatgccgccgccgccacgccacgccgccgccgccacgccacgccacgccacgccaccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatacatgtatatatatatacatgtatatatatatatatatatacatgtatatatatatatatatatacatgtatatatatatatatatatacatgtatatatatatatatatacatgtatatatatgttacttcgcatttatcctaatacattttttttatcttgcagaaaagacgtgttgtcggagtcgtccgtcaagcctgagtggaagagctagccctagaaggaattggagaaggcaagtgacgtaataatata

SEQ ID NO: 28397 - DNA, 623 bp, Oryza sativa
tgaccaacctgctaaacttcatgaaatctctctcattctgggctgggtcttcaacgtcacgtaacatgtcttgtagcagatcgtgatccacatttcaccgcccaatggagaaggtataaacatgtcatgctcatcttcatcttcctgattatgcgcaccacttctgtctgttgctgcaccacttcctgattcttgctctccatgcttcacccaacatgtatagtccttcatgaatcctcgttgtatcagatgatcgtgtacaacctcttcgctatcaaacatattctcattcttgcaatctgcacatggacaacgcatgtaatcattgtttcttcttttcctatcctcctctgcggcgttcataaattttattacgccatttctgtactccggaaaatgacgtttcacagttgtcgcatacatccaacttcgatccattgctacaaaataaaaaaataaattagaggcacatattataatatcagtattgctaaagtaagttatgatgaaattgctgaattcatcattagtattactcacttgagtgctccattttgatcacttttggtaatgttctgttttccttggaaaaaagacaaaaaatcgccctctatagcctccca

SEQ ID NO: 28398 - DNA, 4739 bp, Oryza sativa
  unsure (1)..(4739): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttcttaacagcatatgtatctaagaaacttaaaacttctttaaatttcagtaagcatgtgcattcaaacttataaaatcttgttcaattataatataaaatcagatttttttttaaaaaaaagacgatcagacaagcgcatgcttatatgcttgattcgattttacaactttcacaaacaacagagagacaaccagagggtttctaatcagcaagtggtgcaaataagattgtacatagtgcaaacaataggggcgttaattttatgtcatgaaagtaatcaatgaatcaacttctctatcgacagggagatacagttaagaaaatcagaagataacacctcttctcaaccaatcataacattgcatggcccacctaccttcacttttcctccaaccataacactccctcatttaattgtattaattttcttaataaccgtgtccaacttaattaattaacctgaatgttacaaactatcgataaattaaaacaactaggaaggtagcccgcgcgatgcgcgggtatatgtattagtttgttaaaaatcggtctaacaaattaatttcaaattaaaagtcagatgtttttcatccgactttttctttcagtgagccaagtcaaatgatgtggtgtttttttttcaatttgagttagaatcacgcgtgctctctctcatgaacagaacatatacgtggagtatgtgcggctgaatcatggatggcatcatcaagcaatggtggacggaatcatcttgaagtttttaagtaggttaagattaagattagatctaatgattgaaaatattggaaaagcggtggttagatttttttaatataatttctgtgaattttacacgtgatcataattaaacgtgattataattacatgtcggtttaggggcattggtatgattgccacgtgatgattttaggggcatttaaaggatctaaatttaatatttgtttaatatggggcttaaaaatttgatcttaaacatttatattagaagtttgagctatgtatatggatctcgaattatgtatttaattataaatgacacaataattcaaaaaattgagaaaaaatgtaacttgatatttataatcatttagaaatctgattattagtttttgatagattgagtgttaacttaaaaaatagcaattagcttaagaaataggagagaagaggagagttaggagggtggagggagaactcaactacgtaggtgcgcacgtatggaggtggcggtgaggatgcaggtattagattttctttttagatgaagatctaatggttaagattaatgggtccatcaatttttaaaagaataatcgctaaacatttattagaatttttgtgattttttattaatctattagctagaaaattaaaagaaggaaggaaggaaagaagcaggatgtacgtaccgtgagaggaggcccgggaggaagggggcagtggagatgggttttggatttttttttaaagatagatctaatggtgtataatatttggtccatcgtattaagtgaaaatcgagggccagatgttttttttcctcataattttttttatttctctaatttattaaagcgtcatgtgaaagttaggagtgtttatagaaaatttaatggactttagctaaataataggaaggggaagaggagaggagaaccctgagcttttcggagaggaagggtcgatcgatttaaataaaaccgatgatcatatgtatttttttccctcaaaaataggtttttttaaaaaaaaattattagatgtgaaatgtgaagacatagaggtgttgtaatggacatctcatagatgatgatacgatatatgttgtcaatttttatataacgtttcattgctgtttagttatcacggaaaggatatggattcatgtctaaaattatatttatcatatatcaagaaaggcctatatggatcaaactaaaaactgaatatatttaaaaatataatcatttagctatctattatttatatataatcatttgtactatctgacgattggccaccagctatgcctgtaacaaaggaactcacatcccgtaactatatctcaaacggcttttttttgacccattagatatgagatcattgcagatgacccatcggatgcctagttctatataaaaccatattaaatagagtgaatataggacttagctcattgattaatttaattaaaaaatacaatcattcaagcgtattgtaaaatcaatgtatatattgtccgtaaaaaaaaaatattagtgcttgaacgttgcacagacagctcgatgctccatgcaaggaaagatataactatttacaataataagttatggtgcatatctcataataactaccttaattagaaaaagaagaaaaaataaagagaaaatgaggggaggataggcgcatgtacatataggtaagagggattttattttgatatgatgttttaaattactggtgactattctaaatgaaaatcaatagtttgatatttttttctcataatttctataatttattagagcgtcacatggcggctttagagcatttgtaggagtgccacgtagcggcttagaagcgtttatagaaagtttaatcgacttttagtatacaatagatagatagattttttttcaatgatactacgtaggtatgcttttttttcccctttactttatcgcttttatcacataagtctgtgcttatgtttttcttctcgtccgatgaacagtaggtaattaagcttcatcgtttttctttcaaatgtacgtaacgtacagaatacttttttttcccttttccggcccacaggaggaaagcggaggaaagcattaccttttttaaataatacattaaatctaatggtctaaaatacagggttcaccaatttaagtgaaaatcgatggtgagattaaacagtgccatgtggcgatctaggagtgtttctaggaacgccacgtggcggcttaggagcgtttgtagggagtttaatggacttttagtatataatagtatataatagatagatagatagatagattggaattctcatcacatatgcagagttaataaaaaaaattatttctacatgcttccactgtatagtaaatagattttaaattaaatttattcagatgctatgtggaaagaaatttacaaattgtatactaatcaagttatgtgaagaccttacgatttacaatgtgaacatgctacaatgagcacaccactgttggctgtcagatgaacaacattggtataaaatttgtactttggaaatggtttcattggccttgaatgatctgattgggcaagcaaatgcctcaactctttttgctatagctaatcctatcttgccaacccgaagtgtaaaatccaaggtgtttttaattattattctgtgatgaacaattgggtattggagattattggttttgttatttggaatttattcacgaagtggttttggagatgattggaatttacaggtgaatctacaggatattgctattatttcatgtgaccggtcagaccgggcagtgtgtgccggtcagaccggcggtgatcgcgcggtcggactggccagcccgcggtcttaccggccgacgctgtgtcggtttcggttttgggttgtttgtttagatatctgtgattatttcatgattatgacttctagatggatactatatgtatgtaatactgttgtttgctactaatgagtcaagttggagatagcttctcggaatatggtttctttgtttatttcatgtgtaggtgactcgatgtctcgggagggtatttgcggtgatggaccgggagtcggcttggggataagacgacgtccatggtggtcagagatcatacgggatactaaggctagagttgatgcacatggttaatggagattccatatggcatacgatggaggtattgtgtgcgtatgggatgcggagtcaaatttggaaggagtccaaatttggtacgattggttatgtaaagtttctttcttgtactagagggtttcctaaggtgtttaggactcttagtatgagtttggtttgtggctttaggcttcctacatcgggtataaatatagggggagcgtgaggcttcccggtatcgcttttgagagcaattgagttgagttttgagtttcgagtttagtcgaaatttttgtaaggagtgctgttggtgcactttgtaaacacagagagaatcaataaagtcgtcatccacttgaagagttcttcgatctgtgtttcaccgggtttcggcggtgtaaccggcgatatactggcagtcagactggcggcaagcggcggtcagaacggcggcatacgggcggtccgaccggcggcggtgacaggcgcggcaagcatctcggtggttcgaccgatcgatctacatcactcagaccggcggcatccactcggtcagaccggcagattaatctcggtcagaccgcgatccgttgaattcgagggtaacttttatttccgttaaaagttttcggtttttgggtataccaaccattcacccccctctggttgacttagttattgtgattcgatcctacaagtggtatcagagccttgttt

SEQ ID NO: 28399 - DNA, 4216 bp, Oryza sativa
  unsure (1)..(4216): unsure at all n locations
cgatttagagcttctttggatttttatcgatctatagtttttgccatggctactcctgttaggttttcaactaagcctcatattttcgatggaacggatttttctcattggtgtagtaggatgcaatcttacattatggctgaagatcatgatatttggagaaaagtttctcatacttatgtgattcctgaagctattaatgctgctgctgaaaaaactgcttttgaacaaaattgcaaagctcgcaatattcttttgagtggtatttctcgttcggattatgatcgtgttgcgcattttcgaactgctcatgaaatttagaatgctttgagtaactttcatcaaggaacaaataacattaaagaacttcgtcgtgatattttcaaaaaggagtatattaaatttgagatgaaacctagagaagctttggatgactatctttctaggtttaataaaatttttagtgatcttagatctgttgattcttctcatgatgctaattatccacaatctgagatttctcgtcattttttgaatggtcttaatatgtctatttgggagatgaaagttacatctattcaggagtctgttgacatgtctactttgactttggattcactttatacaaaattgaaaacacatgagatgaatgttccttctcggaaagttgattttaagtcaagtgctttggtttcttcttcttcttctttggatgttgatgcctcttcatctaagccttcttttcttgctgtttttaatgccacatccgataatcaactcgaacaaatcgaggaggaggatttggcttttgttgctaacagaattgctcgagctatgaataatgccaagaataggaaaagaggtggtccaaatcgttgctttgaatgtggttcaattgatcatcttcgttcgcattgtcctaagcttgggagaggcaaaagagaagacaaagatggtgagaagaccaacaacaacaagccaaagggttcatcccaagggaggaagctggagaatctcaggaaggcttttcaacaagtttgcgccgccttcgagccactaagtgatgtagatggtgaaagtggagatgatgataagagaaagaacatctccgatgtttgcttcatggcacgtgttgaatctgacacagagtattaagataatgaggtagtgcttttgaggaagctattaatattttgagtgaaaaatataagaagtgtgagtagatgtatagaaaacaggaatttatcattgaatctcttaaatctgaaattgctagattaaaatatcttattcctaatgatgatgattgctcaaattgtgaggttttaatgaatgagatttcaaaaattagagatgttaatgctgcacatgatttaaatctgctggtatcatgtctaccttgaatgcatcttcttcaaaatccaatattgtgcatgcaaaacctcctgttgttgcttgtgttgctaaatcttctaatgctaccaatgtgtctaatcatcgtgaaaaatatacttgttctttttgtggcaaagatggacatattgttggtttttgtttcagattagctcataaatagaaaaaggagagagagagattgcttttacaaaatcaaagtggcaaaaattgggttttccctcgaggaaaccggttagaccgcagtgggtcccgcggtcagaccggctactgagcatcggtcagaacgggcaccggtcagaccggcggtacagaggcggtcagaccggcccccggtcagaccggccattgtacctcggtcagaccggcctcggaggaatttttctgaaaattctaaaattgattttgcacgtggatatatgcctattggatcttctggtcgtgtgtctcagtactggattcctaaatttttattatgcttgtgtgtaggctttggtgtcaaggaaggagaacgtgtggatcgtggattctggttgttcgtggcacatgaccggtgataaaaattggttctcctcactcaaaaaggcatccaagactgaatcgattatttttggtgatgcttctgcaagtgccgttctcgctacaggtttggttaaggtaaatgaaaattttgaattgaagaatgtagctttggttgaggacttaaagtacaattttctttcggtttcacaaattgttgatgaaaattntgaggttcactttaagaaaactggaagtaaagtttttgattcgtatggtgattctgtgttgaatatttctcgcttgctgattttgaaaatcctgtttcacctgtgataacatgtttggttgctaagtttgataaagatgagatgttttggcatcgtagacttggatatgttggttttgatcatctcactaggttaagtggtttggatcttgttcgtggtttgcctaaacttaagaaagatcttgatttggtttgtacaccgtgtcgtcatgctaagatggtttcttcttcacatgctcctattgtttctgtgatgacggatgcaccgggacagctattacacatggacactgttggtccagctagagtgcaatctgttggaggaaagtggtatgtgttggttattgttgacgatttttctcgatattcttgggttttctttatggcaactaaggacgaagtttttcaacactttcgtggtttgtttctgcaattggatcttgaatttcctggttctttgaaaagaattcgaagtgataatggtggtgagtttaaaaatgcctcatttgaacaattttgcaacgaaagaggtattgaacatgaattttcttctcctcgtgtttctcaacaaaacggtgttgttgaaaggaaaaatcgtgttttggttgagatggctagaacaatgttggatgaatataaaactcctagaaaattttgggctgaggctattaacactgcttgttatatttcaaatcgagttttcttgagatctaaacttggaaaaacttcttatgaacttcgatttggacatcaacccaaagtttcacatttgcgtgtttttggttgtaagtgctttgtcttgaaatctggaaatttggataagtttgaggcacgttctaccgatggattgtttcttggttaccccgcacatacttgttgctatcgtgtacttattttggaaactaacaaaatcgttgagacttgcgaagtttcttttaatgaggctagtccaggtactagacccgatattgcaggtacactatcacaggttcagggggaggatggtcgtatttttgaagacgagagcgacgacaacgacgacgacgaggtcggttcggccggtcagaccggcacaggaggtgcggttagaccggccagggtcgtcggctgagggttctgttaatgctgttcgagatggtcctctggagactacaacttcgaccagtactgatacagaacgtggatcaacttcaaaagtcgctgctcctttgcacattcaacgacgacatccgccggaacaaattattggtaatatagattttgctgagactatgcgcagggaatttgagatgagcatgatgggtgagttatcgtactttttgggattgcaaattaagcaaatacctcaaggtacttttgtgcatcaaacgaagtatacgaaggatcttttgagacggttcaagatggagaattgtaagccaatttcaacaccaattggttctacagctgtgttggatcctgatgaagatggtgaagctgttgatcaaaaagagtatagaagtatgattggatctttgttgtatctaactgcttctaggccagacatacaatttgctgtgtgtttgtgtgcacgctttcaagcttctcctcgtgcttcacatcgtcaagcggtcaagcgaataatgaggtatttgaatcatacacttgagtttggaatttggtattttacttcatcttctatatgcttaagtggatattccgatgctgattttggaggttgtagaattgataggaaaagtactagtggaacatgtcattttcttggtacattattgattgcatggtcttctaggaaacaatctagtgttgctcaatcaactgctgaatctgaatatgttgctgctgctagttgttgttcatagattctttggcttttatctactttgaaagattatggtcttacttttgagaaagtacctctcttttgtgataatactagtgcgatcaatatttctagaaatctcgttccacactcacgcacaaagcacagtgata

SEQ ID NO: 28400 - DNA, 12178 bp, Oryza sativa
gcaaattgttgatattttcactaaatctttggattctaatcgctttgcttttcttcgtggtgaattgggcataattcatccttttggcatggtttgagggggagtttgtacctcatggttttatcaagcaataatatgacaatgagaaaaattgagaaaagagagctttatttatgcatatggtattttcttgtgcatgctagcaatactttgaaggtttatttgtctctagcatagcttgtatgtattctagtcttttcatgagatctagattttgcttttaagtgagatgatgcatgacacttaaattctatacttgaattaagaaaatatgcaatgtcgatgctagcatatggtttgatctataaatgctctatatatatgctttattgacttgttattcctcaaatagctttaattgctcattgtgaaaaagagaataaaaaatatgaaaaaaatgaatatcgaatccttggaaacagtcttgacgacaaggacgtattcaatatgagcaaaataattggtgccgaatccctggaaacagtcttgacgacagggacgtacccggaataaaagagaaaaatatgagcaaaaaggctcaagaaaagaaaaagttaaaaaattctcttggttattatgtgctaaagtttatttgagaaagagtgataaatgcaataggtatatgtgtttagtgtttattcttcaacctatgtgcttgttaagatgttccattataaatcgtatgaaatcatgaattttgattgttgattcaggcttaattgtaaaatctttggttcatggttatactttaatgcatgcttgttatattatagataggtttatcttctttttattgcaacacatgacttgatatgctatatgtatgctaagctcttgaacattaatgaacataattcctatgcttgatgaaatcattgtcaaaatggggagaagtaatgtgaaattttttggacttttgggagaagcaagatgaatttttggagttgatgagaagagcatgttgtttttgggttcaattgggaatttctttcttttaaaaagggggagaagttttcttttggatttttgagcacgatgtgtatgtttgtacgaagtatgctttttaccacttttgtttttatttttccaaacaccaaaatatttttatgagtttgccaatgtgttcatcaacggggagattgtaaaatcaaaggtgtttttgattattattctgtgatgaacaattgggtattggagattattggttttgttatttggaatttattcacgaagtggttttggagatgattggaatttacaggtgaatttataggataatgctgttatttcatgtgaccggtcagaccgggcagtgtgtgccggttagaccggcggtgatcgcgtggtcggaccggccagctcgcggtcttaccggccgacgctgtgtcggttttggtttcgggttgtttgtttggatatccgtgattatttcatgattatgacttctagatggatactatacgtatgtaatactgttgtttgctactaatgagtcaagttggagatagtttggtctcggaatatggtttctttgtttatttcatgtgtaggtgactcgatgtctcgggagagtatttgcggtgatggaccaggagtcggcttggggataagacgacgtccgtggtggtcagagatcatgcgggatactaaggctagagttgatgcacgtggttgatggagattccatatggcatacgatggaggtattttgtacgtatgggatgcggagtcgaatttggaaggagtccaaatttggtacgattggttatgtaaagtttctttcttgtatcctgaggtgtttaggactcttagtatgagtttcgttcatggctttaggctacctatctcgggtataaatagaggtggagcgtgaggcttcccggtatcgcttttgagagaaattgagttgagttttgagtttcgagtttagtcaaaatttttgtaaggagtgctgttggtgcactttgtaaacacagagagaatcaataaagtcgttatccactttaagagttcttcgatttgtgtttcaccgggttttggcggtctaaccagcgatataccggcggtcagactggcggcaagcggcaatcagaccggcggcatacgggcggtctgactggcggcggcgacaggcgcggcaggcatctcggtggttcgaccgatcgatctacatcagtcagaccggcgaaatccacttggtcagaccggcagattaatctcggtcagaccgcgatccgtcgaattcgagggtaacttttatttccgctaaaagttttcggtttttgggtataccaaccattcaccccttctctggttggcttagttattgtgattcgatcctacaccaagaagatgtaaatccagtacgaacccaacaatagatacaaaggaaaaatctgtacagcaaaacttctgactttttggaagatacaaaggaaaatataaactcagtacaacctcaataattgatcatatgttagctcttgaaaagtacaagtacaaggaaaatcagaggaataaaaaccctcttggaattcagaagttatactcatatatcctgtaaaatcaaagtgttttttgattcttattctgtaataaacaattggcatctatgattattggttttgatatttggagattattggtgaagtggttttggagatgattggttttgcaggtgaataggaactgctgctggagttttgattcggtcagaccgggcaagggttgccggtcagaccgtgttaacgaccaaatttggtaatccaaggattggagatgaagaagaaattgagatggagttcaagatggagatcgtcccggaaacagagtaaagatcggctggaatccgaatcggctgcgaccgggatcggcagagttcgagttggacagggttagccgatcgagccgaatctgacaatatgacaaggcatatgttgtcgggttaggttgatgtacttcatgatgattgccacgcatggatagagtcctgagaaggcaattgtatctattaattaggatattttatgtaatttccatagagatatgtttgggcaaaagtctgccgcaaagacttatggtatcttagagtttgttagagataagagtcgtgtccgatatggacataatttataatctcgggtataaatagactccgagccccatgtaatcaaactaacacatgctcaatacaatcttggcgcatcgccacctttttactttcattttgtttcgacgagttcttgctttcgggttgagctgcatcggtttcgatcttcaacaagaggtaaaacttgttatggctgcttgcgttctcgggattagtgcttccatctttatgatactctaatcttgtttatgtaattcgtcgagttatcatatatcttatataatctttggcaatatcgctatctaacctttaatcggctaacatctgttgctagaaggcagccgattaggttatatatcgacgttgatttagattatataggatatccaccactctatgaaacatccaacggcttgattgtctagatattgtccttttcatatttatagctgcatcagttgagtttgatcttatgagtcgtgattagaatctcaatctctagcctgtctttggttgccgattagggtagtatcggggtttcagccgatattacctgatttaactacatttatcttatatgcttgattgacatgttaaatcttccctttatgttaagatcttgtcgcatttaagtatattgggcttttgtttggtatattctacttgctttaatatcttaatatagagtagtatcggagtattaacgatacatgctagatctatctgatcggctatgctatgaacatatatagtcttgttgttactatatatttcgatctaagtgatttatattgtctcggcatggtgaccgatctatcccaattacttgatttaagtatatatcgacataaggattacatattgttaatatctacagccaaccgaatagatttagttctttcttacttattcatgattgccgatcgatccacatatgacataggctcaaagataaatgatatgtcatcagcaactagctgatcggctatggtttatggatttaaccacggtttctttgtctttgtttcttgttgattgcaggatcaaatcaactggcacgctcgtacagccagaggcaagttttggacctgcactggagttaagcagatctcacaggcctcgtgtttttacatcaatagaccggcgctatgcgagcagtcagaccggccagccgtggtctgaccggccgattttgtgtcggtttcggtttcgggttgtttgattggatatccgtgattaatatgtgtttatggcttctagatggatactatatgtatgtaatactgttgtttgctaacaatgagtcaagttggagatagcttggtcttggaatatggtttctttatttgattcatgtgtagatgtcttgacgactcacgagagtattgctagtgatggatcgggagtcgacttggagataaggcaatgttcggaggtcagatatcatgcgggatacttaggctaatcttctccgtacgtgtggaatttttaatcttcttccttcttgagcattggcctgtagcatttggtagttgaaaacacaatctgaaaacaagtgaccatgattttccttttttgttgagtgacttgagcattggcctgtcgcatttggtttgagtgattttcgctgatgtggtttctgatctcatagatgggattgcattttgggggaggaggaacaggggcaatgaggaatccgacgacgtctcctccaacaatgaggatcatgaatccaaagctacggtgaggaacacctgcaaactaatgggatctttcagtttatgagtcatttagttgcaagcaatgactttggtggttaggaatgaggacatatggcaacgtgtttgcttcagagtaaataacttttgcttcctcaccggcaaacaactctggtatttgttcacgttatctccgtttccattgttttgtattgctctgtgggctcttgggggctggggcatggcctctggagtggttgcacggactatggtaattagaaaggcatttatagatataagatcgtttatttctacgcaacattccaacttaagaagtaagtactatggttgtgtcagtttgacttggccagctggaaggaaatagtcatattttgtaagagtgatacaaatgttattgtggcaattttttttggctccgaatgttttctcattatagattgtagaaactttgtttataacaaaatatgcctgctttctgttcgatgaaataactaactgtgcttggcaagcttataacctatgtttgtgtatgggtttaatttgtcctagagcagagctgctggatcgtgcagttcaccctggtaaatatgaaactttatttgcagatgtatttactctatgaacattgttaaagatttatctcaattatatataacaagctgctttcaattttatcatgagttacaaggttaacgtgctgggatattttttttcaaactacaggtcagcatgtctcagcagatgcaaagacaatggaatatatttatttggtcagtgttaagttcccttcacattcattatgcataagttaaaggttttgatagagtttttgtttgtttgtcaaatcctgttcactgagcaagaagaatagtagcgtttattcagtgccatgcaccaaaatgtagatttagctctattagttatttggctgttcttttgacctttcatcacgctttagttctcccatggctttgtagcatagttattaaaactggaccggaccggcgttcggaccggaaaaaaccggaacctctgccgggggaccgacggtcggaccagaaaaaaccggaacctccaccggtttggttcagttaaaagaccggatatgcaatcaagcccgtataaaccggttagaccggccggttttcatgaaaaaccgctatagaaccggagaaaaaaccatggttgaaccggcctctgcctgctatgtgcgcgggagtaggtgagcagtggggggaaaatgatggaaaaataggctttgggggtattcgaacacaggacctcgcgggagaaaggaagtgcagctaccatgtgttagaatgaaatgggtaatatatttaataactattgaaccgggttagaccactggttcaaccgattgaaccactgaaccatcgaaccaatagcctcactggttcaattactggtccggtctcaataactatgttttgtagcattaacattttgaaactacctatattttagtccaattcactatatcatggggcagcgttgaggaaaacaacagcaggtacattgatttctgcccatgctccccgactgcttcataaaatgattcaatttactgctacttactcattggtacttgtaatactgcaatgaaagaccaagaatcctgatcgtttttattttctgatacagtttaaatgatttctactaaattccatgtgttccttttgatactggattgacactatttcttttaactcagatccatggaaaggcagctagaaggtctatgacccttgtgtggcctatgagcacctttccgtggcttttttttaatattagaattgtacaaaccaaaatgaatgttctttttatctatactaattcgagtgtaccatttagtcaaaatgttatcactatagtactctctggttgccgttgtattcatcatattgtagtatcgaaattcttagtggtctcgaggggcataatatttgtggaatgtgaactcttcacaagacaatggaaacagtatttgttcatcccagttcgcactctggtaggtgttcacactaactcgatcaaacgaatgtattagtactacaacaaattagcttttcaatctctggatgttgctagggctgtagcctagacaggttcaaatataactagggctgtattttaaattatgtataaaaagatcagattgtatgaagatagccaccgtgctattattaaagatgtcaattcaaatataatttctctggaatttttactatgctgaatgaattatttggaattagatccagagtcttggagcaagaagcacaaggttttcttctccagcagtgcactccatcttatattggcactctaggaatacactgtgctgttttttttatagacctatacaaattgtcatcctaccatggtctatgaaactctatttttatctgtataatttgtatggagtgcactgcatagaaaatatctcatttattgttctattttcatatatatatatatatgtatatatattgcgaaaacgtgccttgcacgtgcacgataactagtatcctgtaaaataaaagtgttttttgattcttattctgtgatgaacaattgacatctatgattattggttttgatatttggagattattggtgaagtggttttggagttgattgattttgcaggtgaataggaactgatgctggagttttggtccggtcagaccgggtaagggttgccggtcaaaccggcgctatgcgagcggtcagaccggccagcccgcggtctaaccggccgattctgtgtcggtttcggtttcgggttgtttgattggatatctgtgattaatatgtgtttatggcttctagatggatactatacgtatgtaatattgttgtttgctaacaatgagtcaagttggagatagcttggtctcgaaatatggtttctttgtttgattcatgtgtaggtgtcttgatgcctcgcgatagtattgccggtgatggatcgggagtcgacttggaggaaatttgatgtccggacgatcagatatcatgcgggatacttaggctaatctactccgtacgtgtggaaattttaatcttcttccttcttgagcattggcctgtagcatttggtagttgaaaacacgatctgaaaataaatgaccatgattttccttttttgttgagtgacttgagcattggcctgtagcatttggtttgagtgattttgacttatgtggtttctgatctcatagatgggattgcattttgggggaggaggaacagcggcaatgaggaatccgacgacgtctcctccaacaatgaggaccattcaccctcccctctggttggcttagttcttgctatttgattctacaagtggtatcagagccttgttttcttctttggattttaaccgatatagagctttagccatagctaacaagtttactactacgccccatgttttcgatggttcggattttgcttattgatgtgataagatgcaatcatacattatggctgaggattatgatgtttggaaaaaagttgcacagccatatgtgattcctgaacagattgacactattgctttgaaaacttattttaataacaattgcaaagctcgcaatattcttttgagtgaaattttttgtacggatttttatcgtgtttcgcatcttaaaactgccaatgaaatttggagtgctttgaaaaactttcgtcaaggaactaccaacattaaagaacttcgtcgagatcttttcaaaaaggagtacataaaatgtgagatgaaacctggagaagctttggatgattatcttggtagatttaataagattttgagtgatctttgatatgttgattttgcttaggatattaactatacacaatctgaggattttcgccactttttgaatggtcttgatatgtctatttgggagataaaagtcacatctattcaagagtctgttgatatgtctactttgactttggattcgctttacacaaactcaaaacacatgagatgaatattctttctcataaagttgattctaagtctagcgctttggtttcttcatcgacttctttggatgtaggtgcttcttcatcaaattctattgtccttgctttgattcatgccatgtccgatgagcaactcgaacagttcgaggacgaggacttggctttggctgctaataagatttctcaagctatgaacaatgttaggtacaggaaaaaatatggtccagctcattgctttgaatgtggtggtcttgatcacattcattcgcattgtcctaagcttgggagaggcaagaaggaagacaatggtgaagagaagaccaaggacaacaaacccaagagcatgtttgttggtatttcttacgaccacagataaatccgcaagcgcacggaatactgctgtagcgcttaaccttcgggtgaccccaaaaggacatcgaactcaaggaacgtgtgtaatctacctaaggttaagactatccaaggacaacaactgatggtaggcaggctaggctagagaggactttctatgtgttttaattatctaagctaagttaacggtaatttcctctctgttgcttcaggcaccgacccctgctggtctgctagcgtggttccggctataggtctatgatatatccgaacgtggaggattactaggacgggattcagggctgtcaccacctgccgtctacctctgacaaatccgtgggatacacaacaaacaaaggtaatctctaacctagacaccacatctaagttattaattactactctaatacttgtacaggaacttccttctctatccggagtcctagtactagagcacttagtatgaatactaaacaatgaacccgcaaagatagaaatatatcttactcagactaagtaattaaataacataagaaaggagcagagtgtaccgacagctctgctactcctccagaattcctgctaggaagctacactcatcgaggtagaagtcggatgagcgccaaactttcgggcactcctccagagcttcctctcactctctaccttattctaatgtacacaagatacaatagagcctcttgtaattcagctcaaagttgtgtgttggaaatgagagtgagctcgtccttttataggcaggtatgacggttacagcctttgtgaaataaccaaaccacctcggaaccgccatcaggaagtaatcagggccgtccacgtcgaatctcgcgatcaatgacctcaaaagtggttcggctgaacccgggagggctccattcggcccgtttttcctcgtggacactaattttgaggccctcagcccattggcatgatggttgggcccatttggagttgtctaattgacttatggggcctccaatccatgtaaatgtatcctgaatgcgtggaggtgcagtttgtcgcttgacggatgtgttttcttctcaaaatacatgcatacatgtatttcaccaacactagtggaaatgattagtaataatccgtaccactaagttggatactatgttttagttcataatatgcaggtattgacggtcaaatattatgattttaggaccatcgacagtgttcaaagggaagaagactaaggagaatctcaagaagatgtttgatcaagtctatgccgcttttgagccattaagtgatgtagatggtgagagtgaagatgaagagaagggaaagaacatctccggtgtttgctttatggcacgtggtgaatcggattcagagtgtgaagacaatgaggtgcgttcttttgatgaagttattcttatttgaagtgcaaaaaataagaagtgtgagaagatgtatagaaaacaggaatttattattgaatctcttaattctgaaatttctagactaaaatatcttattcctaatgatgatgagtgcaaaaattatgagcttttaatgcatgaaatttcaaaaattagagatgtcattgttacacatgatttcaaaaatagatctgctcttgctcttggatttgtcttgcatacacgcactttgaatgagttgtttttgattaaaaagttgttgaaaaaatatcaaattgcttttcatgctagtttgatgtttaacatgatttgtgccaaaaaagttaaaataagaacatggtgttttggattgctcaacatgcacactaaacaagatgaagctaaaagatgcattaggtcatgttaagtacatggaggatattgtgaagacccatgaagtgctttcttgccccaaatgtcgtaaaagcaaaggtgtcatgggtgattgtgaaaattatgttattttgcaaaggtttcttatttgaaaagttctttgaaaagattttttttgatggtaagaaacaacttaacatgattttggatcaatctaaagtgactagctacaataggggtgttggttttgatgttcatgattgtttcaccaaaaatcaaccaaatgttttgagtgtgactgaacatggtgaaattttgacaaaatcaagtgctaagaaaacaatttttaagtctgctggaatgatgccctctctttctacaacactaaaagaaacaaaaacaaatctttcaaaaccatctacttctagagaaaagtatacttgttctttttgtggtaaagatggacatcttgttggtttttgtttcagattagctcgtaaacagaaaaaggagagagaaattgcttttgcaaattcaaagtggcaaaaatctagttttctctcaaggaatccggtcaaatcgtagttggtcccgcggtcaaaccggtggctgtgcttcggtcagaccgggcatcggtcagaccggcccccggtcaaaccggctactgtactttggacagaccgaccttggagagatttttctaaaaattctcaaactattctcaaactaccggtcgtgtgtctcaatactggattcctaaatttttgttatctaaccccagtactgaggcttcgacatcttcttgtgtgtatgctttggtggcgacgaaggagaacgtgtggatcgtggattccggttgttcgcggaacatggccggtgaatcgattatctttggtgatgcttttactagtgctgttcttgctacaggtttggttaaggtaaatgataagtttgaattgaaaaatgtagctttggttgaggacttaaagtataatttgctttcagtttcataaattgttgatgaaaattttgaggttcactttaagaaaactggaagtaaagtatttgattcttgtggagactctgtgttgaat

SEQ ID NO: 28401 - DNA, 715 bp, Oryza sativa
aagggactaccatcattaaagaacttcgtcgagatcttttcaaaaaggagtacataaaatgtgagatgaaacctggagaagctttggatgattatcttggtagatttaataagattttgagtgatctttgatatgttgattttgcttaggatattaactatacacaatctgaggattttcgccactttttgaatggtcttgatatgtctatttgggagataaaagtcacatctattcaagagtctgttgatatgtctactttgactttggattcgctttacacaaactcaaaacacatgagatgaatattctttctcataaagttgattctaagtctagcgctttggtttcttcatcgacttctttggatgtaggtgcttcttcatcaaattctattgtccttgctttgattcatgccatgtccgatgagcaactcgaacagttcgaggacgaggacttggctttggctgctaataagatttctcaagctatgaacaatgttaggtacaggaaaaaatatggtccagctcattgctttgaatgtggtggtcttgatcacattcattcgcattgtcctaagcttgggagaggcaagaaggaagacaatggtgaagagaagaccaaggacaacaaacccaagagcatgtttgttggtatttcttacgaccacagataaatccgcaagcgcacggaatactgctgtagcgcttaacct

SEQ ID NO: 28402 - DNA, 1224 bp, Oryza sativa
cacgtggctatcgtgtacttgttttggaaactaacaaaattgttgagacttgcgaagttacttttgatgaggctagtccaagtactagaccagaaattgcaggtacgttatcactggtttagggggaggatggtcgtatttttgaagacgggagcgacgacgatgacgaggttggctcgtccggtcagaccgggcgccaagccagttagaccgccggcacacctccagtcagactggctcaggacgagcggttagaccggccagggtcattggcatcaggttctgttgacgctgatcgagatggtcctctagaggctacaactttgactagtgagggtacataacgtgaaacaacttcagaagtcgctcctccttagcatattcaacgacgacatccaccggaacaaatcattggtaatctaggtgagcggactacaaggtctaaggtaacgactcatgatatttgtgcaagttctgcatttgttgcttcttttgaactcaaagatgttactcatgcattaactgatgaatcgtggattaacgccatgcatgaagaacttgaaaattttgagagaaaaaaagtttggactttagttgaaccaccttctggacataataaacaagtgggttttaaaaaataaaaaaaatgaggatggtttgattgtgagaaataaagctagacttgttgctaaatgttttacccaggtggagggtttggattttggtgaatcttttgctcctgttgctagaattgaggcaattagacttttgttggcttttgctgctttaaaaggctttaaattgtatcaaatggatgtgaaaagtgcttttctaaatggttttatacaggaggaagtttatgtcaatcaaccaccaggtttcgaaaatcctgattttcccaaccatgtttttaagttgtctaaatctttgtatggcttgaaacaagcacctagataggtttaagaactttttgcttgcgaaaggttttcaaatgggaaaggttgacaaaacactttttgtttttaagcatggtgataatcaactgtttgttcagatttatgtgaatgatatcatctttggttgtccaactcacgctttggttgtggagtttggtgagactatgcgcaaggaattggagatgagcatgatgggtgagttatcgtactttttgggattgcaaattaagcaaacacctcaaagtacatttctgtatcaaaccgagaa

SEQ ID NO: 28403 - DNA, 15132 bp, Oryza sativa
agtatctagacggtaccttgatgctctacaggcattgaaacatactttccttcttttccttgctcagggtgtagctcgctggactaaagtaatggcttcctttcaccttcggttttggatgaaggccctcgagttgttccatatgtttgagatcattacatgctttgagtgtatctttggactacccatatacatctaagaagcccagcaggttgacgcaaaggttcttagtgaggtgcatcacgtcgattgcgcggagaacgtccaagccttcctaatagggtaattcccagaaaatagagttcttcttccacatcgccacgtgaccatcttcgctttctataggttggctgttaggcccctttctaaatataactttcagatctttcaccatagcgaacacggctttttcgttgcgatgtttaggcttagtacggtggtttgccttctattcgaagtgcttgcctttcttccatacaaggtggtttgcaacaaggaatcaatgatggcccatgtacacaaccttcctgcaatgcttcagttacgtacttttagtttcatccatatagtgagtgcaagccttgtatcccttgtttgaccgtccatataggttactaagtgcaggccaacagttaatggcaacgaacagcaacgctcgtagattacattgctcctgtttatcctcatcccacacagggatgccttctttcctccacagcacttttagatctccaaccaatggttttaggtacacatcaatgtcgttaccaggttgcttcgggccttgaataatgatcggcatcaagatgtgcttccgcttcatgcatagccaaggaggaggttgtagatgcacatggtgacagaccacgtgctatggccgctgctcatctctccaaatggatccattccatccatacttaaactgaaccttacattcggtgcatactctccgaagtctttaaatgctctgtcgatatttcgtcactgcgacccgtcagcggggtgtctcagcatcctgtcttgttgaagttcttctgcgtgccaccacatcattctagcatgcgatttgttcctgaaataaatgtttcagccgtggtattatagggaaataccacatcaccttagcatgaactctcttcttcaaaggttgtccgtcaacatcacctggattatctcgtctaatcttgtattgtagtgctttgcaaaacgggcatgcttctaggtttcgtactcctcaccgcgatagaggatacaatcgttcggacatgcgtatatcttctgtacttctagtcatagagggcagactgctttcttagcttcgtacgttgtttcgtgcaattcattcccctctagaagaatgttctttacgagttacaataactcgccaaatgccttgtcactcacaccatttttggccttccattgcaagaactccaacgtggtactcaactttttgtggccctgttcgcaacctgggtacaacgatgttttgtagcccgctaacatgcgctctagtttctgcacctccttttcattcgcagtcctcctttacgtcccgcaacatctgaccaagatcatctacaccgtcattatcttcaacagccccgtccgcctcgcccgttgtgttttcttcaaatccaccgtactaagcccagtctagaatgttatcgtcttctactttatcttcttccactgcaacccctagctctccgtgcgaggtccaacaattatagctacgcatgaacccccactgaaacaggtgggcatgaatagttcatactatggaatactccttctagtttttgcacttgtcgcatgaacaagacataaaaccgttatgcttgttagtattggccacattcaaaaaataatgcacgccgttaataaactgtttcgaccgcctgtctgcgtacatccattgctgatccatcaacctgaaatgcatataaatcgtaaaaataaaatctacaaaagtaaactaaataaataatcatacaataatttaaaacatcatccttaaactcaaaaccgacgttacatattttaaatgaatttgggatgacatggaagaaggcgcctatcgcaagagcgacaaagatggcgccgagacggaagactatattgtacttatttctaactattctaacgatttttaaattaacttaggtttgtattctttcatcttaattttctatattagttttttcctttgtcatttttaatttaatgtacttatttatagctatttaactatttttcaattaacttagtttcccattcttttatacaaataatcataaaataattatacaaaaatcgcacatattattcattttttcattatttttaaatttctaaccataccttcaatgtattgtacttttctctaaccatttattaaattaactaagtttttactattattttaacttagttttcctcggccttttcctttgccatctcttttacaacatatttatccacattcttttaacctaattttccctcaacaaatttttctctctcatcattttccaccataaaccttgttggagactatattgtataccaacaaagctataaatgtaatatgctaagcatacatcattagtgtcacgcccggaatttctatccaaaattccaaacacttatatgtgcgtttaaccctcgtccaagaatcagccgaggcacacaataacaaattgataatagagtactatcaaacagctaattaatattcgcaaaataaattattacagaggtggatagttcctctcatagaataaaattctaagcggcggaaaataaaacaaagactgaacagctatggtgactccactccacaagcaacttgacctgaacaacgcctaatcctccagatcatcaccttcattgatatactcctcctctgatgaatgaatattgcaagaatgagcatatgacatactcaacaagccacacagcaaatatgcaagtgcacaggataacaaagaatggcataggaaagctcatttgcataaacagcatttaataaacattttaaagaataataaaacagttgaataattaatcagtattaaataaacactatacaacacacccgtgttgcataggcccaacctcatctgaacaaccaaccccggttgtacaaatcaaatctccataccaggaatataccattccaaaccaggagtcaaattaattaacacaatattatcattaatgagaagtgtgagactaatcacgaaaaacattgttaaactcacccataaccgcgggcacgactattcgaatagttttactctgatcagagatgtaccactgtacccacaagacacaactccacaacatgtcaccatgcgcctcagtaccaccacagtaccttggaaaggaactgtgacaatacctctcacacaacacaactcaccacagtgcaccgttcctggatcataatctccccctcaaaaccagaggcaatggactccccagcgacccccacggacttctcgccgcttcacagtctggcaccccatagtgaatcatgctatacaaaaggtaaagctgttgcccacgctggcttgtggttggcacggtaaatgtttcacaacagtagctcgcgaaccggtccttaattgtcatgagcacgaccttcaaaaccatgtactcacaacccacctttaatcaggtttatgtgttaattaattaacataacatgattaaccatcatgagctaccattaaataaccataaataataatgtaatttgattaatcccattaatgagctaatgtttctaagcatggctaagcaattatacctatatatagcctttagctgaaccaaaccaatatataagctccaagctaattcaatttattacccataggaaaataaattcatcattggccattaattaatagggaaaagctcaccacccgatgatattcgaaaataatgcataagttgaaataaaacattagctttaaatagcttcaacatgctcaaagggttgtttgggatctttgtgacttgccttgagcttcttcaaacgcttccgatccttcctcaacaaaaacgctctcctccggaacgtcggaaactaaagcaaataaacaaaatcaacaaaacagtacaaaaacaagcataaacagtacatgtggatatttttaacatgtagatcttgattttagatgaatttagcaacttgaaccacccgaatcggagttacgacgatttagttatgaatttccgaagttttaatcgattttcatctaatccagaaaattattacgaattaaataaaagatttatgacgtcacgatgacgtcatcgccgacctagcactggacgacgcggccaccggcgatagagagctcggccgggctcaccgaggacaccaacgcgaagaggacgacgtcacgaactcaccggtgcgaaaaacaacgacggacgacgacgaacgacggccagcgatgaggttcgacggcggctcggctcggttccccgacggcaacggcgctccggtggtcttcggcggctgcgaagggatggccggggttctcctcctccgtgcgcacccgacggtggcgacgggaggcggcggcgacggctaaagcggcggcgtggcgcgactggagaggcggcggcggctagggcaacgcggtggcgatgctacggacgacgagggagcttgggacttgaggcaaacggaagaggacgactaggggatgctatttataggcggtgattagagagatcggactccaaacgagaggaatcgagctgggaaaatctaaagttagtttggagagataaactcaaaacgaactcgatttggtttatccgggcaaaattgattctcgaaaccttaggggaaaggaagaggataaggaggagatgctttcccctcaaacaatcggactcggggcgaccggatagggcgaatttggaggagggaggcggcgctcgggctcggccggctcggctggaggttgaagacaacctcgacatgtgggccccacatgtcggtggccgggaggaggagggtggggcggctcggcttgcgcgaggagagagggatgttgggccgaaaaccggcccaacggcttaggggaggatttttaaaactttttcaattaaaataattcgtgaaatgatgtttcatttattaaaaatacttcccttgctcaaataattcctagaaaaatctaaaaaatagataaacaagcaaagtatttaataaaattttatctagctcaattttatgttgaaatttttcatagattattagagtttaacttgtaagcttttaaattaatttctaaaaatgatttaaaagatgaattattaaattaggcgattttcaggacgtgacaattagagaatggagttgctaaccttatcgatcccttcaatttgtatattatcaccaaaaccatttcaccaaaaattttggtagcacctccgtccctcacacctccaatttgcatcaatgacttgggctggaggaggaagaagtataaaaaggtgggtaactttagtcccacttgaccgagactaaagatcaccactttagatctttagtccggattggtgttaacaaccaagactaaagatccccggccctctgacaggaccctaacaggccctgtcaggaggcgaaccgggcggttagtcccgttggagttattaaccgggactaaaaaagtagttttagtcttttttttggaaccttgctattgtggttttcaaccgatccagcaaagatcagttctccggtatcatagtaacactagtacagatcctttcatctgtgacggcccataacaagactggaatttgcgggccgtcacaaggaagtaatctcaatcgggccggaggccgacagcaaagcaattcatgaacccccaccgatgaagaagagcaggaaggcacactcttcccctcagagaattactctcgataaacccgaagcaaaggggagaggaaggggagaaaaggtgcaggcctcgcttctagctccgaggaagctagatctgggcaagggccaggaagagactaagggcaaagaggtcaagaagaaatacgtcgctccacaggagttccaactaggcatgccattggttggagatgacgtgcttgccgcaatgggcaccgcttgcaaggaccttcacttatactacatggagaaatctaacgtcaggaagccgaataaagctaccgatatccttggagagcacgatggaaagccattccttggttcaacaaattatatcatggtctactttaaggatcttttcgaccactacaggctccgagcggtggacacaagcctccttaagtgctacttcttgtaagtactgtagcccaactcaatctggtaataacaatcggtttaacttgcttacaagatcatttatcctgtgtgtaggtaaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgcgcctataatcaatagtaagtgtgttaactaaatatacacaacagcatgacacattccttaagtacttaatcaactttcactatattaatgccgcagtgcccattggatccttctggtcataacacctaagtggagtacatgtcaccacctgaactccagaattgataagaacgcatttgattggaccccaattcaactagcgatagatgaagcgtgggcccaatatgtgcaaagaggaggcctcaggaagacaggacatgacaccctcatccacaaaaaaagacttcccggtaaagtaacaaataggtgaccagtgcggattccatgtgtgccacaacatgcgccttctgtatagagaaaaggtgaagactttggctgagtttgaggtcggtggtctcaattgtgatagactaactacattttagtacttatatatgatcgatcaactaatctggaattatgacaatatagggcacaataaccaagtctctgcctaccagctttgaggaggttcgcgaggagatagccagcttcatcctccgcgaaataattaaccccaaaggaatgtttaggcttaaactaaaatgatgaacaatgttgaacttttatgtttaggcaatgatgaacacttattatgcaactgtgatgatgtaactgtgatgtttatatttatgtatatatttcatatgtttatgttaagacttgctaaataaatatttgatccaactaacttggttttgcaggtgaaatatgataaatatttgaatggatgtgaaatatgtgaatggatgtgaaatatgagatggctgtgaatgtgtggttgtgtgaaatatgttgatgtttgtgtatgtgaatgcatatgtatatgaatgggtgatgctggagagctggggatattagatatctgtgtttgtttttgtcatttttgtagccggcatggctagcaaagaagacctgaggctagccaaaaaaaaaaatttattttttttggattatagtcatctgtgacgggccataactaaatgcccgattgagatgacggtcatctgtgacgggctttagtttaggcccgattgaggtcaggagtcatctgtgacgggctctagtttaggcccgattgaggtcagtaatcatctgtgacgggctctattttaggcccgattgaggtcagcagtcatctgtgacgggctctagtttaggcccgattgagatgagtatcatctgtgacgggctctagtttaggcccgataaaggttagtagtcatctgtgacgggcgctagttgtggcccgattgagataggtcatctgtaacgggctatagtttgactgggcgtctgggtcaaagctatcggtgacgggctttacttagggcccgattgagatagattcatccgtaacggccgtttgcccgattgggataacttttcacatcagtgacttctagcctgtgacggacgctgtgcccgattgagatggggcttaccgcccgattgagatgagggtatccgttctagtgtaacgatattcatgtacgttgcataattttttgatagttgtcgacattttaaatagaaatgcgtagggaccaaattatgccacgtaatatacagtagagccgcagatgatttgaaaagtcggaatgaagttctctacgtacgctaggcggccggcttgccgagttgctcgcacgcgcgaagaccttgacctaatcctactcgcggggaagacttatactagtccaagtatgacttaattatgagttattatatttcatgactggcatatgtgtatcatatcgcacgtaactttaatttagacatcaagcacgggctactgtcgatctacatctctcaaagggaatacaccatatatatatacaagactcgagatcactcgaagatagtgcagttgttgcagcattcgctgataaaggctaactcgaacagcacaaatgagtagtgaaacatcgcccgtgccatctccccgcgggataactagagctcttctatggcttgctgtggcaacggtggcatgcctgcccgccgttgcatcttcctgccgtagaagttgcggcgacgtagcgatcccttatccgttcgggatgaaagacgatcagccaggctgcgccattcctggctttgaggtgagctgcaaacgggacggcctgctgctcaagccgtttctctcggatgacgtggaggtgcgcggcatcttgctagcagaatctcaggttcggataaagatggatatatcctggtcgtgctataacacgattaacagaacaatggactccataaattggtttctgtccttcagggatacaccatacagattatctgatactggcaacaagttcacggtcatcggatgccgaacacttgcttacatcaccatcacaaagccgcaacagctggaaagcagtagtttaaccaccggatgcgtggccacatgtaatagccagggcgaccttgcaagtctctccgatggaacctgctctgggataggctgctgtcagaccaccatcccaaaggggcttcagaactatgggatctggttcgatgaccgctttaacacagcgaagatctataacatgagccgttgcagctacgcagcactcgtggaagcatcaaacttcaccttttccacgagctatgcgatgtcatcagcgttcaatgacacatacgccgggcaggcgccgttgcttctggattgggccattgggaaccaaacgtgcgaggcagcgcggcggaatcccaatcccgatcccaaatacgcgtgcatcagtaacaacagtgactgtttcaactcgtctaatggaccaggctatatctgcaaatgcaaggaaggatttcatggaaatccttacctggatgatccagagcttggatgcaaaggtacgaaatgaacgatttctctgtgttgaccgtatcagtatatgccgcgtcaaccccttgcctacttaatttatataggatgctccttattctaacttcagtcttctgctttcctattatcagtctgtctgatattttcttatccgtcattcaagctaacttgcacaagacatttactacagttacatatacaagccatttgctaaacttgcacagttgaaaaactgcaaattcggtaaaaatgaagtgcgactttagtttggtttctttctagatgaattattatacttgtataaatcattatttctagctagtttccattctgctaaggagttagacgaaagcataatactttaccttttaggttacaacattaatatttgcttcaccacagggagaaaaatataaaggtactgatgtagtgtttgaaagtgattgatagacaagaataaacttagtcacgttacaaataagataggtccttttagcttttgtaatcatatttgcacgtgctcagatagcctcatcttttcgcgtatgcttattagccaaaatttaaattttcaaccttaaatttgaagttgattttggggtttttttcatcgaaatttatttttcagccattgtttttagaccgctaagaacacgtatatgaaagttttatttataaattatttttcgtttgcaaaatatgccgtttcgcttattccctcatatttttaaacatgtatttggttgcagatatcaacgagtgcactgattggtcgaagtacccgtgtgctgtgcctggaacttgcgttaacactcccggtgcattcaagtgcgtgtgccctccgggttatccgaaaggcaacgcccaaaatgggacatgcgagagagatcaactaccactcagttctggggcaaaaatcgctattggtactatcatgcttccgtctcatgctacatgtttggactgtttattttatttcccgtacataacgagtagtaatattgttcatttttttttcgcgagcatataatagcattcattctttatagtgtcttcaattcacgctactacatcttcggagtcactatgagataaagtatttttgaaggcggacaaaacatgttttcacaagcgaccgactagcaatgccgcctgtaccacagtcccgcctgtaccacaatccctgtagaaatcatgattttcctaggcaggcaactggtccaccagcgaagagattttgcagtgaagagattttgctcagcgtttctagcccttactcgaacatcgttctacctttcgctgattgttccatgtaccattgatggaatcggtacatttgcgtggagagattctgcacctgatcaggcttgacgagaggtttacccagcttaaattggtatttcacctcagccactgggatctctgcgtcgttggactccctcaactggtccaaggatagaccggtttctttcatgaatagtttgatctgtcgttttttaggtgtaagaaacgcgtcaccgggatccagctcgggctgtggttgatctccaagctgagggacttctttggactgtcttttggacttttcgtcagccttcttcactgttcgcttgtagtccttcagccctacctttgcctcgaccggtgctatcatcaacacgtgacagtcatgagactctagattcgtgaacttcttatcattcctgcttattattctctttatattagaggagtacccagacggtaccttgatgctctccaagcattcaaatatactttccttctctgccttgctaagagtgtagctggctgggcttaagtactggctttctttctcctttggttccgggtggaggtcctcacgttgtttcatatctttgagatcattgcgtgcttcaagtgtatctttcgacttcccgtacacacctaggaagcccagcaagttgacgcagaggttcttggtgaggtgcatcacgtcgattgcgtggcggacgtccaagattttccaatagggtaactcccaaaaaatagacttcttcttccacatcgccgcgtgaccatcttcgctggctacgggttggctgccaggtcactttccaaacactactttcagatctttcaccatatcgaacacggttttaccgttgcgaaatatatgcttcttacggtggtccgccttctgatcaaaatgcttgcctttcttctggacaagatgggtcgcagcaagaaattgacgatggcccatgtagacaacctttttacaatgcttcaaatacatactttcagtttcttgcaaacagtgggtgcaagccttgtaccccttgtttgactgtctggataggttgctaagggcaggccaatcgttgatggttacgaacagcggcgcttataggttaaattcctcctgtttgtcctcatcccacacatggacgccttctttcttccacaacagttatagatcttcaaccagtggtcttaggtacacatcaatatcgttaccagattactttgggccttgaataataatcggcattatgatgtacttcctcttcatgcatagccaggagggaggttgtagatacacatcataagaggccaagtgctatggccgctgctcatctctccgaatggatttatccatccgtacttaaaccgaaccttacattccgtgcatcctttctaaagtctttaaacttttctatcgatgttttgtcactacgacccatcggcgaggtgtcttagcatcccgtcctgttgacgttcttttgcgtgccatcgcatcattcttgcatgctctttgttcctgaacaaacgtataagttgtggtattaggggaaaataccacatcaccttcgcaggaactcttttcttcgagggctgtccgtcaacttcacttggatcgtctcttctaatcttgtaccgtagtgcattatagaccgggcatgcttctaggttctcgtactcctcaccgcgatagaggatacaatcattcggacatgcgtgtatcttcttgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaaaatgaatcatagcaatccttaaaataaatagaggacttatttaccttagcttaggttgcagctcagacagcccgagaatacaaccgacgacacggacgaggcgaacaccaacaacggcagcagcagcggaaccaacggtctaacacccaacaccacaggcgacggctgggaaccaggacgaaaccctaatcttcacttcacctcatcttcaacttcagggcggagaaactatatatatttatatagagcaagggtgagtactttcgtactcagcaagtcacgggaacttaggtgtttaatgcaagcttggaagagaggcaaggttgttttacaaatcttttatttgaagacattttgaaatcactaagtgatttatttctttctaagtttggggcgaaaagagacttgcgtctcgattcgactttaagagatgcttttcaacagctcatttagtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccgcagacatcccaaatcacacagattcgtttctgaccactcaggttgtccatctgccacataggctgattcaggttacgattcccacacaacaacaacttttcacaaagcacaggcaaacaaatctacgcaacgggaaccacctcacatccgcccatgaccgtgggcacggctgtttgaacagttagttaacctctgcagaggggtacactttacccacaagatacgaacttattccgaacacccgtcgatatcggaggttcgcaacaaagcctttcccaagctgacccagggttacctcatgccacatagaaggatcaaatcctcacataaatataggccattttagttttcacaaatcaaactccaaccacctcgatcggtaatctggcaagcttcgcgttctggccttaccaggaacccgggttggctccaatcgaccccgccccggcgttccccaactattggcatgcgaggtttccctgaaccgactagttacttagctagggtgtcccattccaccttgtggttgcactttgattatgtttgatgagtttcccacaggaatcggtccttatatgcgaatacgggacagtgccacataggcacaacccccgcatcgcgagttttcacaattcattttattttcaaacacaccgacaccgcatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacagaaattagtgcgactactgggtaggtccgtcggtttggcacgcaaaccgaggccaagcaagttaagtgtgtgattctaataatgcatgttgcaaacaaaataataatgacttttcaattataggggcaattgatcaaagggtgacttgccttgctcaaggtcttcatgaagcttcacgaatcttcgagaaaacccgcgatcgacgaaaatccgataaccgcaactatacgcaaacaatcgaaaacctaaacaaaggaccaaaagaaagatcctatttagactaattagtagtgccattaaatagatctcaattttacggaattactggaagttgaacggagtcaatcggatgagcggtttggaatatatggattttcgaagtttattggatttactaaccaaaggaaaaaggatttaataatttattaaaccctttttggaaagaaattgaaggagggatgggatttagacttctttgggcggctcgggctcgacccaagggtcatgcgcagcgcggtcaggccattgggccggcgcgggcgcgggtggtcggcccattaggggcgcggggagagagaggccgacgcgggtggacgcggtccaccgcgcgggacccacctggcggtggttgggttcacggtggggagggcgcgggctttataggcgaggaggagaggtcggtttggaggagggaaaccgacattggcggtcaagggagctcggctggtgttcacgggcggctgcggcggtttcgtgggcagcgcgaaggcagcgacggtgtggatgcgttgggcggcgaaggcggtggatcgaacggcggaaaatcgaaccgcgggagcgggaggattagcgcgggctggcgcagtcaaggtgggggcggcgagctggcgctggcatctgcgtctctgcctccaagcgctagcggccaaggagtggaggcgtggcgtcgttgcttgggagggaaaaagagaaaggaggacggtgggaagggggggctttaccatgccggtttgggaaaaaggaggtgggagagggagtgctctgcctctgggatttggatggacgcgggtgga

SEQ ID NO: 28404 - DNA, 63501 bp, Oryza sativa
cagcgagagcgagagagacagagagagcgagcgacggttctctctctctcggctcgcatgcgtgcaacgcacgtgcgagggggggagatgatgggctgggaggggagatgggccgggggaggagaatcggtccatccaaaaacacagggtggtaaagtagacttttacagagaaaactgatttggatagaattggagagatttagggtttggattcgaattcaaatttgatattcaaactcgagggtttagggatgtatcaagggaaactcaaggagaagtcatggaaaagattcaaaaggaatacttgggtatttgttctcgggaacatagggtggagtcaaggaaaggattcgaggcgggatttgaataattctggattcgtagaagtatttggcgaggattcaaaggaaggatttgaatttcggaatttgattttggagacttaaattggaagaggaaatttcgatgaggatgattttgatggcgacgagagggatcaaggacggatttaaactgagatccacggcacgacttagactcgcacacaaagaacgaaaattttcgcaattaggattttgccgaattagtttttaacgcctcacgaaaagtggagcgttacagatccaccccccttacaagaatctcgaccccgagattcgacggtggaccacacacacgaaaccaaaaagggatcttcagacttcttcacagcttcagactctgctagtctttcttcaacttattgttgcatacttgccacaaaacggtctggtaacttgattcacttagcattcttcatcttactgtggctttgctcttgcctgtggaacctgttcttctcctgctccttcaacttgctcgagattcacaactttttcatttgtttctacttgcacatggttcagacgaccttgtccaacgggcggtgaggtcaacgaggcagaaccactatttggtggctttgaactttttggtccagatacgttaggaaggcttgttgttggttggactcgttttgacttgactttctgagggcagtaccatgaatagtgtcccatctcatggcagatgaaacattcgactcctgccttataaccacgtctttttgaaggtgtagggcatggtacggagttgcttcctttatggctattattgttgatcattgtggcttgctgaccaggttctgacatagtcgaacgagacgtagaaccggaaccatttgaatgctgagatgctttctgatagtattgtgctggcgagtttgtttttcgacacaaaccttcttttgcttgaatctctagggacattactttgcgtctcttgtattcttgcatctcttgttctgcatcttctagtaacaaggacttatcgaccatttgccgaaacgtcggaaagtcgtgagccaaaagtttcactcgcagtttcgcatccattccttttaaaaatcttgtgatcttcttttgtcgacctgcaggtctacacttctgaaccgccagtcctagagggcagactatcttcttagcttcgtatgttgtttctggcaacttgttttcctccggaagaatgttcttcactagtttcaataactcgccaaatgccttgtcactgacaccatttttggcattccattgcaagaattccagagttgtacctaactttttgtgcccctgttcgcaacctgggtacaacggcgtcttgtgatcagctaacatacactctaatttctgagcccccttttcacttttgcagtcctccttgacgtcctgcaacatttgaccaagatcatctgcagcatcgttatcttcaacagcaccttctacctcgcccgttgtatttccttcaaatccactgtactgagccagtccggaatgttctcgtcttctacttcatcatcttcatttgaaccccttgctccccgtgcgaggtccaaacattatatctcggcatgaaacccgtccgagacaagtgaatctgaatagttcttactacataatactccctctggtttttgtacttagtgcatggacaacggataaaaccattattctgctttttagcctcggccactcttagaaaataatgcacgccgtcaataaactctttcgaccgtcagtccgcgcgcatccattgccgatccacgaaagtcaaaccaattaaacatcatacaatagttacatataattaatcgtacaatcattataaaataataacaaaaaatattcatgttttcataccacattaaagttttaaacaaatattgaatgtgtcagggttacggataaggtataccctctatccttggatatacgttgtatactgatacggtatacccgcgcgtatacggatagttcctgtatacattaaggaaatctatcacgtgatagaaacagaatccacagatgcagggagtcctactcgaacaagactaggtcgttaccatatcgtgaggggtccgatattttcgagtcctacttggagatcaactgacccgcggtataaaagggaccacctgggcaggacctaacgcatcgaatctgaccgccgacacatccaccacagcctatgaagtcagagcctacaggagccaagtcgccgggagatctagtcggaccaactcgactacggtctcgccggtatcatcgagttctgttattccctttgtaatctgtagtttccatcatataatcccataccaactggatcagggctattacctaccaaggggtctgaaccagtataatgcttgtcttttgtttgcttgatgtcatactacatagatcctcgtaccagcgtaccccaataccctttatatccggtctactgtcacgcccggaatttctatccaaaattccaaacgcttacatgtgtgtgaaccctcgtccaggaatcagccgaggcacacaataacaaattgataatagagtacaattattactctaattaataagcgaatataatgtcattacagaggtagatagttcctctcaatcaataaagatctaagcagcggaaaattaagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaagaatggcataatagggtttcatttgcaaaagcagcatttagcaaacatttgagaatttaataaaacagttaagtattaattaaacaatattaatccaacgctatacaacataccctgttgtataggcccaaccattctgaacaaccaacccggctgcacagttctatctctaaaccaggaatataccattccaaaccaggagctaatcaaattattaccaattatagcaccatttaatatggtgaaaagtgtgagactaatcacgaaagacattgttagacccgcctataaccgcgggcacctattcgaatagttttactctgatcagaggtgtaccactgtacccacaagacacagccccacatcatgtcaccatgtgcctcaataccaccacggtacctcggaaaggagttgtgacaataccccttgcataacacaatccattacagcgcacctttcctggatcataatcacccccttataaacaaggcatggactccccagcgacccccgtggacttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccacaattatcaggttttagttggcacattaattaattaaccaatcacgattgaccatcgtgaactatcattaagccatcattaaataatagtgagtcataagttatcccaatagtgtgctaatgtttctaagcttgggtaagcaattatgtctaatatctagttgaaccagtaaatataaagctcaactagtcaagttttaataacccaaggtatcaaggaataaagtaatcaagaacaaaagggctatagcaaacaatagattaattccacccaatgacattcgaaaataaatgcattagttgaatagaaacaatagctttaaacgggatcaacatgctcaaagggttgtttgggatctgtgtgacttgccttgctggccttggaactcttcaaattcttcttctgcaaaaacggactctccggaaacgacggaatctaaacagaaagaagcaaaatcaccaaaacagcacataaacaagcatgaacagtacatgtggatatttttaacatgtagatctcaattttagaaaaacttagatacttgaaccaactaaatccgagctaagatgaattagttatgaatttttgaagattaaatcggattaaaacacttatattgattttaattgaattatgacgcaataatgaattatttttgaaaaggaaaaaaggatttattgcgtcagcggctagggtttcggtggaccgggcgcacggcggcggttcacacgaacggacggcagagatcgactcatccaaaacggacggccgagatcgatcggtctatgaccggctcacgggagagggcaacgatgacgtcggcgatgacgtcaccaccggcggcggcggctcggacggcgcacgctcgccggcgaacggcggcgcttcggcacgaacggaggacaccaacgggtagagcgcgacgcggcgaactcaccggtgaccaaaggagcggcggaagaccaacggacggcgacggtgacggcgacgaggttgaaacggcggcggagatcgggtcgacggcggcgacggtgctccggtgatcttcggcgacggcgaaggggcggacgaggacggcggcgacttggcgaccacgacggcggtcttcccgagcgatgacgatgaccggaacggcggcggcgcacgcctggagcgacggcggcgacggcggcgctagggcacacggcgctagggcgtttccgacgacgagaggcgaaggcgagggtggcggcgggtagaggagacaccggggagccttttaaaggggctaggaggcagcggcgaaggcccacggcggccggcgacgggaaggaaacttcggggttcggaggaaagaggccgatccgaatcgaactcgattccacgaacttccaaaacgaattagccgatgtttccaaaagagaaaaggaagaggagatcgagaagatcatttcccctctatcaattcggccggagaaggaaaggagcggccggatttggaaggaaacggcggcggcggcgcgctagggtttcgggcggcgacggcgcgacgaagacgacgaccctgacaggtggggcccaccagtcagcgggagagagagaggagagcggccggcggactgggccgacttgggccgaggagagagagagggttttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggctttttaaaaattatttctaaaaattccatttaaacaacaatttatatattttgaatttttagggtgtgacatctacgggtatctcccctggacaaaatgtgttgtacttaatttaatttaaattgacttagttttctattcttttagattaatcttctatattttacttcctcatctcttttatcacaagatttttttcaaattctaaataaactaatttgattataaattaataccacatattattcatgttttaattaacaaatatttaatgtattgtaattatttttgattttaaattaacttagttttctatcaaattaaacaagcatacaacagttatatataattattcgaacaataattataataataatagcacaaattaatcatgttttaattccacattaaagttgtaaacaaataattaatgtgttttacttaatttaaattaacttaattaagttttatattcttttagattaattttctacattacttcatccttacacaaactttctctctcatcatcacccaatccaaatttctagaggcaaaatagtatacaaaatatatctctaaatccaaatgctaacaacaaaagagaggaggatgaagttgctaacctttttgacacctccaagttgtatattatcaccaaaacaaaaaaccaaaaattttggtagcacctcccctcaaaactcaagaaaattttgatgccttctcgggctagaggaagaagaagatgacatatatggagggtaattttagtcccagttgttgttaccaaccgggtctaaaaatggccaagatttttagtcccggttggtaacacaaactgaaactaaatatcccatcttttgtccaggttggtgttaccaaccgggattaaagatccgggggacctgacacatcctgacaatcggcaaaccatctttagtcccgattggtagtaaagatcaattcttcccgttgcatttttaaaccgggagtaaaaatggtttttagtcccggttttttgttgaaccgggacaaatgtggtttttgcccgacccggcaaagatcacttctccagtagcgtattttctacttattaaattttaatcaaaataaaagtatttcttcatataccttttatatcaaccaataacaaacatccccaatttaatttcatcatctactttattttcttagccaattacaactttctcccaatcatctttaataacttttttattacccatgcttaacttacaaaatgtgtacatattactgctagccttctccgacattgcacatacaacatcacccactagattggaaaggaagacctttcagatgcttttaatgggcaatttgcacattgaaacaacatgttagttcttttttttttttgcacattagcacttgtttaagcttcttccaaatgtactactccctccattttgtaatagataacgccgtgcactttttctcacatgtttgaccattcgtcttatttaaaaaaattatgtaattataatttattttgttatgagatgttttatcactaatagtactttaagtgtgatttatactttatacatttgcataaaatttttgaataagccgaatggtcaaatatgtgagaaaaagtcaacagcgtcatctattaaaaaacggaggtagtagtattttaagcttcttccaatgtttacttttcctactacctctgtctaaaatgacttcatctctaactatgtatattggataattctcccaatagactttatttctagttatgcgtatcacatagctagtccaggtgaaatgatgaagctactactagctttttcgcagtgcgacagctagcttttttttcttcagtcttggagagcgtaacgttatttttagtacaaactacacccttcgtctcgaaatataaacataacatttttagcatagtggtaagtcaaccatttttaactttaactattaataataaagaaattaaaaatatcaatcatatagaattgatgttactagatttattattaaacaaattatcataatatgcaacactttttatttaaaacatgctatttttataaatattgttggtcaaagtagtatctcgaagactgtgtcgaagtctaaaaatacttatattttaggacgaagggagtagtaagaaacaataatgtacgagttagcagtaccatggtactagtaacgcgcatacatacatacattggtagcgctacacggcgcgacacacgggcgcagcgcgccagggaccaaaatggagcgacacacagcgggaatgtccccccactggtgcaaccaaccgaactcagagttaaaaattaacttacatacagttggtgatggattacgatgccattcgtgatgagttaaagtttaacttagatttagctagtattagtaaacgtttaagttttatacacatgggtggtcggttgtgaaggcattgttgtggagttaatgtttaacttgatacagttgggatgtggactatggtgtcgaggatattgagttaaaaaataacttggagtttttgtaccttgcaaaaatcgatagatcttttaatttctatatagaaataggggcctgctaatgtgtgtgattagaccgagccacgtatctcggatattacatatacacatgctaactaatgtttaattcatcggatagaaatcaaccccaagtcatagtaactgggaggttaaaaatgaaaatcgtaatggtccaaaaactacatgatcctagcgtgtattgattcggcattaatttgataagtggttagaggaggcccggaataaacggtattttgtactgatatttttatttcaccaaataaaattggtagtaaaaaatttcaacaatcacaacgtggataataattattttacgatgcatattattacaatcgatcatcacaacggacatcgacggtggcaagtcgtgtaggtgcccgccgctgctcctccatggatgccggaggacaagctcaccgccgcgaaggttgacaccgtacgcgtggtggcggagcagcggacggatcctccgccgtctcgcttgcagcccgccgtcgtcacctgtgcaggatccacgcccacaactgcgctggatctgcactgctgtagccggaaccacgcgcgtgggacgcggagtggcggctggatccgccgatgtgctcgttgccgctgcgcctccgcgcctcccgcctgtagtcgcccgtcatcgccacacccgtagtcacgccggatccgccccatcttggccgggtccgcgcgcatggggtgcagagcggcggccggatccgccgccacctcacctcccatccgcagccgcccgtggccacctcgcccgtcgacgctgcacctgtccacgcacctcggcgccaccaaatccgtcgctccttcccctcatcactcctcctgatccccgaacggccaccgccgctcctcctcatccccgaaccgccgccgctgctgccgctcctcctcgttgccaacccatcaccggaaccgcctcgccgccactcctcatcccttaaccgccgtcgtcgttcctcttctctccacgaggaaccgcacgccgtcgcagatccgtaaaatgtggagaaggagagtaatgagtgggtggacggtttcttcgatgggaattcgtaatatatataccagataaagtcagtatgtcgagttaaaaaataactcaatgtggaaacaccgttggatcacaagacacacattgactatctcactaaccgttaaaaaaactggcttcgtatttaacaattcattgtatggttaagttaaaaaatagctcaatgtacgaacaccggttggatcacaaagacacacattggataacatcaagtaaaaaaattacccggattatggaagtggggaaggggcgcaggggtgggattgagattggtcgtcggtgagttaaatttaaacagcatgctatggatttagtgggggcagggtgggaagtgtgtaagggtgggaatggggcctgtatcagtaccatttagtacgtagcaccttgtcgtgccatatagtagaaagtgtgtgtgttaatactgacttaatttcgtctgccatcttctccttttctaataagagcatataatcctcttgtttgtcgtcccaatacgttagggaaaagggtctgggtcattttgatctagtcaacagggactgttcgattcatcaatgtcaaagtgactgcttatttaaattctcgtacatactaacaactaattaatcttcacatcgacaggaatctctgcttttgttttccttgccctagctagcttcctcataagagaagtgatccagcataaaagaagtatcagaaggcaaaatttacaaagacaaactgatgagtattttcagcagcatggaggccagctcctgttagaaatgatgaaagtagagggcaatgtcgggttcactctcttcgacagagtgcaaattgagactgccacgggtaatttcagcaagacacacatcataggggaaggaggacagggaacagtttacaaggcagatttagacggagttgctgttgcgataaaacaatgcaaggaaattgacgagagcatgaagagggactttgtccaggagttggttatactttgtcgtgtcaaccatcccaacatagtaaagttgcttggctgttgcctgcagttcaaggggcccatgatcgtatatgagtttgtgcaaaacaaaacattgcaagagctgcttgacctccagagaagcaggaggttccatgtcacactaggaactcggttgaggattgccgcggaatccgctgaagcacttgcgcatctccattgcctaccgcatcctatactacatggcgatgtgaagccagctaatatcctacttgccgagggattgatcgcaaaggtgtctgactttgggtgctcaacaattgatgaggaaaatcaggctgtgcccaaaggcactccggggtatattgatccggactatctactcgagtaccagctcacatccaagaatgacgtatatagctttggagttatccttcttgagcttctaacaggtaagaagccactatcaaaagaaaggaggagcttgacatcaatgtttcaggaggctatagcacatgatacactccgtgagctccttgacattgacatagttgatgaagctagcatgagggtgatctatcgtgcagcgatgctagcgagtcaatgcttagttgttccaggtacaacaagaccagcaatgacggtcgtggcggaggagcttcggcggcttgccctagcagatgaagtgcagcgatgcccacagtcgccattagttcttgaggatctgagctttacggatacaggaggaagcacagtgtccatttggtacaatgggagccagaccagcggggtttacaacctcgagaaaaaggccgttctgagtacaggattcgccagatgatcgatagatcatatgctatattgttggcttccttgtgtcatttgtaggtttatgatatatttagtgttcttccacactttagaggcattcattgtgaggaataagagtacactaacatgtaaaataatgtagcattaagtgtaccgcaaaattaatgactgaaatttaattatctagtttaacttcatgcatggtagatcttctactccgatatgttgggagttaaacgtatcgtcaaggaaatccatggcggtctcttgttattccccattttgacaccaaggagggtttctgagaagtcggagctgctacgtcgagtatttgatgagcttggcaacgatgaattgaacctttcgcttggtttcaggcagggtttggttgttgtcttctagtgaagtcggagttgctgcgcttttgtgaaatcgggaacaataacccatgccaggcggaggccgagcatgcagaggagcgcggcaagctctagcttggtgagactcccatcgacatcgagcttgaatcggaggaagatcctgcgcagccactcgcgctcatagccagccagagcgggggccttccccttctccttcccatcgacaatgtcatcaccgcttgcatctgcaaggcaggcacgaagctggggttcaagaggcagggaaggaagcggcagcggagaaggcatgaatggtgggtcgatgaggggaggagaagacgtcatcatgtggggaagggtccggtgcggtggtcagaggactcttttcaatggatgtcggcggaggcaccttgggtgttgctctccatgtgcttgaagtcatcgtcaagggagacggaggcgaaggcgtggcgggaggaattagtgttgccaaagacaccggggaatggggaggcggaggcttggccgtacatgtcaaagaaaggattaggtggaagaaatgttaaccatattgtttaactaacacatgggtccacaatttttgttttaatattaaactattaaattttgcttcatgtaccacgtcaatgccacgttagatgaagaccaattcaaattagccacgtgggtgccacgacagctaaaaaccgtcatccaaactgtcctgggaccaatattgcaccggttttaatagttgaggaacccgttgtatctagtattgcggtttaagtatgaaaatcatactcactgtcacagagttggcaaagaaaaatcctcccactaggcccaaagcccttcggccgcataaaaagctgaagcgcatgtatagaccttattaggccctcttctaagggaaacgttcactttggatccattaactgttggtcgagtatcatacgttgcccctcaactataaaatcagatataaaatgtccaataactattaaagcttgtacaaactaagtctttgagacaaaaaaaaaatccttctgatcagccttcctaagtataatagtatcatcagcatactgaattattggaaagtcactttcttcatcaggctgaataggcttagaaattaaaactctattgaagcaactcagcccctagaacaaacaaaagtggagacaacgggtccccttgtctgacccttcttttgcatttgaaggatattccaggtacaccatttaaaagaactgaagtatttgctgagttaaaaatcatttctacctagtttaagcatttagcaggaaaacctatatgtctcaatatcatcaagattgcttcatgctcaattgagtcaaaagatttctcaaaatcaaggtttataataacaatttctctctttgattgctgacattgatgaatttattcaaaagcccatgctaaacaatcttgtattgttctgcctttaataaaaccatattgattttggtgaattaaatcagtgatcactccttgtaatctatcagctaaagccttagttagaagtttgagacttatattcttaaggaaatgggtctaaaattattagctgattctgggtttatcttctttggtactaaagaaatgaaagaagaatttatagactataaaaatcttgggcaacaatgggccaacatttaattcttcaagaaatacccattaaaaccatcagggtcaggagctttatcaacaggcgtccactttaccaaatcatctatctcttgagaagaaaaaggatccaccaaataggacaaatcaattgttctttgaggaaatcactcagattgaatgccatgcttgttcccagagtagagttcgacttttactctatttttatgtctagtgcaactataagttttaaacagcgaccgattttgtacctatattcggcacaaactctaacaatcttcatgttcttctcccccactatcgaaatgtgcatatgattatcattgacaattatatcaacttatttatgaaaacatcaaggggaaattggatgattgtttctaatccaatgagaaaacttgcaaagctcctaactacttgtcgaagtgtcatgtgattttatagattttatagtttgtactgaactgtaacgttgacaggttggtagaacgtggaattaattcttctgtacagatttttcgtcattttccgttagtacatttttcaaaatactaaataatatattttatgtaaaaactttatacataaaaattgttttaaaatattagataaatctatttttcaatttgtaataattaaaacttaattaatcacaggttaatatctttcttgttttgcgtgccccctttttaatcttggtctttaggagggcctatgtgtcaatttgcatttgtgtgtgatgaaacagatgttctgtggacaatggacacactctgcctctaactaactcgggaaaaaaggaagcagtattccaagcataaaagaactttgcaagaatgattatcttgggacataggccctcctaattggtttgccattgatcgatcttgggataaatggatggacttttcgttgaaaaaaaaggggaaaagcgatgaagcattcagaacaaaaaactccaggtgccaaactctgtcagactacgtgcacactgcgacacccagagattaactcgcacctgctgaggatgcgacgccgacttgccgtgggccgggagacccagcgagctcggcggtggccggacatacggcggcttgccgtgcgacgtgagcccctgcaccagcatccttcacgagttcgccatggctctacaccacgttgcctaggaacacccccgtgcagctccgcccgagcgccacctggtctaggcgccacacgttcatggtggagaagacgacacccgcgacgccgagcaggcttctcgccggagcaactaccgccttgtcctcttcaggcaactataattttgctccaatccaacagggttcagcgtgacggccatgacaagtaggcccagacatctgccacgacaagcgtaaacatgaaaatttttgggtctatactatcgtgtgaccaagttacatggttttatatagtttacagattgagatttctgctattggcgccgataagcaagcaggcagaggcgcgcttggcgcagggcgcagttactggatattcacatcgccaggcgcatagtcagaagcaatagcaagtgtcatagtaagcctaggagcaaggcagaaaaaaccagaaaatggaaagaatgaggaagagaatggtcatggcattgattgtttttatgattgtcacaatgaacaacatgattgtcacaatgttatgtcctacaatatcgtgcagcgtgattgtttttctcctttattattgttctgtgctagctcttgccatgagccacatctattttttttcctctgccgctgagtggcgcatatgtgtgagggagatggtgaaagtggtcgagagatgtatcggcaaaaaatgaactgtagcacaaaagcaagagctgagaactggcagctcggtggcgacggaagggtcaaccctgttggattggagcaaaattatagttgtctgaattcccttttcctctgtattaatcgtgttggttcctgacaaacatcatacattgaaaactatttattggcagaaaacatgttgcattattgtttcttacaagatagcttgtgtgttagtaatacctgatgatgtaaagcttggcacagcaatagctatcggaaaacagcgttatcaaggcctctagccaccaacctctcatttttcacaagcatgtgaacgtgcgttacaaatatgctaaaaatcaaacagcattacagcgcacaggctaacgctacatagctcgatcggaagacaatttcttatttcccatcacacgtatttgacatatccgatctgaaaaatcaagtttcaaatattttgttccagatgcaacacatagctaaacataaaggtcttttagagacagaatgaggtagcaggcgacaaccaagctagttagctagaagatgcagtacacagtataaagaagctgaaaattaagcaggatacaacaacagcgaagtagcgaacagaggacaagagctagtaaagttgggcgtccgtgcgagtgtacaccccgagcgcatcgaggtaacaccccgcgcgggcgaagaagccgacaatgcacccgtcgctctcccccggagccgtgaatggagtccctccgcctccggcgccttgcccaaacggcccgtagctgaggcattggttcgtggagaacgtgagcgaggtaatgacgactgtgtcaggtgacgctgcatccaagggaccgaacgttccggtgatcccctgaagtgattccagaggcatcagttcaatctgcgagagacaatgcaatggggtacgttacattctaccccaagataaatgtatatactctctctatccctcgacgccgttgactatttaaacatgtttaaccgtttttcttattcagaaacttttgaataagatttaataaacatgtttaaaaaaatcaacgacgtcaaatatctaggaacagagagagtatatatcgatgacagaccgattgaaaaaatatatatattcgtccactaaccttatacgcattgccaccaggaccaccccatggaccaacaacttgctcacttccgtcatggtcggcatatgagaactcaatagaatcgatgacgtcaccactacggatagtcacactcactagacgatgtggctccggtgcatcgacgtagtgggactcacctccacttctaccccatggcccaatcctggtaagcccagtctaatttaccaaaaatgaagaaaaacgaaggattagtgtgtgagcacagaggaatgagatagataggaacagcaaaattttacgctacttatatctctaggtatcacatgcattgctatattaacggccgtttggttggagagaatttttaggagggattgggagtttagagggatgagactattaagtgttttgtttggttgggagacatgggaattttgatgggatggagattgggaattgagaaaggaactccctccttttcaatacctgggtaggggcaggtaattgggagggaattcctcctttactttttctaagcaaatctcatccatccgtttttaataatgacttaatcttcaactaaactccctattaatttccatcacctctaccaaacaagatattgggattaagaatcaaattcacatcttaatctcatcatcaattccctcgtgtaaactcccaatccccttccctcgagttaccaaacaagttataagtttaatactgaaaattgtgacactccttctatttttctaaagaataatggtaaaaatagctatgttcagaatgtcaaattgtagtgctagtcatgcctatacttcttgttattgatggccaaataggctgtctggccccgcccagccaatgcacgaccaggctctgacccgagatcagttgggccagcacaatctgacctaaacatcagtctaggcccaccaacggctcagacacgacccaataagactcgggttgtaccgggccggcacgaatgcacagaagactgcagtgctcctcggtataaatctattttctccctcatctctttgggccgtatcttatatacctggaataagtatattcttgcatcctttatatcttcgggccgtgccttataaggctaaaataagtctattttgggctgtgccgtgccgagccagctcagcatgccgagacagaggcctagtcacggcctaacaatctgaccgggccggcatgaggctttggacaccagtcgagccgtgccatatctagactgaaccaaaccctgtgccctgagtcgggtcgtcgggcccgatcctttctgtcatttgtacctgtggtgccggtgcttcctgcaggtgggggttggcatagacgccaatggcatggacgaaggagtccgcgcagccgaagaagccgacgatgctgccgttgccgcgcatcgggatctggaaaggacttcctccgcctcgtccgaatggaccgcgcctacgggcgttggtgatcagcgtgagtgatgtgacgacatccctatccggtgcctcgttaaatgggcccatggtcccgcatatcccagttagaaactccaaagggccaagctctatctgcatggacaaaaaaaattgtaagaaataaaattgcatcaggcttgctctacgtcgagtctcgtggaagataaatttaaatcgtcctccgtccctagattattcttttagaaacacagaataaaataaatatagacgctcacaacgcatacatagttatctctattaactcacacgcatatcctaactctatgagcacatacgaaacactcttttaacgcatatcctaactttgactaaatttataaagagaactatattatttgatatgagatatgtatcatttttatagtttattatttgaagtgatagatgttaatacttctttttataaaagtttatcaagcatttacaaacactctaaaatcgtagattggagggagtataaggtgacaagtttctttttttttaaagaaaatactaatccagcaataggaaaaatggactagaacttggtgggcttggtaaaatacattttaatgagttaagcatgtactcccgaatctatacaatctatctagattcattgtattaggttatgtcacatccaatcttaattaggtttgtttttttttagcgaaggaagtacgtggttagattttttgtactaggtgacgtcacatccgatctttttttgttttttgacaaatggagtgctcaccgtataagcggttccaccaagaccgccccacgggcctatcgaatgcttctgcccatcacgatcactgtaggagaactcaagtgaatcgatgacattgccactatgaatcgtcacgctttccaaacgccgtggtgccaccttgatgtcccgatgactccctccgttccaaccccatggcccaatcttcgcgagggaatcctaacgagtatataaacattcgataaaagtgagaaaaaaaataaaatcacatatagatagatggaaacaacttctcattttagaagttatatatatattgatcacctcatcatcatcgtcttctactgttttctgcttagggttaacatagataccaaaagcgtccacgtaccacccagcacgtgcaaaaaagccaacaatgctgccattgtcctgcactgggatgtggaaaggagttcctcttacttctccaaaaggtccgtagcttcccttattagtgataaacgtaagcgatgtaataacaccagcgggtgccctatcaaatggtccgattgtcccagaaacttccgttacatactctataagaccaagctgaatctgcaagaaaagtttcaaaataacataatactactagtaaacctattataaatttcactagttgtgtgcagagataatgaatgtataccaatcattttatctaaaagaaaaatgcaagaattgaataataagattcatagtcaccttagtacgtttgttccctttatttgggccatagccgccccatgtgcctgatgtgtgctgctgcccactgtggtcaatgtatgagaactcaagtgagtagatgacctcaccgctagaaattatcaagctttccaaccggcggggtgccacctcaatgtcatagtgactggaaccaccagctccaccccacagcccaatcttggctaccttagcctatgtgttaagccatcaaggggaaaaaaacacattgtgaacaccaaatatgaaaatagaagttatgtatataaatatttaaaggaattatttattggtaattttgttaatggtgtcgtgcagaccaatcatctgttactacaaagttataacccactgcttcctcaagaatacatgcaaagatgacacatcattattcactaacaattattacatttaagcatcatacaaacatgctatattgtctataatttaataatttattaaattttaaagattttaaatgtaagcatgttaaatcatcccacataatcataatatttcaatatatctctccattatttttttataacatcctatatactatatatagttcatcctcacttagttcatgtcatttttcttttatcttattaagtcatatcacatcaatggttcaaattgtctctcttcttttcttctctcatcaaaccatatcatcttacttttacatttgaatctttattctacatactatttaaatttaaatcgcatcaacttatataaaatcatgtttatataagcttatgttatttaagttatcttacacattatttttacattatttttagttattgttatcataataaattcccgtaacagcgcagggttttaccttagaattatttgactgtcccgtagataaatgtcccattacaagagaacaacaaaattacttccttcactgattcgttctcggttggttagtaaaaaagttgttcttcgtgtgtaaatgaactactagaagtgtaaaatataagagtacttctatcataacgcctcaactttcagctaggggaagatttagggggaaaaggaaatcctagagcaatcaacagtagggctaagaattttgatcccggtccaatatatatatatatatatatatatatatatatatatatatatatatatatatatatatatatatatatatagtgctccatggtgcccgggcaccattgttgaaattaagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatatatatatatatatttcctccctttttttctagctttgacgttggttagtgcaaacaataaggggtgtatgtagtagctgagaagagaaggctttcaaaagaaaaatggtaatgtcatatggacgcatgcatagttcacaaagatactattggtaactattaatataataaacaatgggtgtgtttagttcacgccaaaattggaagtttgtgtgtgggtgtgtttagttcacgccaaaattggaagtttggttgaaattggaacaatgtgatggaaaagttggaagtttgtgtgtgtaggaaagttttgatgtgatggaaaagttggaagtttgaaaaaaatgtttggaactaaacacggcatgtgtaggaaagttttaatgtaatggaaaagttgaaagtttgaagaaaaagttaggaactaaaccaggccaatagcttgctaaggggaccgagttacacaaggattattctaaaaacatccacaatgtatgccataagggggtcttaaccaattaaggctttagggtgggtagtatacattatgaaattaatctttatagatgaccttatgatgagctagcattaggtataaggaccacccataaggaataaataattcatctctgttctctctcctgctcacttgctcacaaggttgtcagtatcccgatacgtatcctagtatcttacgatactacgatcctaccaagccgaaacgataccgatcccacctagtatcctaattttcatagtatctcgatcctactattcattagtacacgatcctacgaaatcttaggtggtatcccgattctacgatccctacgatactacaaaatattatttaaaataacatggtatgaaaataatataaataaatatgcttaaatttatataaaaatcagttaaatatatcaaaaccaacttggtttctcttaataaatgcctatatttgcatgacatataccattactacatttttttatatagaatggctacatataattaatataaatattaattaaacttaaaaaaagaaaatctcatagtatcccgatactacgatacgatcctatgatacgatattactttgagcaaaacgatactaacaagtatcccgatactgacaaccttgcttgctcaaaactctctcctacatgctagcattaggtgatatttttatatctgtggggcccaccttatttcctaacaagttcataccattgttgggtatgtaccacaactaatatcacctgttgtaggacccatctatatagaccacttgatctcatatcctaaataaacgatagaataacatacccatgcctgtttgccataggaatttaacacttatcaatcattataaaaagggaaatttagtgtgcaattgtagtggtgaaaatgggcaggtacgattggattatagcattcggatatcctaacctatattttactttaaatttggaacctgaaatgggtagtgtcggacaatatatcactcatcccgtatcctatccaatattacttccttcgaatcggcttcgggtacggatatctatttgcatctctaattcataaatattaaatataacgaaccaattatagtgtcaaaagagataaattacgggaaaattatacaatattgcacgtgagctcgtaaaatagtgattaaccaatccttttatcatgcatgtccgtaggtggacttgtaatagattttcatatgtgttctataatatgggacatatgagtggatacaagtcttcttgtatcataacccattttttttaggattcgaattcaaacttggatagtatcgggaatccttattttctcttccatattcttcccgcgagtctcagatcgggcaagctatctggaaatacccgtccattttcaccctatgcaatggtgaatgcaagtccacaattgtgaaatgtaatcaattcatgcagtagtagggatgaaaatgatcagaaacgatgtcattattttattacttttatggaatcggtcatggtatggtcgtaaatttttggtattcatgaatttaactatttagcatcaacttcgatatgatgttgataaaagttagaaaaaaatctaaattttatatatggctagaaatgaaaacgatcggaaatgatatcatttttacattagttttatgaaatggtatcggtatggtcagaaatatatgtatcattttcacccttatgcgatagtacttaccaccaaaattagtttttatggttcttttttgtacaaagtaggtataatatttctggcatttcaccaaggatgtacacatacgtatttgtaaacataaggatttcaatcatggcaagtagagtatgtattatatttctgagtgaattttttttttgcattcactgacttttatgattgtggaaatagtttcactgactttatatatgtggcattaaataactacttcctctaatattcccaattgatcatcatatatttttatgttattttcaaatgatgatcatattagtattcattcactaagtttattcaatatctctgtgtgagaataataaatatcttggtctgttagtgcactgcattgatcgagttgttaccaaattaaatatagtatggagagttattggcttttcttgattttcatgtacttctataaaatgtgtggatcaattagaaatggaattgagtatttattatctcccgcctcccgcaaagctaacatatacatacatctcaatcatcgtcataattatgaatttatcatacctggtcctgtgatgacgacacggctctagtataaatttctgtctgtttcaactcatggataatgtcatttatagcaggtctgctgtgtctatcaacctcgacgcagcgtacagctatttcaacgcattttttcacttgctggcactcttctttcgcgtgcattgatgtgtccccgatcctattcctccaattatttgcaacctacgaatcaaaatatgagcaatacatttgttgattgagtacacatagacatggttccgccatgcatgcatggtgtctgcttagatgaaaactgaacttgttcttctaagggcacccgcaatgggctctctacaagatatccatgttagtatattttcctacatggaagagattaaatgaagagagagagcaaaactatctactaacctggagatagtctatagagaaaaacgaggcaatgcattagaaagctatagatacccatgtagacatactattgaggtggtttactattaatctagtctattgctgagatgcacatgttttatagagagcaccttactttaccattgcgggtgctctaagggcagtcccaaccctccacctaggatggtgtctatggtattaactacattggcatgtaggacttttaacttatgtggcactatattaattaagagagagagtgaaaaaagaaagaaactgggtctcatgcaagatacagcttcaacacgagaacctatgcactagacactatcaagttttgtattgggagataatagtgtcttcataatagatgaagaataaatatgattgataaagaagagagatgatgtatttattaatggcccattttaagaaattacgggttatgaagtgtagtttctattgtgatgtcttattgacatggcaccatagacactacttatggacactatgggttgagactaccctaaagctacgagaggggttggcaacctatcctccccgttacgcaaaacaaagcatatattattgcatgattaattaagcattaactatttttttaaatagaattaataagattttttaaaacaactttcacatagaattttttttcaaaatacaatttagcaatttaaaaaatttgcgtgtaaaatacaagagttgtgagttggaaaagcaggggaagaacacaacctacgaatagacaagttccgctagccatgcacttcttttttacttgggatggacgacatctctctttgaaaggaaagttctccagctacaaaagacccgtgcttgttatgccttttttttattggtcacttttgactaggcacaaataactaggtaatcataacttttgcacaatatgctagtttcggcattgatatgattatttaaactagtactccctggatcctaaaatatatagtacttactccatttattttttataggtatttttttaaattaaaaaaactacttttgataggcatatttcaatctaaccacctaccatcttaatgactttctcgtatttaatgcgttgctctccattcttccacttaagattggttatatgagcatcgagaaatgtaaatataatgaattgcttgtttacgatgaataactagtagcatatttaaatggatgataagtagaattacttatccttggtcattgtgacaagaagaaatatgactatcaaaaatagatgggggagtaacttttagctactaatctgaacaaggaaaactgtttggctagattcatatctaaaatttgttatattttgggacagagtgaatacattgatgggttggtggaggtgaaattattattagataaggggtaataatatgaaaaaaattgcaaacaaattttgttgtaaaaaatgataaataaacaagaatagagggggtaatttcttacgagatcgacgaattgttgggttgatgacatttcgccatattttgagtagcctttatgtcccaccattatctggatgattataatacctaagctgaatatatcattcttatttgatattttacgttgtgccaagtattctggtgccatgtagtacctgcatcatatcatcagtgatgttaaacaaacaccatatcattcggttagtactaataagaaagaaagaggacatatctcttgacgtcctctctacttactctgaacctacgcaaactttagtggtatgtgtatgcgagccaccgaagggccttgataccccaaaatctgctatttttggcaccatgttattatctagaagtatattggccggtttcaggtccagatgcaaaattggttcttccaatcctccatgaaggtaactaagaccttcacaaatccccataattattttgtagcgtgtgcaccaatcaagcccgcgagactcttctgttaaagtggcaaaaaatattcttgaaatgtgaggattacttttttttgtttacatgttaaataattggatagagttcgcaaattaccaccatactcaccatgcagataattctccaggcttccacgcggcagatattcaaagcatagaactttgtatatcattttacaaagtacatcttccccattaacctccatgagttcatgtcttgcttcattgcaatagcctataaatcgtacgatatttttatgttgcaccctcataaggttgctgaattcattgctaaattgcacatcatcaagtcctcgcaagtcatatagcttcttcacggcaatctctgtcccatttgtcagcactccctgttgcagttgtatttcgatctcattatttcattaatatgtattactacaagggtacgccgtaagtgggttatcggagttcattattgataccacttgaaacaaagatatgagtatcatatctcacaaaccttgtaaacctgaccatagccaccactaccaactatttggtgatcggagaattttttcgtaatatcttctagaaaatgtaccggtagatcagttggcattgtacttggatggtttaacttctcctgtttacagatttgctacctcttcacctatatatacacatgaattattaaaactttcgtataagaatatttagagtttacataccttaaattaagatgagtgaattgcacgttattaacgaaattttcacccaagctagatataaaacctaaagataaatatttacatttattgtcatagtttctgggtagtcttttaattatataaataatatatatcaggattaatttaaaacaaagttgttctttttatgataatcctatctattaattaaccattttatgctgtattggtccccttccttccccagaggtctcgatttgtgtgtcattagaaactaatttggaagttcccaagcattttgaaaattttataacctttgatgctgtaacaaaatttgaaattatataaaacatgggaataatgtaagggaacattttacgaaaaataaaatatcacaggtacaaattcctattaaatttaaaaatatatttttcattcaattttttttgtagaaatattcaggatgcaaaatcttttgtacaaatataccatcggtcttgcacaaccattgcacgagaatgacgtgaaaatgacatcgtggccggtatcatacagtgaaagtgcgagaccgcgcggtctcgctcaagcaatcagcgctatcgcacaagcaaagagcgaaaccattcctagccgatttaattagcgattaattatcctgattagcgattaattaataattaattaatcactaatctggataattaatcactaactattattatttaattgttaatcaagtaattaattactaatcaaatggagccctttggacagtgtcgctgattgcttgaccgaaccgttcagtctcagctctttcattccgcgataccgtgtggtctcacgctgttgccgcgcgagaccgcgcggtcaaaattaaacgaaaagtatattttcaaatttagttcttcgtaatagtgccaaaatttccccacccgtttttttatttttttaaaaaaaatgttgtaaagaccctttttttagaactttgtaaagaccatagaaaacttactaggatgacatctttggatcatgcgtagagaaaaggtaaaatttattcagtgcatacactttatttgttcttatctttcgatcaattgatgatggtttgagatataaacatgtggtatgtggatgttgtactaaccaaagaaacaaatacacgagaccacttgcaagtaaaacagaccacacgctatctgctagctgtcatattgattcaagtgtatgttatcgaggctaactaccgttgcattagtacattttctttttgctatagagtcttttgatgacttatattttttaaaaaataatacagtaattacttaaaataaagaatatatgtatttacttgaaaatcatctctacactttgcttgtgaatttactccatatagtttcttatttcaactcaatcatgacgtaattacttctaatactatagagagttacttctattacatagcaaggttgcataaatgtttgaatatattcaagatcatcttgttttgtcacatattttaagggaagtacatggtgcaaatagatcataaaaataatatatgattaagaagatataagtcataaaaagattaaaaaaatacgtttttagctaaaagagaatttagtaggttgaagtgattgccgcattcttttcgggctattgggtttgctgattagctacacgtaaaacgagaaacatgattagcatatgattaattaaatattaattataaaattttgaaaattgaatttatttgatttttaaagcatcttttatatagaaagtttttgcacaaaatacaacatctagtagtttaaaaagtatgctaatgaaaaacgaggaatagataaggtgaactagctgtttagaacgccgccttaaccaagcaacgaccggtcgcgcgcaaactcacctgagtaagacatctcgttgtcgattaaggccctgtttagttcccacgcaaaaattttacaccatgtcacatcgaatgtttgaacacctgtatgaagtattaaatataggctaaaaataactaattatatagattacgactaatttgtgagacgaatcttttgagcctaattgctccatgatttgataatgtggtgctacagtgaacatttgctaatgacgaattaattaggcttaataaatttatctcgtggtttgatgatggattatgtcattagtttttttattaatgctcaaacaccctatgcgacaccctatataatactcgatgtgcacgccaaaactttgggcctgtttagatccctgccaaaaattttacgccctatgacttcaaaagtttgaatacctatacgaagaactaaatatatatagactaaaaaataactaattacacagattgcgactaatttgcgagacgaatcttttaagcctaattgcttcatgatttgacaatgtggtgctacagtaaacatttgctaatgatggattaggcttaataaattcgtctcatagtttactgacagattctgtaattagtttttttagtgcccaaatatctcatgtcatatcctatataatatccgatgtgatatgctgagactttacactcagtacatgtaagcaccctctaattcaatgcatctgcagctggatgtacatgcctgagcgagagccccacgccagcgcgtgcactatgcgaacacgacctgccactggtactagggtcaacaatatttgacgtcagtaaagcaatcggtttgaaaaaagaaacaccactccctttggagacttgacacttgtgatgggacgtgctccaagtctgcaaacacgtaccgtcatcatagctctcgtgacttttaaggctgtggctgtgttttgttcggtgccaacaaattttggaaatacatttaaagtattaaacatagactagtaacagaataaattatagatttgaactataaactacgagacgaatattttgaacctaattaatccatcattaggaaatgtgggttaccgtagcacttatggctaatcatggcgtaatcaggctcaaaaaattcgtctcgcaatttacatgcaagctgtgtaattggttttttcttccacatttaatgctccatacatttgtctaaacatttgatgtgacagaaaagttggatgtttgaaggaaaaaggttgaaatctaaacacagcgtgtgttcggatgccccttttcccaagctcgttttcctcacacatgttttctacactgctaaatggtgtgttttttgcgaaaagtttttatacgaaagttgtttaaaaaaatcaaattaatccatttttgaaaaaaaaactaatacttaattaatcacgcgctaatggaccactccgtttcccgttgcgcactgttccttgggaacaagcaatggtgaacacagcctaagtatattacttcaaaatataagagattttggttcgataagatatatcctagtgtttgcgtaagattcataatactaagatatatttctttcaactaaaatatcttacttcctatgtcccataatataagaatatttagagggatgtgacacaaccagtaaaatacatctatatggagagcctgtccagatataatgtactaggatgtcacatccctccaaaatcccttatattatgggatggagggagtatattttataaatttgtgcaaatgtaaaaatgaaaagttatacttaaagtactttagataataaagtaattcacaaataaaataaataataattctaatttttttataagacgaatggtcaaacagtgtaagtaaaatgtcaaaatcccttatattagaagatgcagggagattaggatggaggaagtatatggtattagtgttatttactagtttcataatatatataatctgataacaatttatttttcttctataatctgataatagaatcgtattgtgaatgttcttatgctttcctcatgtacatctttttctccagatcgaactagctagtatcttttgcattatacatctaaactaaattattttcattatagtagtctacatatttatcgatatgcatctaggtaatttaagatataccgatttagtttttcaagatgctactacaagattcctaacttttaccaagggggtttaaggtcggccacctataaaactgtcggccatacatattactgagtggttaccctcggcaacacgcacatgtggtcggtaatttatcatattgccgagggtaccctcggtaaccatgtacccgagggttacggtcggtctttttttccagagaccacgcatggttctttcttgccgacacatttcccgagcgtataccgtcggttattcttattctcaccgagaggtttattttcccgtcaaattgagaaccctcggtttctaatataccccgtcggacactaataatcatttccgagagttaaattaaacccctcatttactaatataccccgtcggccactaataatcatttccgagagttaaattaaaccccttggttattaatataccccgtcggccactaataataattttctagagttaaattaaacctctcagttactaatataccccgtcggccacttataaccatttccgagtggtatcttataactctcactcactgatatatcccgtcggccacatgctaaatagccgaatgttctcgtaactacccttattaaaatttcaaacggtcggctacctaaatcttcctgacggtctgtaggattttttgcttggacgcttggcaaatcttaggattctagtagtgagatcaataaaaaaaagagtgtatatgttaactttaataaatctgtgttcaaaagaatgcatagagttggcgtccaaggctggcatttcttttgggtgggggctcgtagtccaccgagttcatgttctttcttggcaggcacacaatcccaaaacaaatcagaactcgaaactctagctagctatgtcccatctgccgaagacattgtcgttgtcgccgtcaccgaatacccgcagctcgtcatcactatctccgtcgctactacccctccgccgctaaatctgtgcaggggagagccgccgccaccggaggagcacgggggagactattgccgccagatgcgcacgggggagggccttcgccgctagatccacgcggggcaaggctgccgccgtctatgcgccgctcctctgttgactgttggcctgcgcttgagcccgccgccgcccgctcgctcctaccgtctctgccttggccgccggagaagagaagtgggagaggggagagggaagtagaagagatgaggagagggagtggagagagatggcgtggaggagtgggggagagaagaagagagagaaaaagatgtggtagagagaaagattgtttttaatatatctgccacaccgtttacatattgattttttttaattgacgagggagtgcggtagatccgatgatcctggttcactcgtagacgatagatgaccacccaaaaagaatcttggtcgctcagaccgttcaatggaaaaacgatcaaggcagtagactttttcatgagttcttgaaagcaactattggtttttatggccaatttaatttgttgcagcaaaagtgtggctagaaattactaaggcttgccatcttaggcctggtttagttctcaatttttttcttcaaacttctaactttttcatcacatcaaaactttcctacacatacaaactttcaaattttacgtcacatcattccaatttcaattaaacttccaattttaacgtaaactaaacacccttagttaaagaatgcactaaaattggtctcatggcatgtgcaacaggcctgttaccctatacctatataataaatgagtagtctgttggaacgtaaaaattaaaaaatatatataaacaggagaaatgtagaaatagaaagtcatggcatatacaatcgccagaaattgaaacactaaattttgtcgaacaagttgtttgaatacttcatagggaattcatagtaaaattatagggatgatattatttagatagagttgagaggaaagataaagatatatagtgtatagtattggatttctcaaaggaaatcaaaaccaaggtttgagcttatatttgaaatcctaaaaaaaaaggaaatgaaggattcctatggaaaatgtctagccaaatccaacaaaattcctataaaaaatatcttgatccataggaaaattttcaatagaattttaatatattaggatagtggctagataggatttcaatcctacaaatttcctataaagtccctggaaacacagggctcttttggaacgcaacaataaaaaaacatagaaatacgatagaaatgtacatgcaaaaacataggattgaaatgttgtttcgaatacaagaataaagtaaaacacaatattctttctaaacaaagaagtgtatataggggtgtgtgtgtgtttccttaatgtgtgttcaaaccgtgatcattcgaagcgacacgcattatgtctttgacttcttacaagaaaagaaaacaagaggtcctaatgcatgctgaaatttctatgaaatcaaggccaaacgaaaattttgtctaggccccgtttagttccccaaattttttccaaaaaatcacatcaaatctttagacacatgcatgaagcattaaatatagataaataaaaaactaacataagtgctacagtaacccacatgtgccaatgactgcttaattaggctcaaaagattcgtttcgcggtttccaggcgagttatgaaattagttttttcattcgtgttcagaaaggccttccgacatccaatcaactatccgatgtgacatctaaaaattttcttttcgcgacctaaacatgccctaaattttctttaccttttccctccagttcgaaggatgcatgaatagtaactcgatcaattctgtagtaaccgagacctccaatcctagggaaatctccaattaattttcctttagaattcctccgatcgatctaaaggaggcctaatatcatgcaccatcctagctatagcatggaatgcatgttcatgaagacatcgatttaaaagcttaagtttgcacatatttacaaattacaataggttttcatatacttgacattaacctgtccttcacgacgctagctaagctctcatcacgcacatacatgcatgaataatatatatccacacagcacagatctaaatcgttgcgatccaaaagataattaggagaactcgtcaaatatagggaaacattcgatatatgaaatcaacgttcaaatatatatatttatgtacttaaaaaggaaggaaaaacaaacagatcctcaccgcttggtggagctagcaaccttggtgggcgttggcgcggaggatgatataatacggcgtgcaagctaagctaggcacggctgatcagtgagcaaaatcgatcgtcgaaattaagctgggcctctgtgccgggtgtgtatatatagagtgtacgtgtgttgtttctggttcggtcgagttgtacccccgtaccgagaatcgtaacgagcgatcgcttgcgtgaggaagtggatagcgattggttggtgggcctctcttcccagtttccactagttcctacgttgcttttttttttactgtattactttcctatttcagtaagtttatatattttaagtttacacatttaaagtttgtacggttaaactttatacacatagagtttatacgatgaaagtttatatactggatttaaactcgaattcaaatttaaatatattttaagcaatcggttggtgggcctctctttccagttcccacatcgctttcttatattttggcaccacattaattttctattttagtaagtttatatattttaagtttacatatctaaagtttgtactgttaaagtttatacacataaagtttatacgataaaagtttatatactcgatttaaatttgaattcaaatttaattatattttatataaaatatttatatacacatagtttatatgtacaaagttagcaatgtatatgtatatatatatatataaagtctatgtaaataaatagtttttagtgtaatatatttttcattctcttttttcacacttattttcaaattgattttaaatttacgaagaacccacgactaatcgcctaacgtcgttgccttttttttttttacgtgaggaaaccgcgtgcgggcgtgatttctgatcgttggcctccggcgccagcgatcgttcgcgcagtagccacggccagttgtaatgtacgagggaggggagcatcgaatgagagacgggggtaataattactagattaattagttgaccaaaaggcatggaacgagacgggagtaataatcaattaacgcatgtgcgtcagcaccgtaagagcaagtttgaaagtatagcgactgctaactctaaatcatctatagtcaatttaatatgtaatttatacaataattaccattataaatatataatcctacctaccatatacacattgtatcttagagtctatactatagatgagtataaatttgtagcccgctactcttctcccctattttatcctctcaacatttgtttatagccactactgtacctgctctaaggttgtgttcttcacccttttttctcaactcacatctatctttttctgcgcccacattttgtaaaatgataaacggtattcgccctccgcaccagaatataagaagttttagagtttgacacaggtattaaaaaagtaggtagaagtgaatggtgcagggttgtgattggatgagtagtggaggtaggtggcaaaagtgaatggtggagggttgtgattggttcggaagacaatgttaatggagaagttgttatattttgggataaatcctgagggctaaaagttgttatattttgggacggagggagtatgttttcctaaaattttctatggtagagttgctttaaaaagtcgtgttaatccatttttcatgttttcttttgactggaaatttttcaagtcttttaagctaatatttaattaatctcgctctaatcttctcctcccgaactcagccagtcagcctaggtagcatatctcgcccaagcgtattactaagcccgcgtttagcatgtactctctccgtttcacaatgcaagactttctagcattgtccacgtacatataaattttaataaatataaacacatatatatgtctagattcattaacatctaaatgaatgtgggcaatgctagaaaatcttataccgtgaaatggaggaagtaacttattataataacaaaaataatgtaaataactaagagtccaactgaaagttttaaaatattaaagtcgaaagttctgaattttgattgtttcgacagttgaattaaaaattttaaattttgagttgacagttttaaaaattcgagttaaattttcaatattttaagtaaaaaaataattttttttcaaatttagaaactttttgttgaaaaacgtcttataaattttttctcaaattttacaagtatttaaaaataattgtagagtttaaataaaactcaaattaattaaaaattaactgtgaaaaaaatgtttaaatagctttcatttattgtaaactgcttaatataaaaaaaaacacttaaagaaacgtttgcttcgtatcaggccctcaacacaaaccagcgcgtggcaacgcaagatttagtttttccggtcaagcacgacggtaccaggctagaattaagttttgtgaatgtgcaaacatccgtgttgtactgtaatttgttctaaaggaaaataataaaaatgaaaaaaaaacaagaagaaaaagaagggaaaatcgctctcgcggacagcatgttcgccgtcaagcggacggtcgatcgaaaggtacgtaccgtagaccgtgactttttttgtacggagggagcaggaaattaatatttgtaggcctcgacttgacttcgaatctttaacacgacccgcgcggcttcgcggaagcttcctcactgagtaccagtagcaatgtgggggcacattacatgtgaacgttttcctggtgtcttggcggcagtgagccgcgaagccgcgtggtcaccttgacaaggccaagtggccaacacgccgcgcccatgctgtcacgtacgaggatgattcgcggaccggcgaggcggcgacgcggacttccttgcctcgccatcgacatccgccgtgtttaggcctggtttagttactgctctaaactttttccttaaacttttaactttttcaccatgtcaaaacttttctacataggatttatttaagggctgtttgatacagctccaactcctaaatattactccaggagttaggtctggagtggagttatggagttgcctaaacccagctccataactctaatatattttatgagagagctccacccaaacagacccttagttttaatagagctgaaactgtttggctgagctccagctccaggaggggtggagctgaagctgaagatgtgccaaacaaacccttagttcacatcaaaattggaagtttgattgaaattggaatgatgtgacggaaaagttagaagtttatgtgtgtaggaaagttttgatgtgatagaaaaattggaagtttgaaaaaaaagttggaaactaaaccaggccacacgcaaacttttaacttttccgtcacatcgtttcaattttaatcaaactttcaattttgggtgtgtttagttcacgccaaaattggaagtttggttgaaattggaacgatgtgatggaaaaatttaaagtttatttatgcagaaaagatttgatgtgatggaaaatttggaaatttgaagaaaaattttggaactaaactcggcctttggcgtgaactaaacatatccttagattcaaaattttttcttcaaacttacaacttttccgttacatcaaatgttagacacatgcatggaacattaaatgtagatgaaaaaaaccaattacacagtttgcatataaatcacaagacgaatcttttgagcctaattacgccatgatttaacaatgtgtttctacaataaatatttgctaatgatggattaattaggcttaataaattcgtctcgcagtttacagcgaaatctgtaatttgttatattattagtctacgatcaatactttaaataggtgtccatatacttggcacacaaactcaacacagccatcgaagaaaaattttccattgtaacgtaaaaccttttttcttttaagaaccatagcgtaaaacaggtccgccgatagcgtggcattcgccttgcaggtataaagcggaacagtttattagcgtgtgattaattaagtattagctattttttaaaaagaaatatattaatttaattttttaactaactttcgtttagaaacttttaaaaaaatatatatcgtttagcagtttgaaaagctgaaaataagagagagtggttggaaaaaaaaaaggcatccgaacacaccaaagtaccgcacggggccggacaggggcgtcatgcagcagtggtccaggcggtatatggtcgcgacgtcgcaagcgcaggcgagcgcgccggccaacttgcagcgcgacgactcgtccctcctgcggagcaagagggtggtgcccggtgccgtggtgggcgatgtcggttgcgccgcggacgacgactttgcgcgcggaagacttcgaaaatgtgagtttttcttttctttttctttttttaacggtgggagtatagcactagctgttgcgtgtgtcacaggcccagcggcaagctatagatagccggagttgcatccatatctagagcacccaagtgcaagttttgtgttctgtacgagacaacttgcccttcttctggtcctctcaggtctcagcaggttagtcaatcgcgagaactgcattttttcccctcttccatgcatgctaatcaagctgatcttctagctttatcttctagatagcctcgccatttcttttgcatggtttcccctattttttcagattgatcatgcgagaaatccgcatccacacttttttttttgtttttctcatttctcctagtcatggcatcatgggtacaatagctccatcgtccggccttcattgatgtgcgtttcaaaaacaaatatgcatacaagtaccctatgagattgagagtgcaaccgtgtgttatcaattgtttaactatatacttcctctgttttaaaatgtttgacactgttgactttttagaacgtgtttgaccattcgtcttattcaaaaaaattaagtaattatttattttttttgtatcatttgattcattgttaaatatacatttatatacacatatagttttacatatttcacaatttttttaataagacaaacggttaaatatgtgctaaaaagtcaacggtgtcaaatattttaaaacagagagagtatcagattatccccaacatgtagttatgagaatattgctttgcaatagttatgcttacacactttatagaaggacagtaggagataaatggatgacaaggagaacacgttagagcatgcaagagtgatgcccgtggaccttacatacaaaaagttagaagaaattacaaatggtttctctgaggagcacaaagttggcagtggtgggtatggagttgtttacaaggtatggttcatacttgtatttctatttttttgtaagtaatacaatatatactaccattaatactgggccaccagaaccctgatgccatatatgaaacaaattaaagccacttcatcaaacagggagtactggaaaataacacagagattgctatcaagaagctacatcaaatggtaggactggacgatgtgcaatttaagaaagaatttaataaccttatgagggtccagcataagaatattatagggttagttggatactgctatgaaatacgacacaaacatatcaaggtggatggagattaccatttttctagaatggaagaaagagcactttgcttcgaatatttgcaccgtggaagccttgacaagtatctttctggtatgacatgcatacttctcaatctacatggactatacatgtactattttgtaggtaagaaatagtagtgccttgcatttacatatatcatatggtactattatttttgtttataattatacagatgaaacatgtggacttgattggcacacacgttacaaaataatcaaggggatttgtgagggtttagattaccttcacatggtcgtccagaagatcaaattgttcatttggacttgaaacctgctaatatattactggatgagaacaaaatgccaaaaattgctgatttcggtttgtcaagactctttggttcaacacaaacttttacgacaagaacttttattggaacagtgtaagttatgcaagttgattcattgtgaaagttccattgatttctatacccttttctaatcattaacaacatgcagtgggtacatgccgccagaatacattgagagacgccatatctcaatgaagtttgatgtattcagtttgggtgttataatcatagagataatggcaggacaatcgggccgttctacaagtgctgaaatgtctccccaacaatttattgatactgtaagaattgttttttttttctcaaactttttatcattcactttctactttctgctttattattcactttggatttgcaaggtacaagagaaatggaaaaagaggatgcaggaaatttcgagtcatacatcatcacatgaggcagatagcctagaagtcaagacatgcatcgaaatagctgtaaggtgtgtagaacccgaccgaaagaaaaggcctactctgagggagattattgataaactgaacgagttagaaaatgtgaggaaggcacttataggccaggtaacgtgacattcgccatcacgacatcgcggttatgtctaattcaccagaaaattgcgtattttcctcctttcttcagcttatgacttaaatttaatttgtcaaattatgcggactcagcgtatataatgaacttgacatttactaaggaagaaattaaaacaatgctaggatacatttgttgattggtagctaaatatttaagtaaggacttatttggttaatctcacccacaccgcaagaggattgagaaagatttagaggggaataattccatatctattaaggccctgtttctttcagtttgggattattataatttagattattgagtcagattactataagctagattgttataatctgtagtataataagcgattagttatttctttcctagattattagagcctagattattgggtttgcaagtctaaagagggagtggggtggcatggtgggtaattttgcacccaataatctagaaaaagctcacctaaatgagcttatcagattataataagctgggctccagattataataagctgggctccagattataataagctatagcaataagttgtctgtttctttcagcttactccaaataatctggattataataatcccaatctgaaaaaaaacagggcctaaggtgtgaatttaatcatatcccctcaatccactccaactcctcccttattagggcatgtacaacagttagagataatatggtttttaatcattaatgtatccaaatactttttttttctcttctttcctttctttcactatcatgcaacaaaatttactctaataaatgctaagagtcgactctgagccgttgtcatgcataacaaccatactcctttctctttcttccatgtcatcaaattacttgcatggcaatagagagagaccactaataaaaaccgttgtacatgcacttaggattaactgaaaaaggcctaagagagattctggcaaggttccacattttgttactcagttttgctaactcactaatagagaaccgatctttcgtagattaaaaaccggtattaaagttgctttactaccggttctaaaagtccaattccctataaacaactttagtctcggttgatgttactaaccggtactaaaaatgcctccagagttaggtcaaaaggaaaacgtctctattcaagtcagatgtgtaaatatagttggtgagatggttatacgcgtgagagataaggtgagagatcttgagtttgaatcctacatcccacatattttttttctcttgctatatgcatttttagttttaaccggtactaaagatcgacatctttaatcccaatttgctcatctcggttgctaccaccggtagtaaatgtggttgtaaaccgggaaaaaaaacgtttcccctgtagcgactgtataaactacgaagtgacaagtgactgaataccaaattaagcctagacacagggactagtatgtatggcaagctaggtttcttcttgagtatatagtatgatccctctgatcgttgtgacagagctcagctgggtgtaaatcggagcgccttgtgatcgaccctctggaggtgcgcttcccatttgagaaggacagggatgtatcctgcgtgctgcagctgacgaacaggtccgccgatcgcgtggcgttcgccgtgcaggtggacgagtccaagtaccgcgcggtgccggacaggggcgtcgtgcagccgcggtccaggcggtacatcgtcgcgacgtcgcgagcgcaggcgagcgcgccgaccaacttgcagcgcgacgactcgttcctcctgcggagcaagagggtggagggcagcgccgacgacgactttgcggaagacttcgaaaagctgatgggcaaggcggtggatggggagacgatgaggctgccggttgtctatatcgcactgcctctacctcctagcagttaagcgatttatacgcagctgtctgtcctcatgtatcagagatccgctagctagtccgaataatgtccgatccgtcgacatttgcgtcttaacagcctcgtgatttatatatatgacttttgtgaaactaggaagatagcccacgcatatgtgcgggcatttgtttaatgtgtttatgtgcagttggtttttttattgaaatatcatttatactctattcaaatttatttgagatttctatgaatgttggttatgattttcttctagcttgttacccttgcaacataaaaatttggtaaaatttgctacgggacataaaaaaagtgtaattagccaggggataccggaaaaatatgtatttgctggagaacaaaaaaaaactggtaattagctgctggacactcgcggtattattttattatttcagaagaaaatagagagataaacagctgtggaattacggttttacccttcaatccagtcaagtttcactcccctgtgggacacaccagtcagggatctttttttactttttctctcctattctactccttcctttcttcttcatgtcttcttccacaatggcctgtacctccccatgaccccacccatcgcggctctcgtggcgccaccgccggagtgcgacaacacgcaggacctgccccggatgttcgtgttgctcaccccgaccgaatgcaacacgtcgctcacctacacgcagtggaaggaggcggacgcctccatgcgccaccgactctcgctcaatgctcgtgccgtgctcggctacaccgcgcagaggatctttgcgcggttcacggcagtcaccaagctcacgctcagctgcgtcggggctccgggacagacagcctctccgacgacgcggcatgccaagtggccatcgcattgctgtccgagcggctcgccaggctcaagctccgtggcctccggcacctctcggacgacaggttcgcgtcgctcgctggggccacaccggtgatccacaagttgtccatcgcgtccagcagttttgggccctaggccttcgtggcgatcctccggtcgttcgtgtcctctctgtcaagcgttcacggcgtccggctgggagcaagagctagagagtggagaccacgacgagcggccaagcattggcggtggcgtgggagaggcccacgaggccatggatgcagccggggctggagacggcgaggagcagactgggggagccgatgaggaagggagttggtgaggaagccgtaggggcaaacttatctttaatggatatttctccctctattttctccggaaataataaaataatatcgcgagtgtccagcagctaattaccggttttttacggtgtcctccggtagatatgcgttcttgcagtgtctcttagcttactacacttttttaaatgtcctgtagccaattttgcctaaaaatttgttaactaaaattgcgtgaaagcatgcaattttgaatttataagaaaatattgtgttattacaatgaagttggtttctatgaaactatatatattttgtactatgggtatttctatactttaagtaatactacctccgtttcacaatataagactttctagcatcatccacattcagataaatgttaatgaatctagactcatatataagactttctagcatcgtccacattaatacagatgttaatgaatctagacacacatatgaatctagattcattaatatctatatgaatgtgggcgatgctagaaagtcttacattgtgaaatggaggaagtaattgcttttatgctatctatgtctttgtggattttaggataaattaatttaagattttctattaaacatatagctaatagaactatgtcatataattaaagatagattatacttcgccgcataaatgcgagaaagttaaatttagcatgcagtagtgactaattaggtggaaacaaaagggggcggcgtctagcaaaatctagcatgtagtagtgactaattaggtggttcaggctctagtagaccaatttggtcccacattgcatattttctttagataatggaatagaatcctagcctttacttaaagagttacagccaattattacgccaattcgaccaaacacaaaacgcaacacaacaaaccataaaaacacaagcgtaatagaacaggagcacacgaaaactactaaaagtcaacacaagaaaagaccacaagattattgaattttatttgtgaattttcatccgaagttggcaaaaagatgcataaccattgactcaagattacaacctgcagcttttattagcttgttatctacattacacttttgcagttgagcctaggactggagccaatgtgtttcctaaaaagaacctgcatataaaatatagatggtgatttatcaaaaccaaattatttctactgaactatacagcccaacatatattggatgttcctaaaaaataagtttactggttttttttatcaatccccataagcctattctaaaaaaataagatatactaagtggaatatttaaaccagaagaaaactatagtgctctccaaagaaattttgcttaatgacactccataaataaatgatggatagttttatttttcatgcagaagcaatattttaaactatcatgccaattcctcctagccaagttatcctttattaacacaaccccttttaacaggtgttatataaaaatcttaatcttaagaggcatcctaattttctaaataaactcattcttctcaatgtagccattattaattaaagctaagtacatagaacgaatcgagaattgaccatttttatgaagattccatctaaaatatcattctcctctgtcaaatgaatatgcacaattgaaccacacaaattatgtaagttagtcaggttatgccctactagagctttctaaaaaaaaatattctgtgaaacataacacataatatttgcaaccgaggagtttctgcttcgaactatagcatataaagatgtgtatctatcattgaaggtatagtttcctacccattgcgtattttatcaagcgaaaatttgacttcgtctttttcatcattgagacggggagaaaaaagaagagaaacctagctatctgttcacctatttgttctgtttcgtgttgatacatatgaggacgataggaccacccaacaattaattaactcgactagtataacactaccagatatcccctgtttattaggttaggtgaagatcaaaaaagcagtaggaaaacagtttcgctaccaatcttttgaacaagcatgattgcaaagacccaaatgactcgtagaacagtctacccttgatgttacaaggcagctaaccaccagaattaagacgacgaaatgcaaagacctgatcgtcgaagacccgaaccatattcattgctaaacctggtcgtcgcttactcgctttccatgtctcgttgcaattatgttgggtgccgagaaaaaacttgtgcacacatatacacatggcctcctccggttaacgccacaaatcgccaatgtacgtagcggcaaacaccactcaatccatcgcacactagctagaacacaagaaaaatctcagccccgatcgatcgaaatccatggcgttccagttccacacgctactatcagccgtaacaatatggctgggcgtagcggctgctacggcgaggctccatgccgccgtcgccggagcacgagcgccgccgccgccgccgccgcccggcaactgccaaaggaagtgcggcgacgtagacatcccctacccgttcggcgtctggaacggcagcgagtccgacggctgcgccgttccaggcttctacctgaactgcgacgtcgacgacaaccacgtctacaggccgttccacgggaatgtggaggttctcagcatctccctgccgaccgggcaggcccgggtgacgaactccatctcctccgcttgctacaacaccagctcccgcgacatggactacaacgactggcagatcaacttcaccggcacgccgctgacgatctccgacgccgacaacaagttcaccgtcgtcgggtgccagacgctggcgtacatcaccgacgacgacaacatgggcaagtacacgagcgggtgcgtcgccatgtgccagggaggcgacctgacgagcctcgccaccaacgggtcgtgctccgggataggctgctgccagacagccatccccaggggtctgaagtactaccgcgtcaggttcgacacgggcttcaacacctcggagatctacaacgtcagccgctgcagctacgcggtgctgatggagtcgaaggccttcagcttccggacgagctacgtgagctcgctggaatttaacagcagcaacggtggcagggtgccgttggtggtggattgggctatcggaaacgagacttgtgataaagcccgcagaaaggttgacacctatgcatgtgtcagccacaacagcaagtgcttcaactcgtccaacggaccaggctacatctgcaactgctccgaagggtaccaaggtaacccctacctgcaggacgggcagcacggttgcacaggtatgaaaactgatccatttaagggtgagagaggaattgtatacgtgaatatatacacataaacaaatgaatcacatagccaagtgagaattggtgtggatatttcttgattttaaatgcttttacggtactcatttactagcagaattgaaatatataacagttgattatcataagcatttaaaaagtttagccaatgcaaggtaattaacattcatctactgtaatttggaatgatttttcaatttaatttattattttattactatatatttattttaagttcaattttaccactttaaaatttgtactacactaattaaattttgaaatatactttatcacaattttacgggaatttactagctagattaaaaaatatttaaatatacccgattcgcctcgagaaggtgacacctggaataaattaaaaatatatatctatctaattaacttgtttagttgtaatatcaagacagttaagatgtactatatttccctacactttttaacatagcttatgagagaaaacatgcatcagaattttttttttgcctttatcttttgattagtttagtatgagtcacagaatctgaggttcattatattattaatatatgattaatacacaaaacatcacaatttcccacaagaaaatcatattgcccatgtatatatgatagcaaatcactgtttatttttacctatgtttgattaatgcagatatagacgagtgtgcggatccgaagtacccttgttccgtgcctggaacttgccataatcttcctggcgggttcgagtgcttatgccctcgcagtcgtcccaaaggcaacgcattcaatgggacatgcgagagagatcaaacccttcatactggaggaaaagtagctattggtactccattatcctcgcttatcattccaagttctttttccttatccaaaaatcagtagctaagattttccttatgttaggccatagcatccacatgttccacaccagtttatatggattctccacaaaagaaaacaaaaactaattttaatctgtttgattagtcatggaccccaaccgatacgtcactctcagaacttttcagaaaaagaactgaaagtgtaactacatagagttctaaaccgttagtccgttacatgatgtcgacctgtaattaacttatttatttggaataggaagatgattgcatccccgcctttgcatttaggatgtacagtacacaagcatgcagtttaattttgaaagttttttcttaagataaacagtatctgtatatgcagtgctgaagcacttgtttcaattcaacctttagtctcctttacaaatattcatttctgcaggaatttccggttttgctatcgttggcctcgttgtttttcttgtacgagaagtgatccagcacaaacgaagtatcaaaagacaagctctgcagagacagactgacatgtattttcaacaacacggaggacagatcttactagaactgatgaaagtagagagcagcgctgagttcaccctctacgacagagagaagatcgaggtagccacaaacaatttcgccaaggagaacattgttggcaaaggagggcaggggaccgtttacaaggctgtcctcgacggcaccactgttgcgataaagaggtgcaacgaggttgatgagagcagaagagccgacttcgtgcaggagctggtcatactctgtcgtgtcaaccacccaaatatcgtcaaactagtcggctgctgcctgcagttcgaggcccccatgctaatctatgagttcgtgcagaacaagacactgcaagagctactggacctccaaaggagtaggaagttccacgtcacactggcgacccgcttaaggattgctgcagaatccgccaatgcacttgcacatctccactcactgccgcgcccaatactccacggcgacgtgaagccagccaacatacttcttgctgaaggattggttgcaaaggtgtctgactttggttgctcaacgattgatgagaaaacccaagctgttgtaaaaggtacaccgggatatctcgacccagactatctacttgagtaccagctcacagccaagaatgatgtatacagctttggggtcattcttcttgagctcctaacgggtaagaagccactttcaaaagaacggacgagcttgatcccaatatttcaaggggcaatggaaagtggcaaactcgttgagctcctggacagtgacatagtagatgaagccaacatgggagttatctgtcaggcagcatcactagctagtcaatgcttggctaatccaagttcatcaaggccaacaatgaggcaagtggcggagcagcttcgacgactagcattggcagatgaagtacaacaatgcccacaaccgccgctagtgctcgatggcctcatcctcacagagatggggagcacaacatcatcatggtacacaggaagtggaacaagcggggtttataaccttgagaacaatgtcgttctaagcacagaattcgctagatgatccatagaccccttgtgctttattgagtgttacaatgtgttgttttatctgtgttagattatgagttgtgttgttttatctctgtgttagattatgagttaattcttcccagttgtggtggttgacgggcttcccaatgtgtgcggctgtaaccatgcattgtgaggaacaagtgaaacaatcatgtttcacaatatataataattcaagtgcatcaaacacaagtagtggtagtcatagatcaaaacgaaattatctgcacaaagtttgagtttgctattatgagtcgaggtctagatcgtccagtgtgaagacaacaatcctgttgcaatcaattggtgaaaaagatttgatgagagtaggaaaacagaccttggacgcatgagatatactacatcccgttttcaatatatatccggctagagttaatgtaacatcctagcctagggcttaataggattactagaatactcatagttgcaacttcttttccggaagccgatttccaaagaactccagggttaagcgtgcttggcctggagcaatttggcatgggtgaccgaccgggaaattcttcccgggtgcgcatgagtgaggacaaagtgtgcagaaaagacatgtgttggtctgtgagggcagtctgtaacctatgaaagctatcagatgtaagtgggcccggcctgggggaaggcgggacgttacaaaatggtatcagagccgactctcgcggtttcacgggcgtgtgtgtcgcagttgcgcatggtctctcgcggtttcacgggcgtgtgtgtcgcagttgcgcatggctggtgtggatccggagtggtcacacagcatggcacatgcgctggcactggacacacggacgtggccaagaggggacgttcctggcctggggttgatcgacgggggcgtcgatctctcttaagggggtgaggatgtaacatcccagcctagggcttaataggattactagaatactcatatcaacaagttgcaacttcttttcaggaaaccgatttccaaagaactccagggttaagcgtgcttggcctggagcaatttgggatgggtgaccgaccgggaaattcttcccgggtgcgcacgagtgaggacaaagtgtgcacgcttaacctggagcaatttgggatgggtgaccgaccgggaaattcttcccgggtgcgcacaagtgaggataaagtgtgcagaaaagacatgtgttggtctgtgagggcagtctgtgacctataaaagctatcagatgtaagtgggcccggcctgggggaaggcgggacgttaccattaaccaatggattccttctcgtattgctaaaagttgagaatctctttatggggagaagctatacaggttaacagaagaaagtaaggcacaacctgcttttcaactgtcacaccctaaaaatcgctaaattataaattgttgtgaaaaaggaaatttttagaaattatttaataaataaagtaagtgtttgaataaaatctatgaaaaattttaacattaaattgagctagataaaattttattaaataatttgagtgtccaagtattttccggatttttcccggaattatttgagcattggaagtatttttaacaaatgaaacatcatttcagcaattatttaaaataaaagttaattgaaatcctctccctagtcttgggccgaattcggcccacgcctctcctctctcccatccttggcccgcagcccctctctctcggccgaagactgctttagcttcttcctccattccctctgacgcaaggggcccacccggcacagtgccgtcttcctccttcagccggcctcccgtcccgtgccctcgaatttcgtctcggttcttatcccgacgaactcgggataaactctaaatttccgccgccgtttcctctcgaatgcgcatcgatctcttcctcctccgcctatataaaggatgacccaggtctcctcttcgtttttcccctcttttcccatgctgccgtgccctagtcgcctctccctcagctcgccctctctctccaccatcgccgccaactccagccacgccgcgccgcccctctggtcaacgcgggcttgcgccttcgcctccctcggctccgcaaggccgagctccaccctggccgccggttcctttgcgccgaaaccccgccggaagctttcgtcgccatgaaccagtgggtcgccgccgtgtttcgatctctagccaccacccaccgtggactccatggtcgccagaccttgtcgtctcgtcctttggcatcacaaggaccccgggaagcccgtccaccccttctcctccgccggagttcgctggaacgctggtgtcgtcatcatcccgaacctcaccgccgctgtaagtgttggtaagcatcgccgtgtcctcctcttcctccccattctataggcttccgtcgtcgtgccgctgttcgccgtcgccaccgccaccgctgtccagagccaccggcgtcgatccagcgtggctgtcacgtcatcgccctgttagccgccaccgcattgccacgttgtcgttctatccacatggcatctgcgccagcgacacgtgtcaccacgtggccgctatcctaaacgctatattggatttgatctcacctgtcagatcgtggtcaaaggcctgtcaaagcaatcctagccatccatcccgtggacccgtgaactatctttgtggacttggttcatggtagacccagtctaccgcttgtatctatgacgagtgggtcccatctgacactagccctttttctctcttcctagggctgacgtcatattcctcctttatcacttctaaaataattaaatatgatgtcataaattacttagttgttttctttataggttttaattgattaaaacttcattaattcataactaattcatatgaacttggaataaggtcgttcaagtctcaagatctacctatttatgaactttcattgtactgtttatttggtttttattagtgttttacctcgttttgcgttctaggtttagttttcagtcgtttcggaggctcgttcatccattggagaagttcctgaagacgaattgaagacgcttgtttgcaaagcaagtcacacagatcctaaacacaatcctttgagtatattgaacctatatttaaattctccatttcattcaaatgtgcatttattttcaaatgtcatcgggatgtgagccttttccctatattaaggcataagatgactttattttcctacgggttataatttgactagcttgggccttacatatttgttcagctagatattagatataattgcttagccatgcttagaaacattagcacactatgggattcactctaattcagtccttaattatatcatgatgtaccgttatggtattgatttaattaaactaaatacgcttaaatggtgggttgtgggtgcatggtttgatagtcacaaccataacaattaacgtccgattctcgaaatctctggaagatatacctgtacttaccacatacctgcatgggctctaggctaaacttggagtgtagcttaacctagccaatgtaccaaggcaaggatggacgtgatggagtatggatgttccgtgctgcggtctatgctgcttccggattcacctaggcacaagagggggatgcccgctgccttttgaggagtgggggtgaaacctgaggtgtgtatgattggttaggaagggttatacaaaaggttctgtcacagtctctttcctgtatgtcgtggtggcatgttggcgcttggtaacgtgttgtgaggctgtgtcttgtgggtaaagttgtacacctctgatcaaagtaaaactattcgaatatccatgcccgcggttatgggcggtcaaccagctcaccgtgattattctcaccttaataatttgacatattgaactgagttagtacaggtggtttggttgggcctatgcaacgagtatgttgtatagcgttggattaataatgtttaattaattgctgtactattttacaaatacttaactctttgctaaatgctgctttcacaaatgaaccctatattatgccatcctttggtatccatatgtacttgcatacttgtcgtgtggcttgcggagtattccatgtactcaccttgcaataatcaatcaaacctcggttgaagaaagaggatccagaaggagaagacctttggcttaaatcccagttgagctgcttgtgggagtagtgttgaaactttgctagattttatgttctgctgtagttttctccgtggtaataactaagtacctcttatgtaagtatttatcgcattagttattatgatgaatctgtatattaagttgtcagtttgtgtacctcggttgattcctggacgaggatttaatgcacaaattagtttgaaaattacttatgaatttttgggcgtgacaagttgacatcagagccatctcgattgtaggtcaagccaaacggttaaacccataaggacatgtctttgccaaaacaaaaagtgcatgtttcgaagtcaagatggaggcccaaaccaagtcgatttcgagtacgtttcggagtcgaggaccagtatgcactaaaatgggcgcccaggtcgcattcatgcttggattggggcgttctttatgcagatggaaagctaagaaaataacctttccaatggttctagtcccatattcaaattctttcctagtcatcgggaatcgagcgagcaagttaacgtccagaatctgttccggtactgcgccgccgtatttttgcctttcggccgcgtatcgtgttggagcccattagggtttgcacgaccctaaactttatatattagtagcagcctccacctttagggtttgggttttgcttacattaatatgttaagaacagtttcatcgatccttcggtttgtaagacctcaacttgtgagcttaatcattcatatacaatttggttgtattctttcttgttctggtgtgtgttcttcgatttgcaattagggattagccttctcagcgaggccaaccgggtttcgacacggttgataaccagaggagacgtggtgctgcgattacggggctcaagagcgtgttcattcagaagccggatcaatttgtgtcgcgactccaccaaatcgactgtttatcacaacatttcggaagatcgggtaccctacatccacatcaagtggtattagagctccaggttatactaaattagtttttgttttcgccgtaatcctagagtctacagaaaagccaaaaaacaagtgtagtcattagtttcttcccatcccagacagtgtttagcctttgcataattctttttcagagtctgtagtgttgagttttagtcctagtttaagtttttgttgctggtttagtgcgtgttttagtctaggcttatgcgccatggattggatggcaaggtcgatcggttctgatgacgtgtagcagatcgatcaaaggtagagcccgactgggatatggattggattcatgttggatgagttttgatattgtcctactttgagcaggagatattcggtataaatagggagggagactatgccttgagtaaaaccatgtttgagagattagatagggtttcgtgagaaacttgtgaggggtgctaacgtgctgtggctgcaccctgtgaacaatacttgagtaataaagaacatattcaatcatcaaggcatcgacgatctcttctggtttcttaagttttacattattgttcggttttggcattaacttgtgagtctttgttttgctgcaattttgttcaagttaatccatccaaaacctttataatacttcatagatcaaatctgcaaagtttcgttgattgattcttgttagattcgactttgcttaagttttagggtttgttcagatttactgaaattctgagacagctggcttttgagggtattttctcttaaaccgtttatcagtttgcaaatccctccggtggagttgttccttggtttgtctagtttattcctaggctgacggttcgaccgcgagaggacctgtgttcagaccgatcctaataggtaggatagaccatcggacgtgtgttccattggtttttgaggatgtggcgtgttttgatctatcaagatttggatatttgacttgcgttgaaataatctaccattcaccccctctctggtatgcttgattacttgtgttcgatcctacagctgctgcagcttgcttaacatccattgcagctaatgctgggctcctgcattgggcaagattttgggatcgatttggggctagggttaagaaggtcagccggggtattttgatccctacgaaaatacacagtagacaaaaaaaatgattcatatggcgtatcaggttatacatatcatggtatggatccagcttttataatgttgaagtggcatatcgttccaatctatctattatattattaaaacaactttgaaaggaggcaccacgttcgctgtgagggctagtaaatcccacattaatcggagaaaaagaaaaaaaaaagaaaaggagagtccaagtagaagtacaatataaaaatagctgaaattcggaactaaaaataagtaatattgaaagaagtttccatatatataagaacccaatacgagattaaccataaatcgaaataaaaataaaataaaatctaaaattagaaaaggaaaggagagtccaagtaagaatacaatttaaaaatagctgaattcggaattaaaaataagaaatattgaaagaagtttccatataagaatccaatatgagattaaccaaaattcgaaacaaaaataaaataaactctaaaattagaaaaggaaaggagagtccaagtaagaatacaatttaaaaatagctgaaattcaaaattaaaaataagcgagattaaccaaatttcgaaataaaaataaaataaaatctaaaattagaaaagcaaaggagagtccagataagaatacaatttaaaaatagctaaaattcacaattaaaaataaacaataatgaaataagtttccatataagaacccaatacgagattaataaaaattcgaaataaaaacaaaataaaatccaaaattagaaaaggaaaggagagcccaagtatgaatacaatctaaaaatagctgaaattcggaattaaaaataatgaatattaaaagaagagtccatataagaagccaatatgaaattaattaaaattcggaataaaaataaaataaaatccaaaattagaaaaggaaaggagatcccaagtatgaatacaatctaaaaatagctgaaattcggaattaaaaataaggaatattaaaagaagagtccgtataagaacgcaatacgagattaattaaaattcagaataaaaataaaaatgaatccgaaattagcaaaagaaaataaaataagagttcaagtaggaatacaatttaaaattagctgaaattcggaattaaaaataaacaatattgaaagaagaatccatataagaatccaaaattagccgacggttgacgggacttctagaaaataaataaaatgaattccaacgatagttatgtttgatttttagaatcacaatgacaatgaagagtaagtggcggacgggttgtacaggggcacagtggcatcgtttgatgagacttctaaaaattataaaaaataaaactacaagtccaatttttaaaggttcagaacttctaaaaagtaaaaaaaacaattataatcatgtttgattttaaaatctcaatgacaataaagaagggaggcagcgcgcgagctgtagaggagtacaatggtaaagccgcagactgtttggcgggacttctagaaagtaaaaatgaacacaaacgataatcatgttcgatttttaaaatctcaatgacagtaaagagaagagacggtggacgggccatagaggagtataatggcaacaattgacgggacatctagaaaatatataaacgaaatccaacatgacaataaactctaaaaactataaaatctaatttttaaaggttccaagaagaataaatagaaatagtgatagatcgagtaagcaaataaatgagatgacataaggagtagcgactggtgtgacttttaaaaactatataattagaaacacgaggatgataaggtttggtcttttaaagtcttaagataatgagatagctatttaataaattttaagtaaaatcatattaaaaaatatatgattttgtttgggtgctagccgcgcaattgcgcgggccacccagctagttatacaaatactaatgatatttttcaaaacaagcaaatttacacacatgcaagaatccaattaaccattccatgtaatatagccacgtaaacttgtaattgaacaaatggatgcacgttccatcatgcaaccaaaaagacaacttgaaccgtcttgctcagatcaacctcattggctatacttctgcatcatccaattccgatctcgtgaattattgcaccaaagtctgaagtcccggccctatttcaacattgagtgtcgaattgtctatgggcctcattaagttgattccatcaacatcgatccatccatccaaactagagtagtattctgtaaactattggtctacggggtataacaataagttatttcaagcaacggtaaccatcactgatcaccaccgtgtttccaacaatgcatatattaatccttgtgcttactcggtcgtatgccgtcattagatgattcttcgatccaaaatatatattccactatcgatgacatagtcttgcgttctattttttctttgattgcatgtgcatacgacatgtataattatttttctttgattgtgcatacgacctgtaattatttttcttttattgtgcatacgacctgtcataattaattatttaaagtgcagtatacaagctatgttgtttgttttacctactaaattatggaaggcacttttaccaagacattgttaatatcccacaaaattttcgtacaatggaacatttcaacagttgctacaagaagatgcatgcatactgatcaaattaagatgcaaaagcgactttgaccggtcgcaggtctttggaccaaattgttgaaaatggtcagtgtgccatacagaaacgtagcactgttcatgcacgcatggatgatcgacactaatattatacttttcgcagttaaaagcgcgtcttaattaattacttgcgatgaattgatgtataacataactagtattccccgtttcacgaagtaagactttctagcattgccatatttgtctagattcattaacgtctatataaatagcactactacagaatgagtttttgcaaatgggcgaacacgattttcgcatctggttgggccatccgcatacgcgaaatcgtctgcaaagatcgtcatctttccatgcggccagggcacccgcaagcgaaaatccaattttcacatacgggcgcttacgccgatcgcatgcaaagagaaaaaatagggaaaaaaatttcaaaaacaacaaccctagccgcaagcggcgccaccgccgcccgatcccgccagacgcgcccgcctcctgatctgggcgggatgaggcccgtcaccaccgcccccgctcctaccgccggccgcacccgccgacgacgccccagttccgccgccggccgctctcgcctccggatctgggcgggacaaggcccgccaccgccagatccaggcaggatgaggtccatcgccgccggatccgagcgggacaaggcccgtgtcgccgcccactcgtcatcgtcgtcggggtcgccccagctgcccccacttgtgtcgtcgtcgtcgtcggggtcaacccctccttgtcgtcgtcagggtcgccaccgcggagggggcagcccgagcgatggggatgacgtggccgccgcccgccacgcgacgcgccgctctcggctgccggcgcccgcctctgccccatccccacctccgccctgcgcctctgccccgtctgctctatgccgtgagagagagagagaggagataagtgtgtgtgagagagagactcagtagagagggttgtggttggcgtaaggataaggttggggttgaaaacttttgaactgtggagagggaaagagccgacttcatttttacatgcggaccacttaaggatccgcatgcaaaaattagttttttaatttttaaatcaaatttatggcactaaattaattcttatgaaaatgttgttaaaaacaaagttgtagaactcattgagatctaccatttttctttaggttatttctccatttgaatttgattgaactatataaaatatgaattttaaaatataagaatttcaaataatttttcgagtagtaaatattttcagataaaaaaaattgtcaacaacaaagttgtaaaatgcatcaagatctacaacttttgttttggtcatttttctatatgactttgtttcaacagtttgattttgaattttaaattatgacaactttaaacaacatattcaaatagtaaatgatttgaactgaaaaagtcatcaataacaaagtggtataactcatcaagatctgtaacttttcttttggtcatttttttcatccgataaaatgatttgtaacattgttcacagaatatacatatctcttatatagttttataaactataagagagatatgtaaattttgtgaaaattttaccatcactttatcggatgaagaaatgaccaaaatagaagttatagatcttgatgagttatacaactttgttgttgatgactttttccgctgaaatcatttactccttcaaaatagtatttgaagttttaaaattcaaatttttaattgataaaacaaagtcactacaaaaagtgcccaaaataatagaagtaagaacacaataacatgacagagtatgattttagaaacattaagggaaaagaatcatccaatttaggttcatatgagtgagataatctagtttcaatttttttcaaattttatttccgcagacggctacttaacacgcccgtatggaaaaattgatttttccatgcaggcgcttaagtgagccatatgcaaaaatgacctcatttttacgtccggacctcttatgagttcctatggaaaaatcgattttttcatacgggcgtcttaagcagccatatgcgaaactgccgctcgatttttgcagatgccactagttatggtccgtttgcaaaaatcatgggggtctcgtacagaaaaaacacttttgcagtagtgtatgagccatgctagaaagtcatacattgtgaaacaaaggaagtagtattatgtatattcgtgcgagatgtatactttgctttgtttatacatggagtatgtggtagagattttttgattatggcagtattcgttatgccataatctttcgttgggttttccacgcgctaccaagcgtttatatgtatacaaaatttcagcacagtatgaacgtaatataccagtagtgaaattccatatgtatgttttatatatatactcctagctaacacagcttctttcttgctttaatagttacttcctgtagctgatctcgcccaagtgaggatcctatcacaaacaactagagctctcacgtgaagataatcaatgtaggatttagggatttttcttctcgtcaaaccatatattacctttggcatgatcgtgtaaaacaacgtatgcgcatccactagaatgtgtattcctaaacccagttgtaaactcaataactaataaccaaattacaaacattgttcgtcaacccgtgccagctattattattgctatctatgtatctatctattatattattaaaacagctttgaaaagaggcaccacgttcgctgtggggctaaaaattcccacattaatcggagaaaaataaaaaaaagaaaagaagagtccaagtagaagtacaatttaaaaatagctaaaatttggaattaaaaataagcaatattgaaagaattttccatataagaacccaatatgagattaatcaaaattcaaaataaaaataaaataaaatccaaaattagaaaaggaaacgagagtccaagtagaaatacaattttaaaatagctgaaatttgaaattaaaaataagcaatattgaaagaagttcccatatgagaatccaatacgagattaatcaaaattcgaaattaatataaaataaaatccaaaattagaaaagaaaaggagggtccaagtaggaatataatttaaaaatagctgaaatacagaattaataataagcaatattaaaaaaaatccatataagaatcaaatacgggattagttaaaattcggaataaaaataaaaataaatccgaaattagcaaaagaaaataaaataagagttcaagtaggaataaaatttaaaattagctgaaattcggaattaaaaataagtaatattgaaagaaaaattcatataagaaccaatacgagattaatttaaatttagaataaaaaataaaaataaatccaaaattagaaaaactaaaagagaattcaagtaggaatacaattttgaaacaactgaaattgaaaataaaaaataaaaacattagaaaaacgtattaactaaaattttttaaaaaaattctgaaattagaaaaagaaaaataagatttcaattatgaatacaatttataaataactaaaacttgtgataaaaatagagaatattgaaagaaaagaccatctaaaacacatgacgagataaattaagtaataggcctataaaagagtagagtggtggcggttgatacgacatataaaaattgttaataaaacaccaaatagaatcctaatgacgattaaaaggagggacgtcaggcaggccgtgaagcaaacgagtaaggcggttgctgggacttctagaatgtaaaccccattgataatcatatttgatttttaaaatctcaatgacaataaaaaggagaagcagcgggcggggtgtataggagtatagttgcagagccgctgacagttgacgggacttccacaaaatgaaaaatgaattccaatgatagttatgttagatttttagaatcacaatgacaataaagaataggcggcggacgggccgtagaggagcataatggcattgtttgacgagacttctaaaaattataaaaaatagaactacaagtccaatttttaaaggtctgaaacttctaaaaagaaaaaaaccaatgataatcatgttctattttaaaatctcaatgacaataaagaagggaggcagcgggcgaaccgtagaggagtagaatggcaaagccgctgacggtttggcgggacttgtagaaagtaaaaatgaacccaaacgataattatgttcaattttcaaaatctcaatgacaataaatagaagagatagtgaacggaccgtataggagtataatggcaatgtttgacgggacatctataaattataaaaatgaaacccaacgtgacaataaacactaaaaactataaaatccaatttttaaaggttccaagaagaatgaatagaaatagtggtagatcgagcaagcaaataaatatggagatgacataaggggtagcaaccagggtgacttttaaaaactctataattagaaacacgaggatgataaggtttgctctttcaaagtcttaagataatgatatagccatttaataaatttgaagtaaaatcatactaaaaaatatatgattttgtttttggtgctagccgcgcaattgcgcgggccacacagctagttatttaaacaacaacagttcatact

SEQ ID NO: 28405 - DNA, 33795 bp, Oryza sativa
tagaatccatttatattacaactcgctaattattaatttcatctcaactcacatgggtccacgaccgatgacagaaacttttgaatgttttaagtagtagtgatagagatagagataaagataaagaagtaaagatagaaatagagattaatatgacattaaatttatttcttaagaagggtctatctcttacaatttgctaaaaaaatatttcaatttgttaataccacattaattttgaattctagaaactaaattagtgagtccatggtatctcgtatggcatgttttgtttaacacaaactctcgatacgatacgatctatgtgttcaaaaagatatatgattcatctaatcgatgaatttttttttctaattatgaaagcaaccgagaagtgcccaatgaatataaataaatatatattaggggaaatggtagtgcgaagactttgttgagttgcattcaagccgttgggtccttttcgtttatttaaaatttatggctggctagtgtccaacagtccaagtaagatccatcaggctccgctcctcttcatatactccctccgtcccaaaatgtagctatttctagcacagtgttttgtcccaaaatgaagctatttcttcacctacctcctcctctcaaccaatcacaaccatttttcttcacctactttctcttttcaaccaatcacacacttcctccaatcattctcacctactttcttaatactcgtgccaacctcaaaaatggctttattttgggacggaggaagtatatactagcattaattcgtcggactaaggtgcacaagtacgcgtacgatcagaagagaaacacatcgacaaataagttcatacttccatggcttcctatggtgagctaacaatatcatgtctcacggccatagctgttgctggggcggcgttgctcgccggcggcgcagaggcgcaatgcctgcacacctgcggcggcatagacatcccttacccttttggcatcggatctgacggcgactgtgcattgcctttttacaatatcgactgcaacaacaaaaaaccattctaccgagatgtggaggtcctcagcatctccctccagcttggtcagatcagggtgagcacccccatatcttcttcttgctacaaccccttctctaagaggatgtactccagcgggtgggggttcaacctgtcatacacacctttcatgctgtcggactccaacaagttcacggtcgtcgggtgccagtcattggcctacatttccgacccaaccagcaactacacgagcggctgcgcgtcctcctgcccgggtggtaaagtggtgagcgccaccaacagaacctgctccaggataggatgttgccagataaccatccccagaggcatggaattctgcaaggtgtcgttcggggagagcatgaacacatcgggaatctacgaacacaccccctgcagctatgcagcgataatggactactcgaatttcactttctcaaccagcaacttgacttctctgctagagtttaacaacacctacagtggccgagcgccggtgaagtttgactgggctatctggggtccccgagactgcgtggaagcgcagaaaaatctcacatcgtacgcgtgcaaaagcgaccatagcgtgtgcctcaattattccagtggagcaaaatcagcctacatgtgcaactgctccaaaggataccatggcaatccttaccttcaaggctcaaatggttgtgaaggtaaaatatgcctatagatttattctcatcaaagctacaagttttaaataattataggtatttcctgacagtaagtataatatagagttgtcatgtattgcaatagagtgtataaacagctatcttttttctctcaatatttaacggacacatctatacaattaatgaacccacttctggtatacaccctccgttctaaaatgaactaatgccttctgctacgagtccacattttagttattagagggacgtaggctttaaaaaatagcatagcacactgcttatttacccatctgcatttctcctcagattagagatgacaatggccccattttccgtggtgaattcacccattaggagcaggcatggttagaattggttcttcatggggacataaaggggaggaggcttgtccccgtcggttttcacgagggtggggatggttcttcattccttgtccccactccccgtggagctccacataggtatccaagtttaatgtgattatattaattattatatttgataaatgataatcatatgtttttatcgtgtgaaatagtatataatatttctagatatatgttgatatattaatataaagtgcgtatatacgttgcattgcatatataatttgacatgtgtatattgctttaagcggggacgaatatcctgcggggatttatttcctgtgcggggtggggatgggaacaaagtttccccgttgtttatcgcagggatggcgatgcattccccgacggtgaattccctgttgccatctctacctcggatccaatgtgtttctatgtactttagcctctcaactatgtgaatgcgcgttgctgctgcttcttgttatttttaaagtacagagtgctgttaataccataaaaaaattaaaatgaactccatgaaagtcatgtcgtctcggcatgcatagtcgccaagtataatttcctatagttagcatgccttttataaaccaacttttttttccatgtagctttgtcctttaatttgtgtgcatatcatcacttttttttttgcggggtgcatatcatcacgttataaatatttctataaaaggtttatatttgattgcagatattaatgaatgtgaacatcctgagagttacccgtgctatggagaatgccacaataaagacggcggatttgattgtttctgtcgtgatggtacacgaggaaatgccactattccaggagggtgccaaaaaaacttcttaacgcgaaaggcacgagttgcaattggtacgtacttactccaataccgtgttgcctcatattatgatatgctcgatcaggtatagacacacagatgttgaaatagtaccttgataaaccttttcactaatgaaaaaacattatctctcaaggtgttgttgcctgcatattatctatcctcttcggtttccttggatgggaagtgatacggcacaaaaggagcataaaaagacaagctttattaagacaaaacgatgagttttttcaacagcacggaggacagctattgctagaaatgatgaaagtagagggcaatgcagggtttacactctacggtagacaagagattgagactgccacaaataacttcaacaaagcgaacatcattggggaaggagggcagggaactgtttatagggcggtattgggtggaatcgccgtcgcaattaaaatgtgcaaggagattgacgagaacaggaagatggaatttgtgcaggaactggtcatactttgccgtgtcaaccatcccaacattgtcaagttgctcggttgttgcctgcagtttgaggcacccatgcttgtgtacgagtttgtgcaaaacaaaacactgaaagagttgttggatctccaaaggagcacgaggttccatgtcacactaggaacccgcctaagaattgctgcggaatctgccggggcatttgcgcatctgcactcattgtcgcaccctatactccatggtgatgtgaagccggccaacatcctactggctgagggattggtcgcaaaggtgtcggactttggctgctcaacaattgatgagagtactccggctgtgccaaaaggcacgccagggtatattgatccagactacctactcgagtatcaactcacagccaagaatgacgtatatagcttcggtgttattcttcttgagcttttaactggtaagaagccattctcaaaagaaaggaagagcttgaccttgatgtttcaggaggctatggtaaatggcacactccaggacctccttgacagtgacatagtcgatgaagctagcatgagagtaatccatcgagttgcagtgctggcaagtcagtgtttggttgttccaggtacaacgagaccgtcaatggctttagtggtggaggagctctggcggcttgcgctagcagatgaattgcagcgatacccgcagccaccactggtgcttgaggagttgagctttctggatacgggaagcaccagtgggatttacagccttgataataaggccgtgttaagcacaacattcgctagatgatcagtagatctatcttgattgtcttcgttgtgtcatttgtaggtttttgtatattgagtgttgttctctattttggatgtatttgttgtgaggaatgagaatataagaacctgtaaacacaataaatcatttagtgtactgtagaactactgatggtttggcagaaatgtaatgaaacaactagtagtggtaattgccgcatcaactctttgacttcttggctcctgctttatgtttctttcacccgagaatgtcgccgaagttcccatgggcgcaaggacggtggtgacgggttcttctttctcccatcaccgcggttcaaatggtggctgtggaggtggcaccatcggttgaatctggagttctggtgagttgcctcggtgtggtggtgacgtcaacaagttatacgcactcacaccaacatccacgcatattctcaaaccaatttcatcaaataaatcatttacaaaaccaattattcgttacaaaatattaatcacgacaatcattaaaaaagaaaaaagtcctgcacagcaagttctgacgcatgaaggtgacacactgacagtgcgcaccgggccaaagcggtgttgcgacggatcgcgccaaagcaggatacttgcacgatacttgcagctgaccagggcatggaaagccacacggcgtgctcgctatgtgattgggagaaatagacagcaaatcacgtgcaaaaatgatactcaaggacaaaaatgacttttcacccatctactaacggtatatgtgttaaataagcctactggaaaaggtcaataaaacataaaatttgatgatgcataatataagtgcaaaagtgaattttatcggggcaaataaggctgaattttttatttataataaataattacccttaaattaaacaattagtaaatcgtaggggggatttacaggagtaggatggacgtcactacagaaaacgtctagaactactggatgccgttttaaacaacgtccatacttggacggtgttggaaacagcgtccacctccctggtgcagccaagccacgaatagagcgagaacaatcaaaagaaaaccctgacaatgaaaagaaaacctaactgtcgcgatgagcgctgatcgcgcatgccggcagccggccacacaccgtcgtaaatcgtatacgagtttgccctctctacgactttgatccatccgcttcgtcgtacgtccaagccactctcgccgtcgacgccggtgccttcgatttgtctgtgttttacggcgccaccaatcctgcaatccggccacggcaccgtgtgcattggcatctctcgtcgtgaggcaacaggtttgccctgcaatttatatcacgcatgcatgtcttttcacttatagcatgtctctgctcacactcatctaattagcattaattgatatgtaatacattgttcatacctacttgatatatgacatgagtgttttattgaatatatatatatatatatatgtatagattattattcaactagtagacatataacctgcctttgttaattggtgagttcgtttggaagacacagccaggaaataaaatgattattgttcattaacatttttatactagtacagattctttcatctgtgacggcccctaacatgcctgaaatttgtgggccgtcacaaagaagtaatctcaatcgggcacacagacagctagatcggcataaaactagagcccgtcacgaatgacacttatgtgtgacgggccatagttgaggcccgattgagatgatggttcaatatcttaatcgggccctaaaggaagcccatcacagatgaccgtcatctgtgacgggcttcaactagagggccgattgagataagtttaatgcccgtcacagatgactctcttatttgacgggcttttattaaggccagatagagattacttctatgcccgtcacggttaattgttttagggcccttacaaatatttgttgcacagtataaataccccccaccacctagtgtaattgtatactactgttcactattttggtgggaggctatagagggcgattttttgtcttttttccaaggaaaacagaacattaccaaaagtgatcaaaatggagcactcaagtgagtaatactaatgatgaattcagcaatttcatcataacttactttagcaatactgatattataatatgtgcctctaatttatttttttattttgtagcaatggatcgaagttggatgtatgcgacaactgtgaaacgtcattttccggagtacagaaatggcgtaataaaatttatgaacgccgcagaggaggataggaaaagaagaaacaatgattacatgcgttgtccatgtgcagattgcaagaatgagaatatgtttgatagcgaagaggttgtacacgatcatctgatacaacgaggattcatgaaggactatacatgttgggtgaagcatggagagcaagaatcaggaagtggtgcagcaacagacagaagtggtgcgcataatcaggaagatgaagatgagcatgacatgtttataccttctccattgggcggtgaaatgtggatcacgatctgctacaagacatgttacgtgacgttgaagacccagcccagaatgagagagatttcatgaagtttagcaggttggtcagtgattccgagacgcttctgtacgccggatgcaaagcaaaacacacaaagttgtcagcgaccttgaacctaatgaagttgaaggcaagtagtggatggacagacaagagtttcatagatcttttaggaattttgaagactatgcttcttgttgagaacacattgcccaagacgacatacgaagtaaagcagattctatgtccactggggttagaggtccgtagaattaacgcttgtccaaacgactgcatattgtaccacaagcaatatgcggacttagatgcttgtcctatctgcaaggcttctcgatacaagcgaagagaaagtgctgacgaagcaaagaagtcaaagagtggtggtccggcaaaggttgtgcggtatctaactatcattgatcatttcaagagaatctctgccaaccccaacgaagcgaagttagtacgttggcacgccacggagagaaggaatgacggtatgcttagacacctagcggattcgattgaatggaggaatatcgatggaaaacacaaggacttagctgccgaccctagaaacatttggatatgtctgtgtacggatggcatgaatcatttcggttacatgagtagtactcacagcacttggctagttcttattgcgaagtataacctcccgccatggttgtgctttaaacggaaatatattatgttgtgcttgttaatccaaggtccaaggcaacccggcaaagatatcgatgtattcccggagcctgttatcaatgatcttgagattctttagaaagaaggtgtgaaaacttgggatgcatatggtcaggagaacttcaagctaagagttctattgttctgcaccattaatgattaccctgcactcggtaatctttccgaacaaactataaaaggaaaaaaggcatcttcgactgcaaggaacatacacgaagccggtggctgaagaaatcacgaaagatggtatacatgggtcatcggaggtggctcccgctacgtcacgcatttagaagaaagaagaatatttttaacggtaagagagaacttcagcctgcttccaaggatttgtccgaagatgacctagtgttgggggatttttcttttttcttttttccgaatcacaacgaacagcaccaggttatgaccgcaccaacctggacgtcgatccaattggtgtccacatttgtacgttaattgtaatagcgcacacatcttgacgctgtttctagtaacgtccaccttactttggtaaatgttatcctctaattactaataatttaatgtaaagaatattatttattattaattaaaaaatcggcaaataagggaaagagacctgattaatgggaagataaagaaaatcacttattactcatttttggagaagatgttgccgcaagcagtactataatacccgaaatatatatgtttgggaactcttcgtagatttcgatttcccaaccggtacgtatggggtgtacggtttgaaaaaaactagccagctcggctcagctgaagcttcaaagccaccaaaatcgaattaaaaaatccaaaaaaaattaaagagaatcaataacttcacattacggatcacagaatcaagcattcatcaacaagttcataacgcctaatcaaacattcaataaaaatggacaagtctaaaaaaccaaattaaatgcaccaatcatggtaggggatgtgacatcgcttgccgaggaatcgcttgccacttcctagctgtgacctgtcaaatctcgacgcctccacgagcaggtggaggccggatcaggctgcccccctgagccagttgtcgaggagatcttctggccgtcgccggggtcggggtcactcgggacaggccaccattgctatccgtggacacagcccaaggccaccctccacctcttcgataaggtttttgctcggctcggctcctcagatttttcttttctttttgtagctgttcgatttataagaaccgtgccaatttttatctaaccggcaccttgttgctcaaacatgtcagttttattttttttatcttgataaggtgagaattaaatgttaatagctaataagtataggttttaaatgaaccaacagaggtgatacctattttgtagtagtggcaattcgaggatgtcgtcgcctgctacccttacgctaactgactggaagcagtatgagtgcacgactagctagatggtatagctgcccacatgcgaagcggccccacgggctatatgggcttgtttagtttggtgtcaaaatcaaccttactaaaatttagcttcgtcaaaaagttggcatattttgacgttaacaaatttttggtagcattggatgtgtttaatttgttgtcaaaccaattcttggattgtttgtatgagtttctagaaataccaaattttggtaaggtatcaatggcaataaaatatttagtttgttagcttacaatgttttcgtaatacgaaaaactgctaaggtggaaagtggtaccaaactgaacaaccctacacagcctgcgagcaatgccacagtagcgtagccggctacttagtgaagaagtgaaagttgaatccaccatgatctgtgcgggaggtgaccaaaacagcggaatgggctatcctccggttgttaaaaggcctgtgattctaacacggtttaggccttggaatacaagaattttctccggtaccttcagtggggaaaaagtgcacgcaaggtccctcaacttgtcatcgagtaacaacgtcgtcccccaactataaaaccagatatctagtgtctcttaattaatcaaaaccgatcgcaatgatcctttggtggttttgaccccagttttatcctacgcggtggccgagtcagcgtgagacccacgtgagccccacatgtcaggatgccacgtcatctctctcccttcctcctctctctcactcttctcttctctcagccggtggctagggaggagcccgcctgggcgaggcgggagagaagggcgacgccgcgacggcggccgcagtggggaagcacggcggagctctgcggcagccaaagatgggtgaggggggctcatgccagcgacggcggcgcacgcgcacgaggggagtaagggtgtgggcgtggcggcggcggcgtcgatgatggagacgtgttgctgccgacggtccacttcggcgggctttccagcagcagcgcaggcccggagggcaacgtcggtgacgagacagacccaggggtggccgtcggcgggcgcgcgtgaagatgagcagttcctccaatatgtcgatggacgaaggtcaaacaaaattgttttctttagacacgatccacctggacagatcgaagacaagaagatgttatggagaggcggcgtgcgaaatcttacctccattattcttcttgacatgagacgcgagaccccgagctcagtgggtacagggtgtcatcggtctgcagggttccccacgcaagaacaggatcagggacctttcacatttagtgagaaaaaggggatgaaagcgagggcacaaatcaatggagagcaacattttgcaataactggtagcttaccaaatagcaggaagtcgaatttgggctcttggacctttgtggcagtgcttgtggtgtgggtggaaaaaaaccgaaaatttctccataatccaagaccctgtcctgctatttattcctcgccgttgtcgtcgtcatccgagcaaccggaggtggcggcagtgacgtcgaagcggcagtagcagttgctgctgccatggtgaggaagaggaagctgccaagatggcggagcgacacgctcctttgagaagcacggcggagctccgcggcggccaaagatggtagggggctcatgccgacgacggcggagaacgcgcacgagcagagtaagggtgtgggcgcgctcggcgacggcggctgtccctctcgctccacaggccggaggcggcgacgtcgctgctgatgcagcagtagcagcagcacaaccaccaccacctccaccaccagccgtcgccaccggcgggcgcggcgtcgacgtggcagctgcagcagggcgcgtggcatctccgcggctcaaggtccctcctcccgacgcagcagctcttgcaggagttctccagcctcctcgtgaagagcatcacaacccatcatcggcaagcaaggcacccaagctagccacttcgccttgctcgccagtggcggcccccccccccccccccctggcgacgccacccagctgcctgcccagcctcctcccgtgcacgcctgtcgctcgtggaaagggcaggagagaggaaggaataagaggctgacatacgggtctcacgctgactcagccgtcacgtagaacaaaacccgagtcaaaatcaccgaaggatctattgtgaccggttttgattgttaagagacgtcagatatctggttttgtggttgggggacaattttatgactcgatgataagttgagggaccttcggtgtactttttcctttcagtggaacatacacgtgcttcccaagttagagatagggggattgcagtggccgagccaaggcctggacatcatgggccagtgctcgggctctgccaaacgaacgagtgattgccccagctaaattatgagacaaaccagtgattaccctagctaggttacatggcaaatcagtaaggaatgtatgagtgcttactgcccaactaagttatatcttgaaatgttttttttctcacaaatcacaattcaatagtgttaacttttgttgcattatgtttaaaaaaatttgttgcataatgacaaatgactcataaagtagtatgaacatgtgtgttaccattagaatttcctgggctctaaaaaatttctagatggatcactaagagggaacaaagtggtacaagggcagcgtataatgccacgggaggtaaagcacaacagaacactcaaaccatacctgacgatgaccttgatacagtcacctacacactatacaagaggcgactacaatacatcacgatatagcggaacgacgactaaccttccaattattgaccatctaagacatgccagataatgatacaggaacacacgatattatttgttaacgaagttcagtcgaatcctacatctcccgagctcttattatgtacgctcgtcccaaccaatatagtacttagccgttacgagtaaatggtctcaccgccatcctcttcctgcgtgactatgctatattttagttgccatgcttatattgtagtgccttgctctctatttaagagagttgccaggttacagagttcgactctaatttcacccccgcgccacctattacaactccaagtctaactgtaaccaaacaggactagtatattcgacacataatctagcaggtacaactcaccaaattcaaaacctcaaaatgtaaagatataacatcatcattcattaacaattactacaattaaacatcatacaagtaatgttatattatctataattttataatttattaaattttagagctttaaaatgcttgcatgttaaatcatcatggcatataattcacataatatttcaatataactctctattattttttataatatccgatatacctatttagttcatcatcactcagttaatactactatttctctcctctctctaagccatatcacataattttttcagtccctagatgactaatttatggtacaaattatctccctcattttcttcacctcaattgtttttagcccttaatgattaatatatgggaaacatatcctatgcacacaagctctcacgtgtacacacgtgcacaccaactaacaaatatcaccaaaaaatctagaaaaagtcatacatgttatttcaatagtattacacccaggcataaaatcttaacctcaaattcattataatttttagccgtaacaaaaaaaaatctgataattttaaggttataattctgttagaattttgtcttttttcttactctctatgtagaatgaaattgaagatgcgactttgcacgtagatgaaatactattgcaaactcatgattcaacccccttacaattacacgtgatcatttttagttgatctacacggtgtgtacacgcaagggcctgtgtgtataggatacgctccctaatatatgatctaaattatcttccccatttcttctctcataatttaactttgataaatttaaatgatcataaaccacatcaaattatattgtctagctatcttacatatctttttatttattattatcataataaattctcatacagcatcacgtggggtttcactggtacaaggaaaaaaaacggtcgagctacggaaacaatccagccatttttcagaaagtgaatcgtaccaaatcgaattatttagaatctgctggtgtcgggaaacattctgaaaaatacacgctcagtgctgccagacttttgaatgctattgcagcggatctctgtttgatgtgtcaatggcttaaagaatactatgtagagtgaatataggtggtgtttaaatttcgtgaagatgaaaataaaggtaaatattaagtggatcacgtaaaacgatgtgatgtgtgattaattgagttttaattactacaaacttaagaaatagattaatatgatattttagagcaactttcatatagaaagtttatatacgaaaagtaccgtttagccgtttaaaaaatgtatcatgagtatctaaaattttatcctccgcttgtagaagaaacgaacagagccatagtcactccaatttgccgtccacataaaaagactgcaaaggattgagccaagccccaagcataaagaaaaccgaaatttgcccacaattttgtccgtttggacacaccgtacaaaattacagacgaaaactattaatggcatcgatctcaacaggaaatgcatctaagacaattgagccccctgatgtttgcatttgacagttgacacgaccttggcgttgatatggcaaacctgtttacctgtccactgccgcggtgcaccacacccttcaccggcaattccacaacagcaagctagcgctttccaagttccagcaatgccgccgcgaggtcagacatggcgagggactagagtgtatagtggcggcaactaccacaaccgcgagagcctaggacgttgccggccggctcgccgcccgtgagctaggcctgctccggggcctagtccctcggccacacatgagctgatgaagcgtattcaagatcacctaagcacggtggactcccagttaaaataaatgattgtgaagtactctctccgtttctaaatatttaaatatttgacatcgtcaatttttagtacatgtttgatcgttcgtcttattcaaaaacttttatgaaatatgtaaaactatatgtatgcatataagtatatttaacgatgaactaaatgatacaaaaagaattaataattaactttttaataagacgaatggtcaaatatattttaaaaagtcaacggtattaaatatttagaaacggaggtggttgttgtatttagttagttcgctacatacgtacttacataaaaagttggcattacaaaagtcaatatttgtgtggtaaccgggcaagcgacgtggacatggaatctgatctgatgggcagccatgtgtgatgacatcgaaagaaatattcacttccagcctcgtggtcgtggagaggtctcacgtcgtagtcacgatcgaagatgagatgcaacggtgactttgaccggcaaagtctttggatcatcgtctttgttggaaatggtcagtgtgcattcaggcatcgatgatctgtgatccatgtgttagcttttgccagttaaaagtgcatctatattacctgttctaaatttatatggataacttaattacaaggagtatgtgctggtggatttttagataatttgatcgtcgttgtaaaatcttagcagctctacctcaaattagttttcttcaaacactcccgcataaactagtagataattaaccaatttggaacatgtgccagaaagcaagctaagctagggcaaagaaagtggtccagactaaaatttactctaaaattaacactaaagatacagtaagcgaagacttgttcaagtcgttgggtctttttcttatatttaaaagaaagtttgtctagtgtccatgttggattcatctcaaattctcaacgctggctctactcatcttcatatacaagcacaagtccataatcacctatcaagaaacagaggtttaagacacaaacagatagctaggactagctagttcatccatccaccatgactagccacagaggactaacaacaacaacgctgtgcctcgccatagcgattgctgcagagctcctcgctgggagagcagaggggcaatgccagaacaccaagtgtggcgacgttgagatcccttacccattcagcaccagcttggacaagtgcgccgcgtccgccttcgaattcgactgcaacgacaccggcaacggcgtctacaagcccttctacggaaatgtggaggtgctcagcgtctccctccagcttggccaggtccgggtgatgaatcacatctcctcttcctgctacaacttatcttctaaggagatggactccgacacgtggcagctcaacatgactggcacgccgttcatgctctccgactccaacaagttcacggtcgtcggctgccggacacaagcctacatcgccgaccaggattacgtggggaagtacatgagcgggtgcgtgtccgtgtgccggcgaggtgatgtgtggaaggcgacaaacggcacctgctccgggataggctgctgccagacggccatcccaaagggcctggattactaccaggccttcttcgacgacagcagcatgaacacgtcggggatctacaaccgcaccccctgcagctacgcggtgctaatggactcctccaacttcaccttctcgaccacctacttgactacatcggaattcaacaacacctatgatggccgggcgcctatggtgctcgattgggccatccggagcgccaacagttgtgaggaggcatggaagaagatggactcttacgcgtgcaaaagtaccaacagcgagtgcttcaactcaaccaacggacctggctacacctgcaactgctccaaagggtacgaaggcaatccttacctcgaaggacccaacggctgtcgaggtgaattttcctataatcccatcaatactacatctagaattctaaaattgtgacagttcatatgaaatagctttcagcgtgtagctttcatgattttgttttcttactccatccggctatatttttaagaaataagtttagttggtccatttataaaatttccaatacatagtctgtttatgattctgacttttttccattaatcccatttcatatttgaaattctcccacgtttccattttccagattaccaaattcttttccccacatcttacaaattcgtcatttttattttgtagatattgatgaatgtcaagattccaagactcatcattgctatggagaatgccgtaataaacctggcggttttgattgtaactgtccagcgggcagcaaaggaaatgctaccattccagatggatgccgaaaagacttccgcttgccgctaaaagcacgactggcaattggtaggcacatgttttacaatctcttttttttaagactatgttttactgctgcatatctggtcgacatccatgttaaaacctacacatgctcaaatatttccactaatgtcagatatttgtttatccaggagcggttatctgcgtattagttggcctctttagtttccttggatgggaagtgatacgccacaaaaggagcataaaaaaacaagcactattaagacagactcatgaattttttctacagcatggtggccagctacttctggaaatgatgaaagtagagggtaatgttggattcaccctctatgagagaggggagattgagactgccacaagtaacttcaacaaggaacacatcatcggtgaaggtggccagggaactgtttatagggcggccttgaacggagttaatgttgcaataaaaaagtgcaaggagatcgacgagagcagaaagatggaatttgtgcaggagttggtcatactttgccgtgtcaggcatcccaacattgtcaagctacttggatgttgcctccagtttgaggcgcccatgcttgtgtacgagttcgtgcagaacaaaacactacaagagttactagatctccataggagcaagaggttccatgtaactcttggaacccgcatgaggatcgctgcagaatctgccgaggcacttgcgcatcttcactcgttgccacaccctataatccacggcgatgtgaaaccatccaatatcctacttgctgagggattgatcgcaaaggtgtctgactttggctgctcgacaatcgatgagaatactcaagctgtacccaaaggaacaccagggtatattgatccagactacctactagagtaccaactcacatctaagaatgatgtatatagtttcggagttattcttcttgagcttctaactagtaagaagccgctgtcaaaagataggaagagcctcaccttgatgtttcaggaggcaatggcagagggcacactctttgagctccttgatagtgacatggttgatgaagctagtatgagagtgatgcatcaggcagctgttctagcaagtcaatgcttggttgttccaggtatgacaaggccgacaatggtgctggtggcagcggagctccggcgcctagcactagctgatgaagtgcaacaatgcccacaaccgccgcttgtacttgaggatttgagctttgtggagatgggaagcacaaccagtggagtttatagccttgagaagaaagctgtgttgagcatagaatttgcaagatgatctatagacagtttgttgtattgattcccgcgcgtggtttgtaggtgtgtgttagattgagttttcttcctagtgatgaactgaatctgtaaaatagcatagtagcatttaggtgcgctttagaattaaagataaacatagttgtaataaaataactagtgatggtatttatacagttccaaagtgagcacaatttaattggtttggttacactactacacaaatgttttctaggacgagcatcccaataggttgcaggcataccataaatgcccgcatctgcaaaaatcgacccccccattttcgcatacgcttcttaagaggaccgcatgcaaaaataagcctattttcacatgtggttctcttaagtaatctgcatgtgaaaaaagacccactcgttttcttttattctcccctccttgctctctcctactaagtcctcctcttcccactctcttctcctccactcctctctcggccctcctggcctcctcctcttctcccccactccatcccaacggcggtggatggctcgtgcgacaggcgcgagctctagcaacggcggtgggggagggcataggaggtgtgcaacggaggcggcggcagttccccacggggagaacagtggaggaggcacccatcggcggccctcccgccacgtggatctgaggacggcagtccccccatgcgcggatccagaggcggctgccctcccccgcgacgacgatgacctcgatagcgacaatgacgagacggcctaggtggaggcagcggtctagggtttcgagtggcggtggcgactagatggtggcaaatctagggtttcagggtagggtttggttttttttttgttttttcacagacgggtgacttaagcgcccgcacccacatggaaaaatgacgatttttgcacatacctgggtgcagatgggtcagggcccgcacgcgaaaatttgtttaggccgtctggaaaaattgtttatgtactagtgttatttatgatgggacatgcctttccgtgtctgctcattttttggctaattattatttttaatgccagtcgatgtacttattgacattgattttttttaaaaaaaagttatatagttgaaagagaattctttatctccatgttcatcactcatcagtcttgtatatcgtgtggagccaaacaagttgccgcaccagtcgtggatgcaatctgatcgaggctatacaagtttcgacgagctaacatacgcttcttgtttaggtgtgattggctttcttacctttctgcttaaaataacccgaggtaggtagcttgatggggtggccttcacagctcgttgttccacccacgttctgatttgctttgccgagaaataattgatggcttcgagaggtgcctgccgcgtactctgtctgcgtctcaagaaaagcctctagcgggcgacgacttgacttgacacgggaatgaccgtccacgcgcgccgggccaggttgacgcgcaatagtgcccaccaacactgtgacgccgaaaccgttttttttttttttttttgagaaccaggaatttattaaacttagaagcatagtacatgcttgagagtacaattaagggactcgaaatgattgaaaagaattctagcacaacagtcccttgttggataggcaatatgggaaatgttttgacaattgaagattagtgcccaccgacactgtgacgccgaaaccgctaattagcagttggctgcgcgtccttcttccgcgtggacaggaaactcgtcgctcgttagctcgttcgactcgcgacaagatggacttagcttggatcgactcgtttcatttttctgacgaaccgagctgacattttaacttgttatatataatgagccaactcgagctagctcgcgagctactagccttaacaagctagactaaccctaccttagcaggtcacaggcccacagtcacatagcacgtagggctatatttttggaagaccgagcccaatagagcatcaatcagatcaaaaccctagtcaccccatccgatcgtgcctctgtctccactctcttcatccctctgccgccctagcgtagcgccgtagctgcattgcagagcgcgaccactgcgcgcccccacatctccaccgctttgccgccacgcgcccgtgcatctccttcttgggcacatctccttcttgggtacaaaagttgtaatatgtaatgaaatggaattaatgcagggtgtcatagactggatttgtgtaaagcactcctattttctggcgtggtatgaagcaatgtagcggagcttgagccggtttggctctgcacgaattttatgtgatttgctgcttttttttccttctttcttaatgtacactatttgagttttttatttgcaagctattttcctcttgttaggtcagtatttgatgcattggctcacgagctaaatgatcaagctcgagctttgcaacgagtcgagccgagctgggtatttagctcgtgataataactacttaacgagtcgagctaagccaactcgttaattatcttaacgatttagatcgagttgagctgactcgctatccaccctacgcgcggcacagccatgtggcgcgcgaggagaccctggcggcgggagggcgcgtggtaaggtgacatgtggcggttttttctcgcttttcttttttttctaggtttttcttttttcctttttttgttttctaatatttatatatatagcacatatacaaactttgtataagtagcgttcttttggttttttaatacgtacgtatacaaattttatatacgcacataataatgcatatattttttttacacattgaaattttaccgtacaccgagttgcttgaaggcttttgaagcccaatcgtacattcgtaccgctcgagcggaggaccgaggacacgtcggcggtccagaggcccagagcacagtgttgcagcccacatgccgattgtataggccggctgagaaaaattccaactcgggcactacaaaatagacttttttctttctcctgtcccaattgagtccacttcgagctggcccagtggacgggagtgcctggagtggtccaagcagtggaatactggaatggggcgcccctaatgcgcgatcagtcgcgcggtcacgcgggcacgcgaccatcagatccactactactactcgtacactactactataactcatacactacgggttttggtacagctccaactcctaaatataactccaggagttgagtctggagtggagttgtggagctgcctaaacccagctccacaactctagcacattttgtgagagagcttcacctaactccacttccaattttggtggagctgaaactatttggctgagctccagctctaggaggggtggagctggagctggagctgtgccaaacaggccctactactgctactactacatgtatatatatatatatatgtacatgtatatactttgtatacatacatataaatttgtattattgtatacatatgtataaattttgtattaataatataaagtttctatatatgtatacaaaatatatacatacgtgtatatataatttttatgtgtaccaaaaatcgatgtatacaaaatatacacatatacaaactttatatacacgtgtacaaactttgcatacgcgtatacaaactttacatacgtatatataaacttatataaactttgcatatatgtatacaaaccttgtatatgtacatattaaaaaccgagagaaaaaaatacgaatacaaagtttgtatacgtatgaatacaaacttggtataacacgaatacaaactttgtaatatgtacatcttaaaaaaaggggaaccaaaaacggaagagaaacgaaaaaaacaaaaaaaaagggaagagaaatgaaaaaaacaaaaaaaacggaagagaaacgaaaaaaaccaaaaaaagggaaaaatcgctcctcagtcgcggcgcgccgtccgccgacctctccgcgcgcgacacatgtccagtcgcgcggaggagggcgcgcgcaactagccgccccttagctttttcgactggaatgggctggcctcttgttggaatgcttgcttgcaactttcagcaacccactctatagctcacttgcctgtcctttctagtgtagttatcaagattggatcggatatcgacggaagatatagggtggaaacaacgtatctatagtaataacctgaaaactaccgttgaattaaaaattgaacgtctgagattcgtccacgtcataacgagtaaaaaattttactcatagatttactcatgacgtggatgaatcttagacgtttattattcgatccaacgatagttgtttccacaacatatatggtttgcactatatatattttctcggatatcgaactggtcaaaggcctcgattcatgaaaatcgatttttacttcatgaaaatatatatcgctctgcagtattgcgatcgatcaagcgacaaattaattagaaaccacttggcgcaagagtactggagatcgaaggattatgatcaattcaatgtcttttcctaagcaacaagaggaggaagcgaatcaagaactctcccaagtgatttccatgagccattccactcgaccacccgtccattcatcacacagctcagctcccaactccctgtcacagctccacgactagttccggcaacagccagctggccgtgccgatcgaccaggcgtctcgccaggccacatgttttttcccggtgtgtttactcccatttattcaaagtagcagtagcagtaaaaaaattgggttcccatctaaagcactgacgacaattaaaaaaaggggtattcaagttttcacaagggaatgaaaatctgcttgtattaattattggcacaaagtttttacatatgacagaaaattaccgtcagaaaaacgtacgaaatcataaaaatgttgcgtatacaccctaattttctaggcaagaaaaagatgcataatagtccatgtaccccctaaactcttgatataagtctatctagcatcttaaacattgaaatgagacatctaacctcctctaaactaactttgtaataccgttcaaattactctctagcattgttttggatggtagttttgggtatcttggaaactaaatgagtggttttgaatatagcaggtttacacatcatcgtcaataataggtcgccaatatatattctatagtgatgtcaccttactattatattaacatctgtctacattaaatgagaacaaaaaaataagggttaaaaagtcaaaactaaagatttaggtggatattttaacgcatatgtccaattcatatatcacgtaataaaactctcatccaacgtatacgtaaatcagatagaaagctatctataaaacctggtcaaggtgctagatggattttcaaccaaaatttagggggttatttggactttctcctatgaaaattgagtactagtacgaaactgtgaaggctcctgcagatactaaaatccactgaaagctacgttgaaggcttataccccctggcaagacttgaaaattcaagtcacgcatgctagtttgtttcacacatacactatcatcaagccgtttggtcatttccacgccagtgcgtataaacgccagtgcatataaacggtcaggaagacgccggatcatccgacaattgacgagttattgagccatgcagctccagaaattagcagcaatattgttgctaattagtataggccattcggcactgctcgccgccgttggagcgccgccgccgcctcctggcagcagcaactgctcgacggcgtgcggcggcgtcgatatcccctacccgttcggcatcggccctgcaggctgcgcgttgcccggcttcgagctcacctgccgcgacaccaacaatggcggcaagaagccattcttggggcacggcggacacttcgagctggccggcgtgtccctgtccgatggtcaggcccgcgtgtggaacaacatctcctcctactgcaacgacacctcccaaaccatcatggatgtggtgagcttcgctgatccgtacaggctctctcaggccggcaacacgttcgccgtcgtcgggtgtcaggcggtggccgtcgtcggggtcggagattccgccgataacatcgtgcgtttcctgagcgggtgcgtggcgaccaactgcgggcgacgcggcgatcgcctcgccgacggcgcctgctccggggcaggctgctgccagacaacgataacgaaggggtttaacgcctaccaggtcgagttccagaactactcgacagtgttcaacagctcgaaggatatctacaacgtcagccgctgcagctacgcggcgctgatggagtcgtcgagctttagcttcaggaggagctacgcgacatcgtcggaattcttcgacgccaacggcgggagagtgcccgtggtggtcgaatgggccgtccggaacgcgagcaactgcgtggaggcgcggaaaaaccgagaatcgtaagcctgcgtcagcatgaacagtgcgtgcgtcaactcgtccagcggaccaggctacatctgcaactgcgccaagggattcgagggcaacccttacctctagggatgcacgtgggtcgggctgggtcgacccaaggtctgacccacgatacccaaggcggtgatttgtgggtcatgggtcaagtcgacccacaaaacatgcttagcccactgacccaagagccatccatggggcggcccgcggccaacagcagcaagcaaactggaccgcatcatacaagcaaaatgacagcagcacagcagcacgcagcacagcagcgcgcaggcatcatacaaaccaaaaattcgtagatgattaatcatttgacatcagctgaaatcgaacaaatacaagcaaattgtagagctgaggatgcagagtcagttatacaggtaaatgatactattgataaaatcatcgccatcagatgcataaggggtttcttggttcataaaaaactgaaactaatcatttttcaatagcagatttgaccaaacaaatggttacaattatcattaggtcatcaacatatctattgtcaagaacatgagttgaggataagtctttgacatctcagcataaataggtgcaatgacacgacatggtccacaccaggaagcactgaaattttccacaacctacaaaacaaaacagtgagtatgtcaaaggtactagtttgcatcaagaatttaccaagtggatgagaatgcaagtgatattcagaacagctgagagtacaatataatgttgttcaacttgtttggatgagatacaaaatcaacataaaacagtcctaagtaacagacaaatgaggtttgaatcttttacaaacaaactagaacaatggaaaaaaacagttctacacatcagcataactagaaatgatgtacagggtactagatagaatatctgaatgcagttttcatggatcatttctgtcttaataactagaatatcagatttttttcactctcatccagagtcagttatacaggtgcatttcagtagcagctaattgatgccaatagtaattatatgtcaggtaaaagcctggagcacaaacagagctatcgaacagtaaaagcctcattacataacaatttccggtaaacaacacgattactaatgcactggaattacctatcaaggcatcaagtttcttcttcttgtgataagaccatcccaacagaagggcctagaacattaaaaaaacaattaactacataaactcaattggcactgtcatactaatagttttcaaagaaaaggggatagacttacaatcaacgactctcatccaatcctgtagacaaatgagagcctcaactatctcaggcgtcaatctacttctgtagtcattgattaccctccctcctgtactgaaagcattttcagatggaaccgttgatgctggaatggctaacacatcacgtgctatgtgtgagagtacaggatattttagtgagtttgccttccaccaggttaagatatcaaaatcatcaactcgaggcagtatatcttctttatagtatagcaccaacaacgatctgaggggtctccatgctttgaccaccttctgcataccaacaacataacatattgcaaaaattaatttcattattacgcacttaatcaacatcagcaaaaaaaaatacaaattgttaatgccaaggaataatacgatccatttacacacttctaccctggccaccggctaatcgagtcaccggctggcctggcaataactgaaagcatcctaccagcaaaatttagtgttgtgtaggcgtgtagcacatacttgcaaagatataactagagtttcttttggagtagtatctattaaggaggagtagtatcattgttggctctgctgccgtacaaaatcaacctaaaaccgacaaactgataggaaccaagtaccattgctagcattagtattcaaacataaggccaagcagaaatttctagatactattcaggaggtcactagagagtagagacatattaggcaggaaaagaccaatttctcattgtctgtagaaaaatcttaaggcagccaaggagacaaaatctacctctgcttaaacaggtccaaaagaaacagatcaaggtccagggcaaactgaatcacagttctcactataatctgatgatactcacgtttccttttggaacctgacttagctttcattgaatctttgcccttcaggaactgattctaaatctatgccaaattcccaatataatgcacacgtccaatcaattcctcccaatttcttgattcaaagcaaatagagaatcttgcatacctgcagcatcaacacatgttgaggtccgtcgttggcggcggcgcggcgagagtgatgctgggtgtggcgctgaaaggtggagcatccgcccatctgatccatccccttcttctatggccggttgggaggtctgctggtggcggctacgcggcaatcttgggggtgcgcatggcgctgcagggaggagaaacggagcatccaagcggcgatcttgagggtgcgcatctcgctcttccatggtagacggcaacggcggaggggcggagctccacaacatgatgcggcggaggagcggagagccccagcgcgatgcggcggcggcggagctggtcgtgccgcctggtactcgacctgaaacctagctaatgggtcggcccataatgctccatgggtcactgagggtcgacccatgatgacccatgaaatttcatgggtaagcccatgaggttttgaccccatgtttcatgggctgggtcgctgggtagctgggttaacccgacccatgtgcatccctacttacgaatttttttcgtttttagattttttttaatatttacagaaataatctatcgaccaaaaaaattgcagaaatagcccctgccgcccatacagagggcggcaaggggctaattgcaattttggccgcccataaagagcttgcggccgtactttttcatctgggtcccttgccgcctcaatagagggcggcaaaggacccagatgaaaaaagtacggccaaaagatttttctatgttatgttaataataaataaagaagtatttattggtaaaacttgttaatattgttataaaaatgtgttgaagttggttgttgcgcaatttcatatgttaagtgaggtattattttgttccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgcccctaacatgtgaacgtggtggggtatggtgggtacgcttgattggcaccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccaaaaggtatcgtgcacatataacaacaacgtagtcattacacaagcatacagttctggaaagtgaagcaagtaaacaaagagaagactgctctactggcgctgccccgcgccgcgaccacgcttggtcctccgggcctgtgctcgcacgtggtcctaggagtaggtgaaacgatccggtggcacagcacgggtagcacgagtgtcccgcggaggagtggcctgcgcctgatcctgcgtctgcaccggcggtgcgcctcccaactgtgaggggccgatgacgtcctctgtcgagcctgaagcgaagtcgaagtcagtgatgtcgaagaggaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcggcctgcatcatagcgaactgggcgaaacctacacatcgacaacgggacccttgtaagctaagacataaaatgcatgtaaattgattgtcgaagtaatattctttttttaagtacctgtggggggcacaacagaaggcctagccgaggaaggcggggtgctgaacggtgcacgaaaccctgaagcaatcggcaagtgaaacgactcacttatatgtgcgaggcatgtacagaaatagtaataaaaatacttacctccgtgcggagggggtctcggcctaggaacgtgcgcagctggatggggaccagtcggttcgggtggccgctgtacagctgcgtctgcccgagcaacgtcgtctgcacgacaggtgagcactcgaagaatcgagcgcatcgactccaccatccacgtgtacgtcgtcaggtgctcctctacgggtaccggaatccctgcatctaaatgttggatcgtcgttgaaccatcaacgacgacccggttgatgtcgtcgacctgcatggttaatttgttcgtaaatattcgtaaaatttgacgaagagaaagacatgaaaacataaaggaatggtgcgatgcagggtactcatagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcggggccagtcgccagctgactgctgacccttgcgcgagtacctgcgaattaatgtgtaatattagtgtgaaacgacagatgttacaaattattgtgaacaggcggattttaatgcaacaacggaaagcgtagtgcaagatcttaccggtgaacagcagctgggacggtggtcggaaacggtactggaaagggctgacggaagccgaactgccgcattacgcagaaaggggcgtgaggctcaacgcagatgtcgaataccatcggaaccatagtcatccagtacgcctggtccctggtgcagagtgtggacagacccaacggcgcacgagcctgggtagctgcggcactgttgggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcatgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaattgaagcagccacctcttcgtaggtccggtgttgcggtggtgtgccaacggctcgagcgggaggtgcggtgcgcgctgtaatagtgcgaaacgtgccgtcagatcgtcctgtcagtccacagccatggtcactggcccaacagcgtctcccgcgagcggtagccccaacaagtacgatacgtcctgtagggtaggggctatctcaccgcacggcaagtgaaaagtgtgcgtctctggcctccatcgatcgaccaaagctgctaggagggacctgtccacagtccatcgtctgggcgggtccgcgtcgccggccgcagcctccaccagccgacacatcggtaggaggccggcctcacgtagcctgcaataacaaattaatatgtaattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggagatctatcgccgggtccaacagctgaggtgtatcctgacgtgccatctctgaaaaatatagtgtttcgtgttagaacaattcaaaaagtagtaatgtaaaacaaaagatgactcgcaaattaatgaaatactcaaaaaatcatgagaataattacgtacaacaagagtacagcttatttaaataaagcaaacgttagtaatggtacataacgatgacgtgcaatttaacatatatgtagagttcgataatataacataacataacataacattacgtgtcgaagtccgacatacatcagcatacctaaagacactatgtgccttagtctgacgttacatcacgagaactaaagacatgacaagccgaagtctgaaattacacgacgaaacataaacacatcgataagttcgaaacaaattacaagcaaacccacatgccaacatagaacataagaactacaccatgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttataggtgtgcccacgttaatcgcatttgctgcaacgcttcaccctgccagcctccgactcgtccatattgttgcggatgcgacgagtcctcctccttccagccttgcctcggagcttcgatgggtcaggaatattgagtacttcatcgttagtctctgtgaactccccagctatgccgaacccgtaaatctcgccgctccatgtatgatatattgcttgcttactgaagtactgcgacacatatactgcatctggtatgccacactccgctgcggcagcaatgacatgggtgcatggcctgtggagcagcttcggctttgaacaagagcaatgacatgtgccgtcggctttgagaacacactcctgcttcactctcttgcggtagatacccctgcctgccttatcttgacatagtatctcgaacctatgttgttgggtaccttgcactagagctcgatgtttcatggcctttttacgcaactcctctagctttttctgcatgaaagttccaaacaaaatgctgttgttcggcatagagggaagaactgcctagaaccgatccctaaaatacctgcatgtcccatgtaaaatgaactccactatgccaactagtggcagtccacggacaccgcgcatcacccagttgtaaacttctgccaaatttgttgtcattattacatatctagcaccaccggtgtcatacaccttggcccatttctcttttggttcatgcagaatccactgagaaaatttccgaatctccaatccagttcttctaaccaaagttggactatctgttgggagaggtccaagagcttgaggagggtcatcaacggcagtcgatggagccgctgcacgctgattactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcgtcccaaacaccagggtatcctcgttccatgctcccaaacagaaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgtcagtatctggccccgatactttcctgtcaagaatgtcccatcaatgcagagaactggacgacagttcacgaatgccatcttgcatgcatgtagagctaagaacgccctttgcagcacactcttgccaggatgttcaattgatgggaatttcttcacttcgtaagagctcctagggtttctttcctcgataacaccaagcaggcgtggcaaattgtcatacgaggcttcgtatgttccaaatctcatctctattattttctgtttggccctccaggccttggcatagctaatagtatacttgtatgtctcctcgatgtgtcggattattgaccttggttcgtatgtgagattatcgatgacatgcgcatacatctcagatgcgacaaatgcacatgtaatgttcctgtggtatttctgaacaccaggtagaaaacatgtatgcttggtaacgactgacactgtccaataatccttccatttccccttgtacgcgtgcactctccagggacaaccatctttttccttaacacaccgaacttcatattgcgaccggttggacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctgactagcccattctgctggattaatatccgtctcctcatctgacgaatcaccttcctctacacgctcgttgtcaaaatcctccctctccatttcatccacaatggctgcgacagtctccccctcgtcggccactccacctggttgaatgcccactggagctac

SEQ ID NO: 28406 - DNA, 9401 bp, Oryza sativa
cggaaaattccggagagtattttacggcacaaagaatattgcaaaatattcccggccaatgatttttaagggaaaattttaattctcccattatttcacttgattaaattgatttaacttttatttaatttctagaaaatgcattatttaatgatttttaaacccgaacgaaaatcggggcgttacaaatctaccccccttacaggaatctcgtcccgagattctgggatggctagaaagaaagccggtgctggtgggctgtctgtctgatctgcaccttgaactgccacattctgcttcgaactgattgattgactggttgatcaaacctgcacgattgaactggctggaatcaacctttctgctcctttgctttgccaaaactggaccgactcgttctgcttgaactgacctaggccagaactgcggatactcctgaaacttacttatcttggactgaactgttgaggttggcaattttggtaacctgagaattcaccacgctggctataagaggatgaaaatggaatctggcatttgtaaatcatttaccctatgtccgcttcgactggtcccaattcaaatgacaagtaattccaggaaaacctgcttgacctgtctttcgtctgaactgcaaccgtccctgatgctgcttctcaaagctgagctattgacctggcctcaccggtgtacctcagaattcaatcagataacttgagatcggtgtaactctgctgacaccctgtaactggctacttcaagtactacccggattgttgcactgggttgaaccttcaactaaaacagtgatgaggtgagccaaaactcgtctccgagacctatcccccttacagggagtagtcttactttcgcctgactgggaacaattggactattgtccttgaaaaaaaaaataaccaacacttctctgacttacaaagaccctcactttgaaaactgaaacttcgtcgattcatcaaaatagagcaatgacgactcactttcatcccagcaagatttggaacttaaccctcagttgctgataggaaattccacataaagaaattctcatttagctcctgatcttactaactcttaactgactttcccatcagtactaactgctggcatgactgtccttcttctgacctgacttcggtgtcgtccacctaaatgggttgtgtagttgatatctcaaaactaaactgaccgactcgcattggaattgacacaacttgaggaactggggtgctgcgagtagagctgttgtcttgatgacgctaacgccttgccgttgaacaaccttgcaagaactgaccttgtaaaccataaccactatagatagcacttgttgcctcagggattggtggtgaccttgctatgctggtctactgaagacttggtggcgtactgtcggaggttgcaggtgcttgctcttggaaaacaaactgactttcgctctgatcctgattccggcttgcatctgagcttgtacttgttgttggagacattgtcgttgcatctgctgctttggactctacggttgcggtatcaacatctgacacatccatcattagatcttggctagccaggatctgaccagagcgaggtgctcctactcagctggtagcttgttgtcttgaactgatccactgactctgactgcaacacactactgctagagttgcttccgctacattcgaccttgcatcgagctttgcatctcctgcatcaatacacccatctactgatcctggataccaaatgttgatcacgagcaggggttcttctggcatcgggagtacctggtagctttcgactgatccattgttctgtgactttcatacaccgttgttgttgctcttctctttgatactgaccatctgctgccagaacggaagagaggtggaagagaggggttgctaaagataaggtactaaaccacttgcctattgatctgttgtgagtggattttatgattcaagttgtttaagcaaacaacctagtatggtcgcatccccaccaatgacgcaaaccatacccctacacacaagcaaacaacacacgatctagaagctaacgaaactactcttcgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgcccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaggtgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctgtactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagatccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtgacaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacatgagctagtcgatttatcacccaaggttgacaaaggatagatatcaagtaaacatggcacaagcgagcagataggtaaaccctgatcccatgtaattagcaaaacatgcatatttatttgcaaacggtaaaacatttataaattaggatcaacatgctcaagggggaatgtgcgacttgccttgcttcttcactttgatcttccgaactcttttcctcgcgaccgcggacctccgaaacgacggaaactacacgctggcacgcaaaacgaggaaaaactctaataaaaactaaggaaacagtacataaaaactaaacaaacatgtagagctcaattttagatgaattttgcaagttgaatggctcaattcggagttcgaatgaattagatatgaattttagaagttttgagccatttaaatgaatttctataattattcacgaattattgcgcaattattatttattttctcaaaggaaatgacaagtgctgacgtcaacaaaggggaggggcggcgccggcaagcgggccccaccggtcagcggcacaagggcgccggtccaccgtggaccgggaccaccgaggcggtccaccgccggtccacgggaaccgacggcccggatcggcccaaagccgattggacggccacgaggcagcgtggctggggcacgggcacggcatgaagccggctcggccgagacatgacgcggtggcggcaagggggaggcggcaagggggaggcggcaaccggctgcagcagccggcgacgtggaacggcggcgggcggccggaggacagcggcgcgcacggggacggcgacgcaccccaagaggcggcggtcggcaagaaaggggacgggaaaaaaggaagggaggagagatcctcaccggaagcggcggccgacgtggaggaagaggacggcgacgacgattgcccaatggcggcttgcgaggatggagggcggacggggtcgcccttgaccttcaggaggagaagagggagttagggaggggaggaccgatgcggggtgactggaaacgaagaccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggcggtggctcggcgcggcgacggctgtggcggcgggaaacggcgaccggagctcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggagggcgtggaggggatcgtgcccacgtcgttggatgcgagctcgggtgcgggagggcgccggattttgcggcgacgtggacggctatggcggttggggtcggccggcgagaggtaggaggaggagctgctgtcggcgaagggagagaaggagggacgcaaaacagacttttgcgagcgggccaagtgagaggggagccggcccgagagagggagaaggcgcgcgggccgcgggagaggaaagaagacttgggccgaaaatggcccaaagagaggaagggggaaattttatttgttttctttttattttaattgatgcaatgatctttgtgttattaaaattatttcttgagctccgaaaattcacggaaaattccggagagtattttagggcacaaagaatattgcaaaatattcccggccaatgatttttaagggaaaattttaattctcccattatttcacttgattaaattaatttaacttttatttaatttctagaaaatgcattatttaatgatttttaaacccgaacgaaaatcggggcgttacacaaactagcagatctacgttgttaccgatatctacaatacgcacttctaaattagtacaactaaaaccataaaaatataatgcatttattcaaacaaattttttaaaaatacacactatttaactcaatagtcacatataggatctgcgaatattacctgaaatcggcgtctgaatccggcagggcttcgccccttcttctcttctcctaccctctcttcttttttttcactggagttgagaggtgagaaatgagggctggggctgggcggcaggccttttataggtagcgaggcctgccgcccggccagtgggcggcaaggggccgcctgcaaaatggctggccccctgcggctcttttgcattcggaccccttgccgccccaccaaagggcggcaagggttttcatgcaaaatacccaccctccgtcacagcccgttcctcccccgtttgccacgtcagcttgctgcccaccattggggcggcagggtctatttttgcaaattttctcgccaatagattatttatgtaaatattaaaaaaaaatctaaaaacgaaaaaaattcccctacttacctcccaaacggctgcctaggtgaatatgtttcctctagattctagtcccatcccatcgttttagcgtggttctaattcgtgatatttcctacagtttcatatatgcacttaccgtataggctagttctttcttctctcataaagccgtacatattgaatttgattattatcacaaggtttatatagaacgcgatgatattgttgagtccgtggtatagtttgaacactgagatcaacacgaaaatccttgatattttggaacgaattttgtttatattttaggacagatgggttatttgggaagtgctatacccagaaaccatcatgcagtggcggagccaacgtgggggtggaaggggggggggctcgagcccccactaccccgctggactcctagaagttgtgagagaggagaagggggaaaagagggagaggaagaagaaggggggggagggggctggaggaggaagaagaaggctgagcccccctctcctccaaacctagctcggccactgccatcatgcaagtagcgctttttcacatgattgtaattaaatatgttcctgcaaagtactaatacatcgtcaaaaagttgtaaatacttgccaggattacaaagacgtcattactagtaaatacatctccataatgttgtaaatgcatcctcgtgtaactttaatcggcgaggaagcgatagcacccaagagcttactatatatctacctatcattctgtattgtttatttaatatatatttgtgtcttcttttcttcggagttcaattcatatgccaaaaaaaatgctaaattgctaacttttttcattataaatttcttctattcatgcaataatttccctatatgtaattatttgtgtagatattgatgaatgcaaagaaccgaagaaatacccttgttatggaaactgcaaaaatataccagggcatttcgactgtacatgccctaagggtacccgaggaaatgcctttgttgaaggagcatgccaaaaaatcatcttaacatccggagtacgaatagcaattggtacgcacctataccaactctatctcatcacgtacatatactttcaatatagttgaggcttccaacgtcttgaattccattgcaatataactagtttttgtttgacttctgatgtgtttcgtgtggaaatgtaaacaaaactcttgatctacttgatttggttatggcttacataaacgtaaaacaatactgatgttaacatacttgcttagaccataaattgattacaacttccaatttgttcgttcaggagttgttgcgggtgcattggttggcctctttggtttccttggatggggggtgatcaagtacaaacagagaataaaaaaacaagctctattaagacaggctgatgagttttttcaacaacacggaggtcagctccttctagaaatgatgaaggtagagggcaatgcggggttcaccctctatgagagagagcggatcaagattgcaacaaataacttcaacaaggcacacattattggggaaggaggacagggaactgtttacagagcagtgatagatggcactaccatggcaataaagaggtgcaaggagattaatgagagcaaaaaaatggactttgtgcaggaattggtcatcctttgtcgcgtcaaccataccaacatcgtcaggctgttgggttgttgccttcagtttgaggcacctatgcttgtctatgagtttgtgcaaaacaaaacactacaagagctgttggatctccagaggagcaagaggtttcatgtcacactaggaacacgtctaaggatcgctgcagaatccgcagatgcatttgcacatctctactcgctgccacgtccaatactccacggcgatgtgaagccagccaacattcttctcgcagagggattggttgcgaaggtgtccgactttggttgttcaacaatcgatgagaaaacccaagttgtgccaaaaggtacaccaggctatattgatccggactatctactcgagtaccagctcacagccagcaacgatgtatatagctttggagtcattcttctcgagcttctcactagtaggaggccattttcaaaagaaaggaagagcttaacatcaatgtttcaggaagctatggcaaatggcacacttgtcgagctccttgatagcgacatagttgatgaagctagcatgcgagtgatccaacaagccgcggttctagctaatcaatgcttggttgttccaggtacaaccaggtccacaatgatgctagtggccacagagctctgacggctagcattagcagatgaagtgcagcagtacccacaaccgccattggtgcttgaggacctaagctttacggggatagggagaacatcgatgtctacatggtacggtgggagcaaaacaaatggggtttatggcctctcgaagaaagctgtgccgagcatagagtttgcgagatgattgatagacatcatttcttatgttgtcgtttgtaggtgtgtgagagattgagttttcatccagagtggaggagctggtcagttgtgtatgaccatgcctatgcattgtgaggaataagagtacaagaacgtacatgtaaacccgtgaagcataattgtattgtgagactgattagcgaatcctaagaaaataactagttgtgggagttgtataggtgaaacaattatatatcagttggaaccatactacttcaataatctacttaattatttttaaagaaaactctcaatttgctctcgaaagtgattgattccctcatttgctcacgtaaaattggttctccctgatctaatgctcctcattcccagcttttatcctttatttgacatttcggttagttttatatatcaacctagtaaaatgatagttttctaaacctagtggcatgatagttttgcccttaacttttcctgtgcgtggttagcaattttcgtaaacctacatgttattttagcaaagaagtgttatggaaaattatttaaatttagtatattgcatga

SEQ ID NO: 28407 - DNA, 15242 bp, Oryza sativa
ccgggactaaagatgccggttaaaataaccgggagttaaaatgaatccttaccaactgggactaaagatgtagccaggcggcaggtttcttttttcctttttttattgtttttaacatcgaataatgatttcactccatccacaaatcaaccccaaatcaatcaacacagatcacagcacaaaagatatcaccaaatcctcaaatcaatcatcaccaaatacatcacaaagtgtaaaaaaattacataacaagttctacaaaaaatcatcacaaatacatcacatattcacatcacacaaatacatctcggatccaatcacaaattcttaaaaaacagaaaaaaaatcaaatacatcctcgatccgcgccggccggctcccctccgacagaggcgcaaccgccgcctgccgcgccggccgcctccgcgccagcgcctccgggccggccgccgcccctccgcgaggcctctccgccggccgctcctcgatctgctgccggagagagaagtagaagttgtagagaagggaaggataaggataacacatagagggaggtgaggagaaggagaggataaggataaggataaggataagagatagaagaagatgaggagttgggaggataagtcatagggattatatcctgcatacggaattttagtcccggttggtaataccatacaggactaaagatcgaaataatctttactcccggttggtattaccaaccggtactaaagtggtgatctttagtcctagtttgtgccaccaaccgggactaaaaatcctcggtcccctgacaagcccttggcagagaatgaaccgggactaaaaatcttctttagttccagttggtgttaattaccaaccgcacaccaaccaggactaaagatcaagatttttttaaccgggactaaaaatgattttttgtcccgatttttatagaaccaggactattgtagtttttggtcgaccctgcaaagatcagttttatagtaaaattaaagatcaattttacagttgatttatttaatttttttatctttcagtctttgcttccaaaccgtatgaacataagtacaaattagaagtctccccctttactacggagaactaaacagttggtaagtactccatcctcttcatattataataagtcgtttgactttttacctagtcaaacttcttcaaatttgaccaaatttatataaaaatatactaacattttcaatacacaagagcaaaattaccatttcacctatcgactagatgtatgttagcgaaggactaatgagaagagcaaaacaaatgataaaattcgataatgaatggtataagagggagggccgatttcacgtggaaaaatgaatgtatcaattaatggataaataaatatttttctcttatttttgaggctagaaaagaggtcatcaccagttaacacactactctgtcaatttgaatgggctttctcacctttacgactaacaagtggaggtggttgcatgatactctcatagctcgtttttctgatataaacaatgaaaatggtcagaagcaatataacattctttccatgggaataatcctcgggcggtcggtaactttttatattttaactgtccagtggtgatattgtaacataacacaaaaagatagttgaaaattaaagtttatgtatgactatagaactttatagtagtatcttctagatcagtaaaagggtccctatgctatagattggtgtagaatctcttctcctggtttcatccctttcttccatcgacgtgattggctttcgatgtgtttggcttggacgacagacttggaggtgccccgcctctgtttggatgtcgagaagaaaagtccctggtgacgacttgactcgtgaaggttgtcagggttggccgcggatcgcgccgatgctggaatagtcgctgcagatcgagttgaagcgacatcaccgagcgcacggtgcgacaacagcgacgacgcgacgcgatccgaagacatcactgcccgcggtaactgcctcccagaactggcctttcgcggcccactcgcaattcacaaagcggccctgtgggctatgcatataggaaaaggtccaatttgactccatcaaaatatagctcaaatctaatttatatctctcaattgtaaaactgaatatatcgactcctccaacactcaataccgtcgaaaacaacctcctcaactgttttgattgtggtttttgctaacgtgacaaccatgtggaggcctagtcatcatgatattaacagtagagtgaggcccacgtgtgattcctttccaatctccttccttctcttcccctctcccccttcctttgttttcaggcttcacgacagctagtggctacagggcggaggaggacctcgagggagctgggtggcagcgagttactccccaccttgcaacgagctcgagctccacatccatctccatcgaggaggataaggagtgaggagccaaggaggaggtgcttggggcgaccgtgcgtgagtgggagaagagctccgtcatcggggagaaaggcgctcaaggaggtgttgacacgccgtccctaagctggcccccatcacccctatctcctcttggcgccaactaggccgaggccatcatagatcccgcctgcgactgtcgcctagactacatgttcaccctgcacgtggactcggtggacgacctcccctgccgcgcttgataactccctgatctctgtccacttccaccgtcaaagaagacccggtcggatgggcaccatcccaattggaggggagtgctcgccgccaccgccgcttctcctcgccatttcgcctcctccgtcgctatggagaggagggactagtctctttcctccagggagggtcaactggccagggggaagaggaggagagagatacgaggaagaagggagggagagaaagggaggagaagaaagagaagagtcacgacaggtggacctcacatgctaattaaccaagttagattatgtcaacgtgcctcatcaacgaaaacatttaaaggagtcaactaaatcggttttaatagtatagcgtttcatactctagtattacggcagagggtatgaatcaaattgaagacgcattttagggacttaaagtggacttattccatatatacacagtctacaagcaatgaccgacgtatctgatgggctggtgaaaaagatgctccccgtggcccaaagcagtgaatgctgccgtcttcccgttgtcaaaagactctccgatacttcttctttttctttttttttcgaacttcaactctaacacagttaggcccatttggaatggaatgacagaattttctccgatacctatcaataaggcggtcacacacatcctatgacttggtatttcacaagtttctaaagaagaagtatgcttcccgcgttctatcagtcaacccaccctgtaccacctcatttacccgtcctataagtacatgtcaatcaattaagagttctctttgttcactactagtaaaaaacaattttcctgcaaaaggagctctttagatcgtagaaagagcgtttccgcgtgtgtctgtaaaaatcggcatcccattttcacgtgtagacctttaagaggcctgcacgtgaaaatcgattttcgcagacgtgcctcttaacggttcgcacgcaaaaataagcctattttcgcatgaggacccttaagaggctctcttaaaggcccgcctactagtctatcattcccttcttttcgctcctcaacactttaaaatttttcatccttatcctctcactcctctcactctctcacctctccctcactctcttaatctgtctcctctcttattctcctctcgcggtctagtgtgtgcggcgagtgcggccagcggagggcacagacggcggtgggcgcggacggcggcatcgagcggcttggcggtgggcgcggctggtggcaccgatcggctcggtgacgggcggatccgcctcggcaagcctcctgacggtggcgggcggcgtggtcgacggcgaaggcggtggctccctcgcgaagctccggcggcgatgacaatgaggaggcggccggtagcggcgctgatggccccacgcatacgtgcgctggctggatccacgctgccctcgccgccgacgacgaggaggcgatggcagccgggagcggtgccgccggcttcgcgcgcacgcgcgccgccgccaacggattctccggtttccattttttgaatttttattttattttttggaattttatttttctatgcaggcgacattacccgaccgcacgcgaaaatccgattatcccttgcgattgggccgtccacatgcgaaatatatattttcacagacatgggacctccacatggaaaaaaccctttttgaccgcacggaaaaatccttttttattagtggttggagctaattcttaaacatgatattatggttaagcatgatcacctaattttttatacggaattaatggaagagtaatggccggtgcctgatgaatccataggaccgcttaaactcgtgtgtggcgttgtagatggtgcagtagtggtataccatacatggtgttggtaattttttgacaagttgacaagcacgatcgtagcatcttaagtcttgtggtgatcctagagtcgccaaccacctcgatctagcaaaaagctaaacctagatgggttttgataactaaaccggctagcggagccgatttctagataactacccgtctcgtgggcaaacggaaggttttcaggacaaacctacaaagagatgtcgcactctcgcagcagcggcggacggtttacagcgcaaaccgacaaagatggacaaactaagagaaaactaaaagcaatatgaaaagaacgattcgattgattgatagtagattgattttacaatgaaccggccttgtcccttatacaggggttggtcttgccctctacaggccctcctccacgtccaactcggggtagaaaccaaaggaaacccaaaacatgccttcccgagcaaggaaacctcgagacccgacgaaacagggtcggactcggaccagccggtgtgcggccggtcacaccgccggtctgaccggccctcaaccggcggtctgaccgcccaacacaaggcctaccccagaggaaaccggtagacttccaaattttggcaatatttcctattttaatcctaggtgccaaatttaggtgtaaacatatgatactccctccgtttcacaatgtaagtcattctagtatttcctgcattcgtattaatgttaatgaatctagacatatatatctatctagattcatttgcatcaatattaatgtggaaaatgttagaatgacttccattgtgaaacggaggaattagtactacacatggtgtagtagtaaactcccagacttctcgagtagttatagccaaacgaggttctcagaaatctgaatgctattgtgttcttacacaatattgtcactccatttcgcagtggacataaagaaaaaaccctgaaaactagtgatcgaaggccaaaagaaaccaaaatctgcacactgttttgtccctttggacacaatttacaaacgcaaccattacaggcatctcaacaagaactgcatctctgaccatcaaggccccaactatctgcatatgattgaaatcaaacaaacaaaaccagcactccatgggggaaaaaatcaatcaacctatccctctctctatacaggaaacaacaaatcaatcatcatccagttaaaaacccaattccaccatcttgtacaagcaaacacaatattgatcaggtcatggctctttcagaacctcaataaccaaatccctagccctgtggaagcacttggcagagaatctctcgtacaccatctcgtacatctgcaggttcaaatacgcaaacctcatgtatctgtcaatgcattcctcatacttctggtacaatgcagggatggtcagaacagcaacaatacctgtcagcatgaggcaaagaaacagggcgtgcttacgatcaatcattccaatgccaaaccattgtacaagtggaactaaatgttggaaaattataccggtaataaaatgatgggagctgcttacttgtgtaacataaagtggtgaaatcagtcaggctgccaatgatagaaatgatccacaggctaaggaagacttgataaaatagcaccgagtctttcccgagtgcgatgtcatggaagacagagaagaccgtgttcatgccagaatgcagcagggctgccacttcattcacaacctgctgcgaaatgcgcatctctggaataggtggctctggcctgcaacctcatttgtttgcacaacacaaccagcatcgtttaaaatatttgccaaatgtccacagcgatgagcaattcactcatctgattgaagtaaaaaacagtaagctgtttgcaagacaaagcttatcattgtctacccttagcatttcagttaaaatagtttacagcacgtacctaatctgacatcagtatcacctggctggttgttagattgtcaattagcataaatttggtcaaagttcaaagcatccacctaatcctctaactgaagtaataatgattaaattgatggaggaatgtcaaaacaacagtgaaagctgtgatgatgataagaattaagtgcctggattgttccttccattggttaactatcaactgaaatctgtatcccaaaatggaaagtagagtccaacagaaattccattcctgtgcgaaatcgaaggctaagagtactatgttgatgtaatgagatggctaggattgaggagctgagatcccaatctcacctgttgaggaggcgggcggccttggcccagaggaagaggacggtgaggaggaggaggaggacgttggaggcgagggagaggaaggtgtagccgccggagccgaagagcagccagccggagacggtcgccgccagcaggcaggcgctcacgtcgccccgccgccacatcaccacgtccccaactgcaaccatcgaatcgatttaatcctcgatcaaacaaagctggaagcatacctacccatcatcggatcgagatgcctaccaaattctccgatcagagatgagacgccgccgccgccgccggggcagcaagaatcgtcacgacgatccatggacgacgaatcgaatcaatccgaacaagcagcgaatcagcaaccagctggctagaccgcggatcgaaggaggaaggggcaagtcaatgccttttcctacaaggagaagaatcggggatttcggaaactttccccaaatgagatttctcggtgcgctagctggactccactcaaccaccgatcaacagctcaactccctcccaggctcccagctcgatgtcgcagctcaccctgacaggtgggcccttggccgttgtacagcgtggaaagttgccacgtcggacgctcgtggccacgtcagcctcgcgtgcatggcgcaacggtaaggccattcacagtgcgtatacctgtactagttgagcactttctacgagttctcacgttaattatataccccatctgcccacgtcgccagcggacaaaggcgcatacattaattatataccccatctgcacacacgttaattatatatcccactttctacgagttttcacgttaattatataccccatctgcccacgtcgccaacggacaaaggcgcacacattaattatataccccatctgcacacacgttaattatatatcccactttctacgagttctcacgttaattatataccccatctgcccacgtcgccagcggacaaaggcgcacacattaattatataccccatctgcacacacgttaattatatatcccactttctacgagttttcacgttaattatataccccatctgcccacgtcgccagcggacaaaggcgcacacattaattatataccccatctgcacacacgttaattatatatcccactttctacgagttctcacgttaattatataccccatctgcccacgtcgccagcggacaaaggcgcacacattaattatataccccatctgcacacacgttaattatatatcccatctgtccacgtcgccagcggacaaaggcacacagccatggcaacccgtcgtcgtatgtggcggtccagcgtgcgcctcgacacatcatcatcctcttcagccgcttgttaaagtgcgcagcccggcccactaaccgtggctacccaggtcacattggggctgctccaccacaggctcaaccggagccacaactttaggttctgggcctacacaaccaaaagactagtctgatgggtgaggaccgcccccaccttttaagtcgtgctcctccatcatcaattaccgatgtgcgactaaacccaacaccgcacgtgctccagtaatctcggacccccggaatagagcttgtggatggttaacgtatatactttctctgttttacaatgtaagtcattctaacattcttacattgttaaacggagcggagggagtacctgctaacttatatacttgcatgcgttcttgcagttcgagtcctgcttgcagaggtacgtgtgggaggtcgacagagctatcgagccccaggtgaacaactcacgaacttgctgtcgacggatatctgcttagcttaatatgtcgtgtcctgcatgcatgcatatgactacattacatacaagaactacaaacccaaatatttcaatccactattaaaataatatttctacaataatctacacgataagaagaaagtttattagtatagttcactgttagctttaagcccatattaaaattgttttcaccttttcttttctctatctttctcccacttacgcatttaatttatttatttatgttgaagcatgtgtgtagttctaggttattcatgagagtgaataccctttatattttttctttttccaatccacgtgagttttacgtttatagctggcttatagcccactactatctttgctctaatccttctcatgcattcatgattgaattcatgaatgaaaatctatagcaaaggtaaggccccagttaaataaccaagattggtttctgatttggttgttcttttgttcacccagaaatcttttgcatgcttgcacctaataaaaagacagatccatataaaatagttgcatctgcagcccatttatacatgtgttctgtactttaacattttcttgatctatgattttgattaaataataaatcattttttttacttttccttatataatatgagtcgtttcacggataagttgaacagcaaaaaaacaccgtaatttactcaatgaaaattgagaattaatcataattttgaagcagtgaataattttgaaacagtgaacatatatatcgacccataattttttctgcatataaactagcaactaatgattaattttcccatgccctatctctgaataattaagtccataggcaatgtatgtactctacagcctacgtattactggccgttcgattttgatcctaatgttaatattttcatcacatgtaatacctatattaataataaatctgtcccgtacttcgtccaaatacatttcattgaatgacgatatatatataacttatcagccttatcagcctaatccatagttctttttaattttcaaagttggagtataacacaatcgcatgtctatggctaaaattattcaaattaagaaggaaacatggaaaggcaaggtcagagaaattagactaggggatgtggtaatccgaacaacaacctatggtcctatcactagtacagaatatgtcataggtgccggtttgcaagtgtctataggtgctggattttcacccggcaccaattagttggcaccagtagcaaaacccggcacctatacaaaaatagaaccagcacctataagttcacacgagccaaaaaaaaaaaaaggggaagagccggctcgaatcgagccgagctcaccaactgcgtcctcacgccctgccccacatggccacatcgattgctcccgacaaattcatccacaaattcacaaaaaaatcatccacaaccatacaaccatactccacaaattcacaaaaattcatccacaaccatacaaccatactccatgttcatcaccgccctactcgatccccttcatcaccgcctctctgatccgagatcaactccaacagcaaactactatattcatcaagaactagcaaatactacaaagatgaatgaactcatgcgggaactcaagaacactcaagaaccttcgtccttctcccttgggtcgcctccggcctccttccttgagatccgctgctgtggcacggccgctgccgccgctgtggtgtgccgcagctgcctcctccaggcagccgccggccacaggagctcgccgcctccccctccgccggatctagtggaggggagggcgcagcagccgccgccgccgcctcaggcagccaccggccgcgggagctcgccgcctcccttcccgctggatctggcggaggggagggcgcagccgccgccgccactgcctcaggcagtcgcccgccgcgggagctcgcccgctgcctcaggtgccggttttaactgaaccggcacagataaatgtgattctaggtctttttcagagattaaagataaacgaaaatgactctgatgatcctcttttagtaatgtgtagttggagaggagatggttgttggatttaagattgggtgaaaattaaataagaagtggtctgatggaggaagcagtactctaaaatctcttatatttatggataaattttgaacccaaatccattatatatgtttgtgcaaagaaggaatacttattagcctcgacatgatacttattcatttcacgcacggatattattaatatttattttgtttgttgcatgtcaccatgatatatggtacgcagtaaagactttttttgtccattaaggtggtcaagtgtacatgataacagacttgaaagtttcatctgtagcattttattgccaacttccaatgataattcagtcaacttcttaaacatttacattttcaagcattgagagtgtttccaaagaaagtatatttatgtggtaaggtgttggtttggagtttggaccattatttattggcaacaaaattgattgctatcatagtaaaagtttcttataaactttatattgacctcatccttttccttatgcagatatcgttgtcttaacatctcacttagctaggactgattgaagaaacacagtaaagtggtggaatgagaaatatccatgaaattatactctaaactgcgtaagtttaattaatatcatttaatccttataagtattgggagcagtttatttgaattttaagcatatgcatatatagttgaaacaattcgaatcacactatatatatggagtgacaagaaggggataaagttgggttttttttttaatcacgagcaagagtactgtttcatctattttactggaagaaataaatttctattcgtaccttgatttgtttatatatatctagatttaattttgcaatgcattgagtgatacacgatgacataatttatattctcaacatttttcaaaatcttcatggttatttagaaggcatgcaaataatcaataatctttgccccataatgcttcacgaccattttatgataatttgaagctaaactgcattacaaataatgaattgagtggaggaacatgccatgaaacttgcccataaataaattagggaatataagaaaattgccacatttgtcaaaatagcatgacattattttgacagtttatatatatcttaggtagatcgtactatcatcacaattaaatattaaatcatatccataattcatattaaataaaacaagaaaattcaaatatcatggattatgaatttgatatctgttaatttaacccaaaatcaataattgtacaatttagctaacatgttcccctataaaacgtgttagcttacattgacttttgtttatcctgagttatgtaatttgcaaattaacaagcatgtttagtctatgattaagattttactatttataaaagaatttgctatataacaaaatcctgtgcaatgcacgggttagcgactagttcttctaacaaatcaaggccgagcggcgtgggggagaacaacgcagatgcgttgtggaggtcgtggcctcgccggttcgtggctccacgcgagtgttcccctccccatcccccgagccggcgatggaggaagaggaagagatggcggtgaaggaggaataggaggcggcaaatctggtgcctaccttgatgacatccctcgagtcatgttgtcgcccatcgtcgtgcctcgcttcaagccgccggacccgtcgtcgtcctccgatttgcgccaccgctcgtcgtcatcacctgctccaagccacagtagcctcctcgacccctctgtagcctcgacggcggcctccatgacctgtccggtttgatgtgccaccgaggaggcagaagccgcgctgctgctcgtcctcgttgcccccaaccgcgggcgccaacgaggagagagaagggatttggtgccggcgatgagagaggagaagggatttggcatcggcccaagctactcaggtacgataacatggtctatcataggtgtgttgaactagtgggttgattgttcagaagctaacacgggactttgtgataaaacaagttccgtggtatggcttgcttgggaactatgacatgctatgtgctaaggacataccttgctggatcaagtgagtcatgccttctcgaaactagccgtgcgtccttctctgagaaggtcaacgacccatagtccatctggcttgccaggggaacccctcgaccgcccgagaagggctatcattgtgtgtccgccgacctaaggacgatggtgtcgcctgtgggtttcacgtcccagttgatgcagtgcatcagctgccgagcccatccatcgcattaatcatagattctcttcggcagtcacgttactatatttccaaagtcaggatttcacactgcctcttcataagttataggatgctgcaggtgggcttggcgtgacatcccacggtggtttttttcaacggcagatacacaggcgctggccttgaaggacataatgcaagctcatgattgtaaaacaatgttttatgtctctcagcagagtatgcatgacagaggtgatagggtataaaatcatggcggcaagtgcataggagagattatgagattcgcccaaagttatgtaccagacaacacatgacttgggctattatccagtaggaggcctgaacccgtatacttgttgtgcgtgtgtttgttctgtgcttctgagcagctcagagtacggcaagacgcctcagagcccctctagatcctaaaccgttgttccccacaactgccaagctcatctctctggtagcgggtgatggctagatgtagcccccaagtctagatttgcactagtaatgtcagcattgctcctggtcgcacatggtggtacgtggggagaagaaggctaccatggatgtattgtgctatgggatgctcccgtgcgatggccagtctgaattagggagggtggatcttttctctctcaccatcttcctccgcaacccttctcgcaatgctgggaagttgttaatgtttcaactgcttagaggcctttgtgggcggttcggtaatagccctttgcatgtttggcagcattagcgacagtcggttcagtgcgagttttgagcgtcgacatgtgggatgtgtgtttgtttctttttccttgtcgcaattatagtttacagtaatatataattttgtaaattttttctgctatatcaatatgaaacatcgaaatgtacaattcgtttggagaaaaaaatttttgttggaattaggaagcttggcattgttgaactaatttgtccaaaaacatattgttccaacatttaattagaaagttatttaagcagacgttttcaacactggagtagaaagtttcttcctactaagttttagagcaaaaagttataaatacaacattctaaaatcagggtccagtcttgcacccggcctcccgggttcaacggtaggcatgcgtcctatatgtgatccttcagcgtatccactggttgatcagttaaactattgatgactggtttgcccgtgacgcacggtatttctagtgtgcttccctataaaatagttgttcacttcttctagagttaaccgtaatcaattgtcttagtggtgaaagctagcgtgtacctatgtaccgcacatgcaatctgtccgtgcctttatcatgatttgtttccataatataatcaagtgtttagaggggacttcaatagtccatggcccttctcagggggtagaattaatattttggccagcggacatgttgtatcgttgtgcttttcgtgcatacacggttgttgcttcgaaaaatcctactagcctagtttcagcgtgtaaagttttagcgtggcatatcggatatacggatacacatttaaagtattaaacagaatctaataataaaataaattacagattcaacctgtaaactgtttggtgaatttattaagcctaattaatctgttattagcaaatctttaatatagcaccacattgtcaaatcatggcataattaggattaaaagattcgtctcgcaatttacacgtaatttgtctaattatttttttctatattaatactctgtacacgtgtcaaatatttgatctgacagggtaaaaagttccatgggaagtaaacaggacctaacttagtttgtttggacgagttgatgtcgttctcaaactactagttgactgactaggaattgactagagaaggtggcaccatttacgtgagaactacggtttatcttacctcgtgcattccaaagtcaaaggactaatccacacgtaaacctaccactggatttattaattagagtaaattgtattagtaacacacgaacttattacactggtggagaaaccctttgtagtcccggttcgtaacccccctttagtcccggtttccaaaccgggagtaccaatccgggactaaagatcgctatctttagtcccgggtgaaataaccgggagtaaagatcgatctaccaaccg

SEQ ID NO: 28408 - DNA, 5057 bp, Oryza sativa
catatatatatatgtatgcatatatatgtattgaaacatatatatgcatggtttatatatatatatatatatatatatatatatatatatatatatatatatatataaaccatgcagcaacaggggcatgaaaaaaaaaaaggtcagctctatctttagtcccggttggtgttaccaaccgggactaaagatagagctgacctttttttttttcatgcccctgttgctgcatggtttatatatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgttagctcagaagctaaggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccacttgtcgcccagggaggatgatgtaccgcctgcgccatagaataatggcatggcatgtgtctcgtagatgcgtctcaccgtctcctctagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcaacctcctcttcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaaggatgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaattcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattacattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatacatgtatatatatatatatattgcatttcacgttaacgttcgtcctcgttcgt

SEQ ID NO: 28409 - DNA, 3988 bp, Oryza sativa
gatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatatattcttagcatatatatgaatgatattattatattggtaaaaactctaattaagatattaatgtacatactgcatgatttaaaattaataaaaattgtaatcatcatatgtacttagcgttggaattatattaaattaaatgctaacaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtgtcccatggcatcgacacgaacagcgctgttttggttcgtgctcttcatgtcctgggctctcgtgtagaatgtgtacccattgatctcatatccctagaatgtcgcgatagacccagacggtcccctcgccaggaaggcaagtgttggttgatcgactcgttacccatgagatgttgtcgtagccacgcggggaaagtatcaatgtgatgccgtgtaatccatgcaacggacttaccgatgttcctggcgcgaactagagccaagtgctcctcgatgtaaggagctaccaatgaagagtgttgcagaacagtgaaatgggctttacggaataaattgttgtctaccgtccttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgtgttcatgaatgcacatagctttgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgttgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgctttcccgctgcgatgtttaggattcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaagaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccatagtggtatccaactttttgtgcccctgctcgcaacctgggtacaacgaagttctgcggtcctccaacatcttgtccaatttatgggcctacttttaactttcgcagtcttccctggcgtgctgcaacatctgaccaagatcatccgcaacgtcgttaccatcagcagctatttcctcctcg

SEQ ID NO: 28410 - DNA, 812 bp, Oryza sativa
ggtattaccaacggggactaaagttaagatctttagtcccggttggtagcactaaccggggctaaagatcaccgggatctttagttccggttggtattaccaaccgggactaaagttaagatctttagtcccggttggtgctaccaaccgagactaaaggtcccgggggggcctgacaggtcctgacagcattcgaaccgggactaaagatgatctttagtcccggttggtaacacaaaccgggactaaagatcaaatatgcccgttacccttttgaaccgggactaaaggtcatctttagccccggtttttattgcatccgggactattgtggaaatcggccgaccgacgaaagatggtttctctaccagtgttagatgggtgtaatttaatacataaacttataaaatgctcgtttagttacacgaacttgtctagttcgtgcgaacgagaaccaaaatagcttcgcaatgttaattttacaaaagttgatgttgattagaatgtgacgtgcatacgtgtaatgagtatgcataagacatataatatttataaatttgatctgtactttatccttcatcatggaagtgatgaatttcatatatttctagcccttatattattactcggtttttttttatcattttctacgatcactatatctcattctatttttattgaagatgtgtttttctaatagcaaccttctcagatatatatttacctagtatcccgatgagcccctaaatcagtaagattggccatgttgtttgtttttcgccttcctccgcacgcaccagacaaattcatgt

SEQ ID NO: 28411 - DNA, 829 bp, Oryza sativa
  unsure (1)..(829): unsure at all n locations
nnnnnnnnnnnnnnnnnnnnnnnnnnnnnnnnnnnnnnnnnnnnnnnnnnnnnnnnnnnnnnnnnnnnnnncggttatggtacgattctagattggtttctgcttggcggacgaatttaaattcgatagtagatgaataagcattgatctcggcaccaaagtcgatagtgcaacatcctgtgccgttgcaatgctgcataggagacaccatacccgtgctctctcctttaggacaggttgctgtgcagttgggagttgctttgttgattgatggacgatttaaccaataaacatcaaagtcacagccggagaaacgtagtccccacagcgtcaggtaaaaagcatcaagagaatgttcaagcaattttggagataacgaccagctcacaacggatgcatttctcatggagatggtatgagaaaagcgggtgctaacactgttatctgtgtccataaactctgtagaaacgatgttaatactaccagcaatttgggtgataccatcgtggaagaggagtctcggagggcttgtggtggagtcgcaggtgagctcgaagtcgggacttcggaagcagccggagccgatgccgaaggggtacacgaaggtcagatcgccgcatgagctctggcaaccggcgagggtggccgttgatggaaccacccggccatgcccttcttgccttcttggcgcagccaaatccttcgccgatgtcagtagcgtcgtcgtcgccagcaggaagacaagcaaaagttgcagggaattcgcggcgtgtggtgagcggatcatctcgctcttgcctcatgcctcttggggtgtttggagtagaat

SEQ ID NO: 28412 - DNA, 427 bp, Oryza sativa
caactccactccagactcaactcctggagttatatttaggagttggagctgtaccaaaacccgtagtgtatgagttatagtagtagtgtacgagtagtagtagtggatctgatggtcgcgtgcccgcgtgaccgcgcgactgatcgcgcattaggggcgccccattccagtattccactgcttggaccactccaggcactcccgtccactgggccagctcgaagtggactcaattgggacaggagaaagaaaaaagtctattttgtagtgcccgagttggaatttttctcagccggcctatacaatcggcatgtgggctgcaacactgtgctctgggcctctggaccgccgacgtgtcctcggtcctccgctcgagcggtacgaatgtacgattgggcttcaaaagccttcaagcaactcggtgtac

SEQ ID NO: 28413 - DNA, 687 bp, Oryza sativa
ggcaactccagctggtaagcaacttctccgcgtcgagcagtgatacggaagggacccacataccgaggtgcgagcttcccttttgtctgaaacctgtgcacacctcgcaatggcgtgacccgaagatacacaaaatcatccactgcgaattccagatcacggcgacggttatctgcataacttttctgccgggactgtgccacctttagattttcccgaatgattctgactttagcttcggcttctcttaggatgtcagtcccgaacacttggctttccccaacttggtcccacaatagcggtgtccggcatttgcgcccgtacaacgcttcataaggtgccatttgtatgctggcttgatagctgttattgtaggagaactcggcataggggagactcttatcccaagtcttcccgaaatctaggacacatgcgcggagcatatcttctagaatctgattcagacgctcggtctgtccatctgtctgcgggtgatatgcggtgctgaaattcaaccgagtacccagctcttcttggagcttcttccaaaagtgagaggtgaattggcttcccctatcagacacgattttcttgggaacaccgtggagactcacgatcctagcgaagtagagctccgctagtttattccctccataggtggtcttcacaggaatgaatcgagccacc

SEQ ID NO: 28414 - DNA, 713 bp, Oryza sativa
aaaaccacaacaaacttatccaagtattccatgaacactttattcattaagttcatgaagaaggcaggagcattggtcaagccgaacgacatcaccgtgaattcatatagtccatatcgcgtagtgaatgcggtcttcggaatatcttcttcacgaatacgtaattggtgatatccggaacgaagatcaatcttggagaatacagtggcacctttaagctgatcgaacaaatcatctatccggggaagagggtacttgtttttgatggtgacttcattgagagctctgtagtcaacgcacatccttttcgttttgtctttcttctctacaaaaatcacaggagcaccccatggggaagtactcggacgtatataccccttttctttcaattcttccaactgtttcttaacttcggctagctcatttgctgccatacggtagggtcgcttgtgcagaggagtggttcctggagcaagatctatccggaactcaatctctcgcttgggcggcataccaggtagttcttccggaaacacgtctccgaactctctgactatggggatttctgacagacctacctgatgcagttctgaacttctgacagaggttggaggtgcaaagaaaacaaccggttgttttggtcctcggtacagggtgacagtgcgtctcgcgcaatccacgactccttggaattgtgccagccaattcatccc

SEQ ID NO: 28415 - DNA, 248 bp, Oryza sativa
gtgcgccgccgtcgtttcagccgtcgccgtcgctcgagaagaccaccgtcgtgctcgccaagtcgtcgccgtcctcgtccgcctcttcgccgtcgccggagatcaccggagcagcatcgccgtcgtcgacccgaaggtttccgccgcttcctcctcgtcgccgtcgccgcccgttggtcttccgccgccgttttggtcaccggtgagttcgccgcgttgtcctctccgtcttggtgccctccgtttgc

SEQ ID NO: 28416 - DNA, 536 bp, Oryza sativa
atggccagagtggtttgtttgcatggtgttcctaagaagatagggcagatagaggtagccagtttacttcaaagttttggcagaaattacaatcagaattggatacccgtttgaatttcagtactgcttatcaccctcaaacagatggtcagacggaaagagtaaaccaaattttagaagatatgttgagagcctgagttttagattttggtggaagttgggataagaatttgccgtacgcggaattctcatataacaatagttatcaagctagtttgcaaatgtcttcgaatgaagcattatatggtcggaagtgccgtacgccgcttctttgggatcaaaccggtgaacgtcaagtttttgggacagacatattgcgagaggcggaagaaaaagtgaagattatccaagaaaggttgcgcgttgctcagtcgcgtcagaagagctatgccgacaatcgtcgcagagatttggcttttaaagaaggagattatgtataccttcgggttacgccgttaagaggagttcatcgtttc

SEQ ID NO: 28417 - DNA, 607 bp, Oryza sativa
aaacctacccccttaaacagaatctcgtcctcgagattcggaagaactggcgaacagatgcggatgagctgacttcaattcatcttctcgttcccaagttgattcttcttccgagtgattactccattgaactttgcaaaaacggataactcgattcctggttcttctctcatttgtttccaagatacggattggtttctcaacataggtcaaatcctcttggacttctatctgttcaagattagcttcttcggtaggtacccttaaacacttcttcaactgcgacacatggaacacattatggactcctgccaaagattgaggtaactccaactgataagcaacctctcctcttctactgacaatcttataaggtcccacaaaacgcggtgccaattttcctttggtgtggaaacgatgaacccctcgaagaggcgtgacacgaagatacacataatcttcttcttcaaaactcaaatctctacggcgattgtcggcataactcttatgtcgagactgagccacacgtaatctttcttggatgatctttaccttttcttctgcttcccttaggatatccgtcccgaaaacctgacgttctcccgtt

SEQ ID NO: 28418 - DNA, 2774 bp, Oryza sativa
aatagattaaaacttcggaaaatcataactaaataaccgtagatccgttttaggtggttcaagtttctaaatttttctaaaatcaagatctacatgttaaaaatatccacatgtactgtttatgcttgtttttgtactgttttgttgatttttgtttatttgcttagtttccgacgttccggaggagagcgtttccgttgaggaaggttccgaagcgtttgcggaagcccaaggcaagtcacacagatcccaaacaaccctttgagcatgttgaacccatttaaagctattattttatttcaactatgcattattttcgaatgtcatcgggtggtgaacctttcccagttaattaatggccggagatgactttattttcctatgggttataatttgattagcatgaaccttatatattggattggttcagctaaatgccttatgtaagtttgcttatccatgcctagaaacatagctaactaaaggggttaattataaactatattatgtaattattaattagggttatattcaatggtagctcacgatggtaaatcgtgtgatgataattaattgataattaaaacctgattaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatggtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtaccgtggtggtactgaggcacatggtgacatgatgtggggttgtgtcttgtgggtacggtggtacacctctgatcagagtttaaactattcgaatagccgtacccgcggttatgggtgagttgagcaatgtttttcgtgattagtctcacactactcttcaatggtaataatgtggtaattaatttaattcctggtttggaatggctaattcctggtttggaggtttaatttgttcaactggggttggttgtacaaatgtggttgggcctatgcaacacgggtgtgttgtatggtgtttatttaatattgattaattatacaactgttttactattctcttaaatatttattaaatgctgtttgctgcaaatgaactgtattatgccatcctttgttatcctgtgcacttgcatatttgctgtgtggcttgttgagtatgttatatgctcattcttgcaatattcattcatcagaagaggagtacctcagtgaaggtgatgatctggaggattaggcttgttcttggttaagttgcctgtggagtggagtcgccatagctgttccgtagtttgttttagttttgttttccgctgcgtagaatgttatttgttttgagaggaactatctacctctgtaataattttaatttgcgaatatttgatagttaattatttgtactctattatcaaattgtcattgtgtgcctcggttgattcctggacgagggttaacacacatgtaagcgtttggaattttggatagaaattccgggcgtgacaccgtcaacttctcctggatcgtcccgtctaatcttgtatcgtagtgctttgcaaacagggcatgcttctaggttctcatactcctcaccgtgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaacgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaatattaactttcactagagttttccttctcaactattttataaaaccatgtttagcaaatgaactaaatttctatatattctttcttccccacacacattttctctctcatcaacttaca

SEQ ID NO: 28419 - DNA, 217 bp, Oryza sativa
tgagaagaactaccctactcatgatcttgaattagctgcagtagttcatgcgttgaagatttggcgtcattatctcttcggtactcgtacggaggtgtataccgatcacaagagtttaaagtatatctttactcaaccagatctgaacatgagacaaaggagatggttggaattaattaaggattatgacatgagaattcattatcacccaggaaag

SEQ ID NO: 28420 - DNA, 710 bp, Oryza sativa
ggcggcgagcttggcgcgcgtcgcggcggtgctacgaggcacgagagaggacggaagagggggcaaacggaagaggagaacaaggggaagctttatatggcattggatcgaagagatcgaactccaaacgagaggaatcgattcgggaagaaatcaaactcggttttagggataaaatcaaaacgaattcgattcggagagaatactcaacgattcgttttgattcttgggggaaaagaaagaggagaacgagaggaacaaaacccctaaatcaatcggactcgaggagaccggattggagcggatttggagggggaaaacggcggctcgggcggcttgcgcgacggcggccggaggttgaagacggccctgacatgtgggccccacatgtcagcggctggaggaggagggggcgggcggctcggcttgggccggcatgggccggttcggccgcgcggagagagagagagtattgggccgaattcggcccaatgaccaaagaaggggttttttgaacttttttaaataaaacaatttgtgaaatgttgtttcaattattaaaaatacttcccttgctcaaataattcccagaaaattctagaaaatagaggagcaagcatagtatttaataaaattttatctagctcatttttatgatgaaaattttcctagaaaattagggtttagcttgtaggcttttaaaatagttt

SEQ ID NO: 28421 - DNA, 160 bp, Oryza sativa
caacatggttgctcgtcctgcagcaacttcagttcagaaccagcctgtcaggaaggaacagggaagcaagccaggggtgtgcttcaactgtggtgatccaggacattatgctgataagtgtcctaagcctcggcgtgtgaagaacgctccaaccccgaac

SEQ ID NO: 28422 - DNA, 418 bp, Oryza sativa
caaagctagttgtaaacacgatcctagaactaaacaatgttattaatcaaggccgtgaacccacacaaacctgccttaacccaaggcctatgatgattcacaccgaactgccaacccgaccctgggtcccagatcgtcctaagccaacccaggccaaccattccacattttaggtgttgaacaaattcgaagaatgataacactaacttgcgtacatttgataggcttacccataaccgagggctcacttattcgaatagatttactcttcatcagagagtacatctttacccacaagacacatcttcctcacgtataaccacctgccacataccaccacggtatacagacgaaagacgtgacatagtttccaacccatcctaaccttagacaagagtaccgacccaattccccctac

SEQ ID NO: 28423 - DNA, 705 bp, Oryza sativa
ttaaataatgctgatgtatattatttttagagaaattatggtaccgtagtacggataatccagactaaaatgaacacgctcttacacccatataagcaagcaagcaagcaagcagagagcaaaacagagcagagcaggttgtgagccagcactgcatcagcatgatgagcagtcgtcttctcaaacgcgcctgcctcctcctcctcgtctcgtcatggctatgctccctctccgacgccaagaggaagacgccaccctggccgccgccgccgccctcctcctttggcctccccgtccgggcggtgtgcctcggtggctggctcgtcacggagggctggatcctcccctccctcttggacgccatccctaacaaggacctcctggtatggccgtctcgccgccgccgccgccgccatgtccacgaatgagtccgaccatgacctctgtttcgttctttggtggtgccaccgcgccgctccggcataacgccgaacacattgattgcaggacggcgcgcagctgcagctcaagaccgtggcggcgggcgcgtacctcaccgccgccgaccagggcggcgccgcggcggtcgtcgccaaccggacgcagaaggcaccctccgcctcggagaccttcaaggttagcctcgccaccgccgccgccgccgccgccgctggctcgccggagtacggcgtgtgagtgactttt

SEQ ID NO: 28424 - DNA, 677 bp, Oryza sativa
  unsure (1)..(677): unsure at all n locations
nnnnnnnnnnnnnnnnnnnnnnnnnnnnnnnnnntggactatggtgtcgaggatattgagttaaaaaataacttggagtttttgtaccttgcaaaaatcgatagatcttttaatttctatatagaaataggggcctgctaatgtgtgtgattagaccgagccacgtatctcggatattacatatacacatgctaactaatgtttaattcatcggatagaaatcaaccccaagtcatagtaactgggaggttaaaaatgaaaatcgtaatggtccaaaaactacatgatcctagcgtgtattgattcggcattaatttgataagtggttagaggaggcccggaataaacggtattttgtactgatatttttatttcaccaaataaaattggtagtaaaaaatttcaacaatcacaacgtggataataattattttacgatgcatattattacaatcgatcatcacaacggacatcgacggtggcaagtcgtgtaggtgcccgccgctgctcctccatggatgccggaggacaagctcaccgccgcgaaggttgacaccgtacgcgtggtggcggagcagcggacggatcctccgccgtctcgcttgcagcccgccgtcgtcacctgtgcaggatccacgcccacaactgcgctggatctgcactgctgtagccggaac

SEQ ID NO: 28425 - DNA, 613 bp, Oryza sativa
ggctgatttctggacgagggttcacacacatgtaagcgtttggaattttggatggaaattccgggcgtgacagtagaccggatataaagggtattggggtacgctggtacgaggatctatgtagtatgacatcaagcaaacaaaagacaagcattatactggttcagaccccttggtaggtaatagccctgatccagttggtatgggattatatgatggaaactacagattacaaagggaataacagaactcgatgataccggcgagaccgtagtcgagttggtccgactagatctcccggcgacttggctcctgtaggctctgacttcataggctgtggtggatgtgtcggcggtcagattcgatgcgttaggtcctgcccaggtggtcccttttataccgcgggtcagttgatctccaagtaggactcgaaaatatcggacccctcacgatatggtacgacctagtcttgttcgagtaggactccctgcatctgtggattctgtttctatcacgtgatagatttccttaatgtatacaggaactatccgtatacgcgcgggtataccgtatcagtatacaacgtatatccaaggatagagggtataccttt

SEQ ID NO: 28426 - DNA, 452 bp, Oryza sativa
tggaatttgaattgagcataaatattcttgatttcttttatatagctttgattaaaatactcttagaatttatttcacatggatttttaataatattttagtggctaatatttcttacttttataaaatttacttttctatggattattttcctagccatactcctatttaggaagggctcttttacatatttattgatttggatattgtattgaaatcacactacaccggacctagtcatctgtgacgggctctaaccctcacctttgacggatttagtctaggttacattagtggtcactgatgactacacctcatctcaaacgggtgaaagcccgtcaatgatgattgacacctctgacggaccgaacaaaataacccgtcacaggtgagtctcacctgtgatgagtggatcttttcagcccgtcaaaggtgataaacacctctgatag

SEQ ID NO: 28427 - DNA, 11167 bp, Oryza sativa
  unsure (1)..(11167): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctgtacatagtcgagaagtgaaatttagtataattttaaggtgagaaaaaaatcctcatagcaaggatttctaactgtatacatcaataaaagactaaactgaaaaacggattcgctacatatgcttttgtaacaataattgcgtaagagaacatgcatcaaaacgtaaaacaaaacgtgctccagatctattcaatgtttcacaacatggctgatttgacttagataagtttttcaaaaattgaagtttgaccataagaattatttcgcaatgctgttccacatgttgatgaccagtatatagtttataatctgtgaaattgttcaagcatgtacggaaagcagagcataaacatccatacctctcgttgttgttccgggttcgcagaagccaaggaagtctgaaggttattgcttggagcttgcaattcccccacgggcaccacatgcttgacagcttgttgcattggctgcattgggctagagaagcgatggtgctgatgcaacattgctgggttggccacaccattcctacgatttggcatgtgtctgaagccctggttggcattttggtgaaacatctacaaagtaacaagcaacgatgttaagtgaagtgaatcctagttaattattaattgctccctccattttaaattagtacttctctttctagacttattctaagtcaaacattttagtttttgacaatcattttttctaaactcatgtagtttgacatcatgatattcatggatttagattcaataccttcataatatataatttacttgtcaaagtacactgttttttaaaaattaatggtaaaaaataaacatgtttgactaagagacacctagaatgataagtaattttaaacgggggagtagctgaagttgcgagtaattgacaacattagcaaaaataagtagatatgataattggatacaattagatgctggatctattgtgttaaaaaagaaaaaaaatatgacaatgatttagccaacaggaatacctggtgaggattatgcagatgtctaggcattcctccatgcggaggaccactcctctggccaggctgcctttgcatgttatatggcatcatcatgtttggaacaaaatttggttggaacccaaagcctgcaggtggtggtggtgggaacaaggcaggcacaccatggccaaaattgaactgatggggagcaatgtttggccctaatgtaggtgccattgttgctagggctctaacacgagcaaaatgtgcctggcaaacaaagaagatatgaatatcaagcttaacaaacgacctttgtaacatggaaaagttcaatgttagcatagcacacttagtatcaagtgtcaatgttaagaaacaaaatgtactttcagttttttttttcatgaattacaaaactcacaagaaaagataacaagatgtacaaaacctaccctaaaaatcaaattcaaatgtaatagagttagtacataccgctaaaaatgcctttctctcctccttccgttgagctacggcaacatataatggctttttcccaaccattttcccgttcatttttaaaatctataatatttttaaaaatattaattgcataatactgaaaaatatttagaactatggaattgggagtatgaggatagcacaaaagaatcattttttaacatacagcattgttagcgtcttcaacagttgcaaaagatacaaatccacaacccttgctccttccatgcgaatcaagcatgacctacaacaattgtaacttggcattatatatggaagcgtaaaacaaatgacaactcactaacagtaagcataacatcaaacaaagtaaaacaaatagagaacataccttgcatgatgctacctcaccaaaacattcaaacaacttcctaagatgctcatcattgatgtcatcatccaaattcttcaagtatagattgactgtttgaagcttctcaaatttctgatttttgtcatgctcaaatttcgcttttaactcagcttgtctttctgattttttctgagcccttgcaacatataacaccatatcaccaatggacttcccattgagatttttaactgcatttctagcacattctgatttctcaaagtttacaaacccaaagcatctcgacaatccatttgcatctctcatgacaatagcactagtaattgcaccaaatgatgaaaactcatttagcaaatcgttatcactaaaatgttttggtaaatttttcacatatacattagtaaagttgttagcgtctccagtgtgttctctctcctgccggcggatgaacaatccaacaaatattttttgtccattagccaacatgccatttaggccattgatagcatccttagcagacgactcgctctcaaattgtataaatccataacccttagactttccattgaaatctgtggcaaccttactggagaggattgtgccaaaagacgaaaacatttcatacaaactcttgttgtcaatattcggttcaagattttttataaacacattggcaagtccactttttcgcagagttggatccctattcgaaaacatgactctgattggcttcccattgacaacggtgaagtttagattttccatggcacgggtagctgcaatcaatcaaactaaattaaagagttgataataaattaataagttgatattagcgggtgtcaaactctcgaaatacaaaatacaacgaaaacaaacaaagatgcatagtataaaactaaacaaaatagaatttcccttctattcaaattaaggtatcacaacacatagtttcataaaaaaaaaatccaatgctcacaattaacatggaaccattgtactccactatataatacatcgttgccaacagccctacactcaaaagtgatcaccccattaaaaaattaaaataaatataacagattaattaaacttacaatattatcataacaacagtaataagtatatgctactccaaacgaactaatttaaacaaacaaaatttacagcatctcgcacacagataattaataggtacaatatatagcagatcgactacacacaaactagtaataataaccaaagagataggcctccgtaagctaaacaaagcgataaacctccataatgaacagttgatcgacccgtgcccatacgaagtgatcacgtaaattaaccgaaagcttttatcatcaggaaaaataaatcttcaagttaaggccgatcactacacccagaccatcagaattctgaacccacgatcgaatcgaagccgatcacccgacaaaatgagaagtaaaaggaagaggaggaaaaaactaaccgtcttcacgcgacatgaagttgacgtagccgtatcccaaggactttctgccgccggcgatgtcgcggcacacataggcggacgcgacgggcgccacctgggagaagagcgccacgagctggtcctccccgacgctcgcctccaggtctcccacgtacagcgacgcgccggtggcggcggcggccgccggggccgtctgatcaccccccgccccctccgccgccgccgccgcctcgggagccggatcgccggctagcggctgagacgccgccgcggcggcggaagcaggcgcgggaggggacggctgatctacgaccgatggcgaaggcgtggggatcgccattgcgaaggaaccgcggatcggcggtggcggcgggtctagggtttgggccgacgcgtcgccgacttcttccgttacgacgctcttctctccgttttttttttcctttattttttttttcaccccgggtggggatttttctggggattgcagagccctcgccgccggtttatatatatcggcggcggagtggtaggtgggcccacggctcagtgtcagagtcggtagtccggtacgaccgcgtacggaggcaggtggggcccaggtatcagtgagacactaggactccggttgtttcttttcttttttttttttttccggctaaccgggcgcatgcattgcatggttcgggggacgggttcgggtgcggtgcggtgcggaggcggggtgcagttatttcgtgttccgctctcgtttgtttgccggagtcgttttagagatttcaagatgagacgactcagacgagtagggggtgaaaatgggtcgggttcggtcagatctcactcctcctatatcctaatccatattttataatcggaatcgggtcggaaacggatagtgtcgaatacggattcaaactcagataatgtccgacaaaaatacggaacgaataagtaccaaaacggatacgtacactatcggttacggatatttattcggatatcaagtcgaaccaacaatcttatatatcacgtactatctccgtcctaaaatataacaactttcgtctataaatctggacatatggttatccagattcattgataaaattgcttatattttgggatggaaggagtagacaataaccatttaacaattccatatatccgtaatacgattatattaggccattaggaccttaggaaataaacatggtataatacatcatagtagaaccaatacatagtacaaaaaggtgcttcacaaaaacataatatgggtaatatccgggaaataccagaattttttaccgaataatccgtattcgtcagatactatgttaccgaacccgatctcgtatccataaaaaaggacccgtatttggacccgatatccgtgaaaagtcccgtacccgaatttgtcacgaaataatgtggccggacgtgtgggcgggaaatacctaccctgttttcacccctacagacgagcgtataatttacaaaccatgtgttgttttctctccgaaacacgctgttctgctttatagattggtgttattttgaactaggaaaaggctataaggactaactttttcttactagattcttgtatgctaataacactgatgtttatgctatgagtgtatctagatttgtttttttaacttctatctacctaaatcaaacaatttgacgattgttagtaaagtaagaaaaatttagtacgtgcagcagtgctctatgaattataccattttttaaacgggtcttgatttttacaagcggtggtttctctcctctatcgatctctagtctgtgtatcaatcatattacgcaaaaactaattggcgaaacctctcgttattgtcttatcgcgtgacactgcttagattcattcgatcgcgcacgttgtgtcatagctgttcgatcgtgcgagcagtggagaagtatactacgcacacatgcatgtctttttccccttataaagttttctctcgaattacttatccgatctacaatccgattacaccatcgtgttcattgcaattaaaatctttacaacaagatcttacatgattatattacgatgaaaaaaatatttatatttgtaaattgtttttattatatacgtaagttacttttatcatatatataaattgcttttagatttaactaaattactttttatacattcataatgctctgtgttgattatttttattattgtttttagtcaattctataatttatggactttaaatttaatttttagatagaccatatttttctccctacaacgaatttaattctaatgttgtaataatttacttctattttatgctaagttacttttatgatttatgtaattacttttaggctttattgaatttaatttcataaatatatttacttgaaaatcttctctacactttgcttgtgaatttactcaacataatttcttatttcaactcagttataacgtaattacttttcatgctatagagagttacttccattacatagctaagttgcttataaattacttttaaattaataaaatattttatatatattcaacattgatctcgtttttaaataacatattatttttaagaataatatgctatttaaaagatataagtcattagagaggttaaaaacgaaatgcatcattgtagtttttaaggcggatgaaaaacaatcgagatttgaggaaagtgttaaaaattgaaatgggctaaactttaggtgctattaaagtgaaccagtacctttaagtgctataaaaaccaaaaacgttaacattcgatactatataaccaatctataaattatgtatgaaaatatattataaagccatctacaaacatgataaaaagattggttaatcattcttttacgagctcacatgtaatactgtatattttttctgttgatgtatttttttaatactttaatcaccttattatatttattatatatgaattagagatagatatctgttcctgaactcgtctgggtaattaagttttcttttggatggggaagtatgtgtgtgtgcgtggaaaaaaatagttgctccactagtcaactgttgcttgaatgcaaatttgttgccgccttacttcccagcccgtggccgctctcaatatcgacaggggccgtcagcggtgctgtaaatggaataaattcatctaaggtatcttaacttgtcaacaaatccgattttcatcctttaaccgcaaaaccagatacaacgggtccctcaactgtcaaaactagtgcagatcaggtccctcggcggttcggacaacggttttggctgacgtggcgtctacgtggctaatttgacttggtcttgtggacacctgacatgtggggcccacgtgggtcccacgctgactcagccgccacgtagatcaaaaccggggtcaaaaccaccgagggacgttgggtgaccggttttgtatagttggggggaccgccggtgtctggtattgcgtttcaaggacgttttttaatctcggtgacaagttcagggacctccggtatacttttcccattcaagtcccttggtacagcccataacacagttggccttaggcccatacggcccattagtcaacaacctaccaagtaaccaacccacgcaactccagcttaccgtggccgccgccacccgcagatcagatgcaacacgcgcctcttcggccgctacagcgcctagcaattcggcgagtgactggtcgaatgacagcagtatggccatgccaagccaccaaccgcgctcgacgagaggggcccagcccagccaacggcgagtgtttgacgcgtctccgcttccggctcgatccgtagatgccggcgtcgagggagcaccgggtcatgcatgggcgatgggccttgtctgtactctctctactttccacctctatccgccttccagctactgttgcaactgttcttctcacagtcacaggctcacagcaatctgtattgtactctgtaggcaactgttcagctgaagcgatcagattctgatgttaattcttcgcatcatattcatcatacccaagatagatttgagattttgtgatgtattgcaggagcaaacaaaataaccgcggaatttttccccattcaaagttcaccaaaatgagctgcaacgcaacgccatttggagctgtacaagaaattttttttccacccccctaacccaagctaagctaggctgcatcttatcaaaatcctactccttgaaccccttgctgagccactgaatcaactgctacaccagcagcaatgttcatgttccatgttcttgatgttcatgtcaaccttgctggctcccgggcttgatgagcggctgctgggagatcttcccccactcctcgggagagcacttcacctccttgaggaaggccaccacctccttcatggtgggccgctccgcgggcgccgggttcacgcagaagatggcgatccccagcgtctgcagcatctcctggaccagctggtccggcatgccgcgcagcttcgggtccaggatgttcaccgctggctcgtagctccccatcttcttcttcgcccactccacgatgtggagggagtcgcccaccaccgcctccaccgcgctccgcccgctcaggatctccaggagcaccaccccgtagctgtacacgtcgctcttctcggtgatcttcgtggtgtagccatactctgaaaatgaggaaatgtatgtcaggataaatttcttggatgttttaagcatatcaacataatcttgggccaggcatttcaacaaacagtatataagtcaacaagcttcaatggacattgatgcttgtgatttcagaaacttgtgcaatggcagttaatagatagccagactgatcggtttcacctgcttaagctacaagcaatcaactagtcatggtcatggtcatggtcatggaatcagagcaaggttaagattactagaagcaactgcaggtcaaagattctttcttagataacagcattacccaaagagtcattaacctatggcattaactgttgctggtcttgtacactacattctactactactatatttctagattttgaagaaaaaatagcatgcagataaatacttgaagtaggaatcacttgcctggagcaatgtatccataagaaccggcgatgcgtgacatagcatgatgatagttgggggagttcatcagcttggccagcccaaagtcagccaagtatgcctcatacttcgtatcaagcagtatattattgcacttgacatcgcggtggagtatcgccgggacgcaatcatggtgcagataggccagcccttgtgctgcgccgacggcgatcttgtaccgggtatcccagtccaggctcctgttatccttcaggagctgttgcagattgccattggggatgtagttgtagagcaagagcttaacatacttgtttgagcagtaaccaagcagcttgacgatgttccggtgcctgatgtgccccaatatctgaatctcagcagcgaacgcgtcgattggctcctccttcgatgtcttccacagcttcttcacggcgatgatctccccattcggcatctcagctctgtacacaacacctgagcaacctttgccgatcacattctcatctctcaggcactccaagatgttatcgacgcagaagttcagcttctggaacggcgtgaacgtccacgggtgcgagaagtcatcgccacccgcaaccgacatgctcatcgccttcttgcccgcgagtgttctgcttctgttgatcaggatccagaccacaacaagcaacagagtgattgagcccagaacagcacagacaaggatcacggtcttgacggtcttcagtgccgtcctgcgaaccatgtctgatgcacaagtgtgcccgtcgtaggactcgcagaggttgggattgttgatgtaggagctcgatgacaatgtcttgaagaacggtgtcaccgggatcgcgccggagaaattgttgtacgaaatgttgagagatgtcaagctggtgagcccactcaacactgagatgctgccatacaagccattgctggagaggtcgagcgactgcagctgcgtcaagctggacatctcatccggcagctcgccggtgaacctgttcgagctgaggtcaaggctaatgctcaggctcgagagcgcgccaatctccggcggtatcggaccggagaagctgttgttgctcagctccagcatggtcagcttctgcaggttgcgaatcgacttgggcaatgtcccggagagcatgttgccgctgaggatgagcttgttgaggtagctgaagttgccgaagctcgccggtatctcgccggtgagcttgttcatgctcaggtcaagctgctccaggttcatgagctcgccgaactgcggcgggatggcacccgtgaagctgttgttgtggacgtcgagcagctcgagcaccgtgatgttggcgagctcgccggggagcgcgccggtgaacttgttggagtagaggtccaggaacaccaggttcggcagcttgccgatctccctgggtatctcgccggcgagctggttctcgccgagccggaggcgcaccagcgacgagcagtcggcgacgctcggcgggagcctcccggagagcgcgttcccgaggaggagcagcttgctgagcttctgcagcgcgaacacctcgtcggggatgccgccggcgaggcggttcctggacaggtcgagcgcgtacagctcggtgcagttgccgagcgacggcggtatcgcgccggagagcgcgttgccccagaggaacagcacctgcagcgccctgagctcgccgagctgcggcgggatggcgccggtcaggccgttcttgtcgagctggagcgccgtgaggctgctgcagttgctcagctccgccgggatgcgccccgcgagctggttgtccgacaggtgcagctgctcgagcgcggcgaggcggccgagcgccccgggcacctcgccggcgagccggttgccggagaggtcgagcacgacgagcgccgagcagttggagagctccggcgggatcctcccggacagggcgttgccccagagcagcaggctggtgagcttttgcagccgcccgagctccggaggtatcgggccggtgagcttgttcatgtggaggtacaggttgcgcagctcggcgcagccgccgagcgcggcggggatcgggccggacacgccggtgtcgtacaatgccagcgtctggaggttggcgaggttgccgagctcctccgggatggcgccggacagcgcggtggcggcggcgccgaagacggtgaggttggagagcgcgccaagggaggccgggatggggcccgacagccccgggttgccgccgacgcggaactgctggagcgcggtgagcgcgccgagcgacgctgggatggtgccgttgaggaggttgtcctggacgcagagcacctggag

SEQ ID NO: 28428 - DNA, 8578 bp, Oryza sativa
caccaccaccaccaccaccaccaccaagaaccggtcgccccggtgcgccattaccccccaaaacgatcaagaaaccacaaaaaaaaccagaccaaaaaagaagaacaaatctcccccctaatctacacctcacgacatgagagagagcttgcttgctagtgagaagattactttgagctggagttgcttaagccgcaccccagctcgcatatggagctagacgaggagatggatcgatcgatcgatcgagcgagcggaggcgttgctgctgctactgtcgccgctgctacacactcgctcactctccggtagtagtggtattaatgtgtttttggctaaaaccccggttgattagggttaaaacctcggtcgatttggtcttatctgcgcgtctcgggggttggaggaggagtatatttaatggagcctatgaacttatgatatgagaggtcgtctcaagctaggtcggggggctattgctaatttgctactgctgctgatgggatgagtgtgtttagtgttcacttgttgtttaatagttggggtcttggtcacttgctgcttggacttttactgccactgtgtgagttttcttttcttttcttgcgagaacaagtaagccaagccaccctcgtgagtgtggtttggatggatttataaaggcgtcagcaaaatgaggatgaaaaacttcagatgaaggttgtggttttttttttactgccagtgtttttccttagcagttgcgattttttttaaaatttgaataaaaagagtttaaaggtaataaaaattcaggaaaaaggatatgcatgcagttgagagggtttttttcatgttcataacgaagagtggattttatcatttagaagtcacatgctcgctagaataaaatgtggtgatcacggagtttccctcgagcaatatgaccacggttggtatttttgggagaatgcggtattcatgttatgagaaaatatagcacaagatacatcttggaatgaggattacacaaaatttcaggttttcgtaatgcttaaagtatccttaggttttgtgaagacaaaagttttaggtcatcgaatatgttttgtaaagacaaaagtccataaaggtgcaagttattgactacggataaaaagacgtagctcgatacacaatgggtagcctatgtatataagcagtttagacctagtaggagtacgactgatgttggtgtatgtagggagaatataccatcgagaagatttatgagatggattatggagacttcttgtttaaaaattctcccaaaattttcttatattttttcttcataacaatgcatcgtaacaataacgataaaccatcataacgaagcatgatttcagagcatctagctagtaatgatgtgacgagccgtgccaatctacgacaggatgatcactgcggggatgcaaacggactgacttacaaatctagcttcttatatgtcaaataagtggtaacccatgggttttcgcgtcgtggccctatttaccgcacctagagatgcaagcgggtcgacccataaactcatttacaggttgaattagtaggtaacccgtgagtcaatctacgggttaccccgcgggttggcccgcttgcatccgcggtgcctattgagagccttgttaacatatggcaaggtcgataggtgcttatgacggaacttcttgtcttacagaaactcaataggtctcatggatggccctattaacctagacaagccgatagacctacgtatcgtttcccgcatgtttgaaatgttcatcttgtttcaatataaacacttaggcttgaagaggtatcaaagatacctctagttcattctcattttttttcctttcttcttactaaacctttcctaaaactagcaataatgaattacatatatcggagagaattatcccgtaaatatgatatagaccttgtaattgtagtttacacgaaagaatagtgagatcatcacgacaactcgacaagcatgtgaaaaccgcaccactgacaaaaggcattgggggattgtatccgggataaaatcttactcgagcaaacctaggagagccgtcagccgtgccatgtgactgggggttagccgcactcccttgtccattctccaacagtagggcccacaagtcagcgtctctacgataatctccctaatcgaaaaaaaaaatgtctttcctgttctgtttaggcattgaggaaagtttcagtttcgcataataaaaagaagagaaaagcttcttgtttggtcatactagactcctccccattctattcatggccggccaatcactagcgagcataggtcaaactggggtacgttgcttagatatcacgagtgaatgagtgattattggcgattgtttgatgaaagaaaagtagaaaacatggggtcctactaatactgtcttctaaactctattcatcttaaaaaaacgttcaccttttacgggtagtattgtagccgagaaagccccggaaaataggggttgcatctgctaattaagcagcacgctttctctagattgcttttaataattatcattacaaactgcatttgtttgtaggctaaaaagatattcggttagccaaattttgtaaggtgtgatcatatataaaaagatcaaagtttgcaaaattcgatcaactagcaaaattgtaaatgcacccaaggcagtagtatggagtattctctccgtccaaaaaaaaaacctaatcctaaagaatactccctccgtcccaaaaaaatcaaatctagaactggatgtgacatatcatattacaatgaatctggacaccaatatgtctaaatccgtagtaataggatatgtcacatccagtacaaggttggtttttgatgggacggagggagtagtccaaatttttctttaaaattagattcttaatggaacagagagagtacggagttgcatagtggtatcctacgaaattgtaaattaggacggttgatatatcctccaaagtaataaatgtgtcctccaatggctataaacgacataccactagtacgaacctaggcacactagctagacaatatattccctccgtccaaaaaaaactcaacttagggtgtgtttagttcacgacaaaattgaaagtttggttgaaatttgaacgatgtgatggaaaagttgaaagtttgtgtgtgtaggaaagttttgatgtgatggaaaagttggaagtttgaagaaaaagtttggaactaaactcggccttagaagagaatgtgtttagattcattgtactagaaggggacacattggtcacatccactcttagggtaagcttttttgggacggagagagtataagtatatttggaaggatggtttactctttgttagttgtccaggcatattcgacgaagatttgcaagagaaattagctactccatttaataagagcaagtataatagtggactacaagccgactataaaaacatatggagaagataagaaaggagagagaagagaagcacgctatatatttgtagtcagttacaacactgattctaagatggtttgtatatcttagaggtataccaaatattaatggtgtaatatatatttataaataactattatatgaattagatattggattgactatatatgatttggagctggtagttggctatactattaaacttcttgtaataagtttatttttcgctcacttaatttattcaaaacaaatttatttttaagtaattattacatcgaagtttatgaaagtatgaaagaagtatataaagtgaggaataattgtattgtgatttgataaattaggggtatgttagttttctttattgatatgtgtggaatagggaaaactggaaaacgaactaattttgtaacggatggagtatgttctacgtatcgcgtcctaaaataagttaatttcttatttccaatcttgacgcacttgtttagatttgtatctagaaaataacttattttagatagtgggagtaattttgaagaccacattgcattaaaataccccccatagaattaaatgtaggaagtaaggattacagctctcgagtttaaaagacaattatgttattatttaatataacatggagaaatgatcttaaaagatgccgttattgtcagcaagaaacaatgatcattctcacgcaatgcacatgattgaacaatatacttaaacaccaattgaatttctttataatctatctattatatattataacgatagctcgaaaaggagggaccaacttcacatatatgtatgggatataaattcttggattataagaaaaagagaaatattttgatcgttacacatggtaactacatgttttaatgatatagattaatcgatgtagttgtatataatataattgtatatttaaaacagaaggcaagaattgtactctgaccatttgaaattacttatcgttttattagttcctatgtcaaacacatctatctttgataattaatttttaaaactccgtatagtttaacaacaattatatattataaaattatttattataataaatctaaaatataaattgtattatgttaaactatatgagtttatacaaatcgatggtcaaagactaaaatatttgatttaggataaacctaaaacgacgtgcaatttaaaacagaggtatcaaatctaacaccacttcaaaattctattatatataaaacacagttgtaggtatggaacataagctaagagaaatatatcaaatctaatcatacttttaaaatctattggatagaaaatacaatcatatttatgaaaaagaaaaatatgtcgattgtatataaaatctaattctgaacgtggaaaaacccgccagtttctttttaaaggatgaaagagaaaaaacgaagtggcattgggcttttgggttaatggacccaaggaccaagcaaaagcccatggatacccgttgggattgacagcaaacagcccatacccccccaaccaataacctaaaaccgcttattgctaatcccaaccttgcaaatccctaaatacccactagttaccatatttaccctccaaaccctaggtcatgttcacaacctctccacccaagccctggggcattgtagccaatccagagcatcttgggtaagattccttgggaagggcaaaaatttgatgatattgggagctaggcaagcaagcaggctgctggctgctggctgctgcctgctcatctcatgggggagtgtgtttaaagtaaaagaggttaatgagagagagatgggaggcaagcaaagcgcccatttctaagttttgggattcttaaacggtgattaaaattttcctaatacacccctccctctctcatgggttatcaggcacagcaccactggtttaatttggtctaaagtcacacatggggctgtggtggatgcctttgtttttatttactgtgctttccttttttttactctgttctttctcttttcttttttttttaccgtggtgtgtgtgaagaggggtgaaaggagaagaggagtgataattgtgcacaggagactatgggggtaaaaaaaaactgggtgagctttccaagagggtggaggtgggtgggtttggggaattgggttaaagaaaagaaaaaaatgcagcaatttgtacttgcatcatgttgcctcttgtgtgatgctttgtgtgtgaagttggtgctaatttatgaaaaaaaatgatctgcaaaatacttatctgattaattgactaaactaataattcaacttaatttacgaatatttagtcaccaaaacataaaactgcaaaatgtgaaaaacttggatgaatatcaagagtgttattgactagtggaacaatatttaacatggtaagaaccacataatgaattattttgttacaaactactccctccgtccaaaaaaagacaaaccctgatttctgtgtccaacgtttgaccgttcgtcttatttgcaaaaattatgaaaaaaatttaaaaagacaagtcacgcataaaatattaatcatgttttatcatctaacaacaatgaaaatacgaattataaaaaaatttcatataagacggacagtcaaagttggacacgaaaacccagagtttgcctttttttgcaattttattaccaaacttcgtgtcaaacatatggtatcatcttttcgtttatgcttatacttattagctaaaatttaaattttcaactttaaatttagagttgattttagggtttttcatcgaagtttatttttcagtttttgttttcagatcgctaataacacgtatataaaagttttaatcataaactatttttcatttgcaaatatagcgtttcgcttattccccgaataaacgaatcgatgggccgataagtatatattgaatatgacatgtgggccttaatcaaatcaaatggtggtactactgatagcggtagtttcagcaaacacaataatgtccataagatggaggacatgtactcccagaaaagaacatgatgggggaaaaatagggaagggtaaaataatttagatcgaatggacgttgaaagaaactaatttctggacaggacctagctcgtagcccggcgtgtctggcatctgagagaaatattttatttggaagtgacattttttaaggttgtttttatactttttctgactgtacccgcacgggacaaaatcccggggcacgggatgagttccggtccatccgattactgggctgaattgttgtttctaatggaacaagacccgacccgttaatgctttttttttttactcccctcattctctccgtcttgtaaaagacgaatataaaactagatcttataaaagacgaacataaaactagatgttacaaattccagtacaattgatcgtccagattcattatagtaaaatgtgtcacattccgttctagattcgttttttggtggagtgagtacgccccataatataacaaactataatagaataagacgtattatattactacaaatctagataggtctatatccagattcatcatattaggatacgtttcatccaatcataggttgctatatcctgggacggatgaagtactccttccgtccatattgattactacatccgtcccaaaatataacaacttttagctatgaatctggacacacggttatccagattcatagcaaacgttttttctgtacgagaacccttttaggttccatgcggaccatctggacgcttatatatcactactatttgcgcatgaagaatcgctccaccaagaaatagttcaggggccgcatgcgagataatgcattttcgcatgtaaccccttaagagattcatctagttattttcacaaacgaacctcttaagcggccgtacgtgaaaatatattttcgcaagcgggcctcttaaaggcccgcttagatgtctaaattccctcctcttaaagcttgtccgcatccccttttcctcctcttccctctttctctcggtaactttccttctcctcctcctccactttccccggccacctcctccttcctccactttccttctccttctcctacatttttcccggtctcgtcctccttcctccatttcccggcctacacatggcggggacggtggctcgggagtgggtggcgcagatgcgcggagatgaccgtctcgactcggggggcgcatggagacggcgtccttgggggcaggcaatgctagcgcgtggatacggccgctggctcggggggcgcgtggatccaacgacctcggggcggatccgccgccagcttggggcggatacgacatccccgtccttgggtgcggcggcggtagcctcggactgggtagatcaaccactgaagttgacaaaagcgacagatttgctcttaggagcggtggcggtggccttgggacagcggcgacacccatggaagcgacagatttgcggtggcgacgacgacgatgatggtggcgatggccattgcgaggatgacgactgtagtgatggctgcgacgacgatggcttcgggagctaggttttagggatgaattgagggctagagctttgattttcggaatttttatatttttttggcgatttttcatttttgcatgcgggcagcttaagcgcccgcccgcgaaaatcggattttcgcgtgcgattgctctacccgcatgcaaaaatcctatttttacataccctgggtacatgcgggccactcatccgcatgcaaaaatcgattaataaacgatatgtagtagtgtctgaaacggaaggaccagtgtacacaacagaagtaggaagctgtgttattccataattggtagcatttaatcttaatcacgaaaacatgtatataattgttctgcgcagtagtataatacaattagagaaaaacactaatgttacttcaacaattatagacacaatatagagcaaaaaaaagcacaatcccgttttataagtatctaacctcttcacttattatatttagctattccattcgtcccaaaatttaaaaacctagaattggtccat

SEQ ID NO: 28429 - DNA, 35361 bp, Oryza sativa
tcttctaggatcaaaatcttcccaaacagtaaggttttttaaaagattacaagaagctgctgttataaaatccagaaaatgaattagagaccaatttctacatattctcactagttgaattcctacaagctgcttctcagaatcatgtccatgccctccgccggccctcccctccttcctccctccctccctctcgccgtcagtggagccgaccaccaaaaatcgtgcggcagtaaggatggggactatagtgattccctccttttcgtggatccaagaagcacgacggatctgctggaggttgctgattgggccaaggcatggatgcatcctaagggcaaccagggacgtggaggtgacagctcgatgtggcaagaaaggttggatccaggcaagatccgatcttttaggttggatctaggcaagatccgatcttttaggccctagatatcgttgcccctcccttgcttcgtccaacccgttgacaccgaagtgagctagtgatccacgatggcaacagcgaggagttttaggtgtgggagacccaggaggtgtgtgagcaatggtggtggtttgtggcttgcggcttgtcaggcaaacattgaagacaataatttcctggtagcgacgagtggatctggccaccctcctggagtggttggaatctagggggttggcggttgttggtgacagtagcttggggtgaggttgtggtgtcgtctggagcagcttggggatagtaacaagcagcgctgtctttgatggctggtagttgtgtgtgctagtgcaagaagtagagttggagctgtctctaatggtgcacaagtcagagtttgagttgaaaagctgtcactcaagtcgtctggcactgttgctaggcggtgttggtgtagggagactgcaggagttggtgtgggggatggctgcacggggtggcctaaaactatagatgctgctcaccgcaaggctgttgggtggcttggtggtgagatcacggttggcgtgggaatatatgctggtggtggcttgaaggatagcaagtagaacccctagggtagctgggtgattcccctcaccttggatctcatccccctcttccggatggtctgcttccagacttcggccgtggggagccccatggcacgaaggaaggtggtggtttggtcaagttggtgcctgcttggtggaggataagtgaccttcagcatcgacaatgctctcttgaagtttgcagcacaaagggcttgtgctaggttccgtgcagggaggtggcggtgtttggaagtatccaccacgctagcaagcatttgtgagctatggtagagtcgaagttgcttggccaggtggcaagctcagcaatgataacctttatcttcttactttcaggtaccgtggtttggagtggatggagtagtgttgtttgcctatggagtggtggagacgcgcgccaccatttccttcaagttttcttccgtgacatcggaaggagcccattgactctcaaagctttctctctcctccgccatggatgcaaaatggatgatgaaatctagcgtgagggtggtggtgattggaaagggaactgatgcggtggttgtgcgggagatctttgcaaaagcacgaagccttgagaaggtggattggtgcagattggcaaaccctagttttcgccagtgcagtcttgtactgtagcagagaatagggaaagtggcggaggtctcggcggggaagacgaagcggcgcttggttagcgttttttgttagggtatcgggaggtactaatgggcctaggcctgcacagtgctttcagcccaacttcactattggtgtggctggttgtgttccttagggatttaagcatatatttttgccttgataaaaattgctcacaacataatagcccaatgtcgttaaaatcctttttgatgcagttagataattctttggaattgctacaatgcgaaataaaaaggtgcccggcagaaaagtgtaatactaattttgttgacctttttaggttgcaaagctgcttgggttttgttgagttggctaatttcagatggctatcctctcagcatgttatatgcttattttgatattgacataagtcacaacttaggctattttgacttgtcatttgtcattctttatacaacagttgatgaattctttaagggttttttactcagattcttgtcatatatgttggtttatagatctttagagtgcttttcactcgggtctctttatgccttttttgggcgtattatggctaaagcagtcagctgggtattttatcaactgctgcttgagcttaaatatataattcccaaagtgattcggttgtaatgtaccttgaaccactcggatagatgtttaatgtgccttgactatatgtttagtttttattcaactaatcacatagtcaggggctacacctaattaggtgcatctagtcgatgcacctgatttttttattttcagcccttcacagtctttgatttcagtactcgggagaccaatgcagaagaagttaaagtactcggattatccttttgaattacaagaaaagactatttcgtcgactgtaaaggtctcaggggctactgtgaagattatggataccctatacccacacggcatgtatatccgactgggtatgggggtaccatgtatagatagaatatctttaaagggtttcgggttaaattcctaaacttgtatatcaaggaagcacccaggattttagtcagttacgattgtatcttatctataactacctattccgttagggatatgggctgtactttgtaatacggaccccttcccctatataaggaggggtccgggtgcctcttggggcacaactttttctcccagatcatacgatcaataatacactcagcggattaatccccggacatgagtaggttattacttcttattaagaaggcctgaacctgtataaaattcattgtctctaaacccatccactttttcagcttgatagccacccccttttattattgccaaaatcttgtttcgacagagttgctgccgggtgacgagttgagagctggggtggtgccctatggagcttggcaatgataactcacaacatgtttcgtcctattcacaaagatgatcggcgattgagagtgtccaaggcgaaagccgtatccaatctctgactggccttggtgacgtcgacgcttgtgggcaatgtcttccctcttgggagcattgttaaagtagctctctctttcttcatatgaaaaacatgtccggtgtttcggacatgcgttggcagcattatggatgttgtttccttcttgaaggcttcgcccagaaagtcttgctctttggtgggattgcactaggtggtcttgagagttgttcaaactggaagccgaaccttggagttgcttgcctgtgatgagcttagtaacgatgacttttgccgtgcctcagttcttatgttgccacatgatttttctttttcgctctccgggtggtttgctaggtatttcgtattctaaccatgcaataaggtttttcgacccaatctcccttataaatcggactaactcttcttaatattttcattcagtagagctcctatcattaggtttttttttacttcttacgtttcacaatgtaagactttctagcattgctcacattcatttagatgttaatgaatctagacatatatatgtgtttagattcattaacatctatatatatgtggaaaatgctagaaagtcttacattatgaaacggagggagtaacaattagaaaaaaaaaccagataatgataaatactccctccgtttcacaatgtaagtcattctagcatttcccacattcatattgatgttaatgaatctagacatatatatctatctagattcattaacaacaaaataaatttcccacattcatattgatgttaatgaatctagatatatatctatctagattcattaacaacaatatgaatgtgggaaatgctagaataaaatagagaaagtagcacaaaacttttttttttccaagagcagcaaccttttcaattttctcaaccacgttgataaaactcaggcaatcaaaacccccatcagacttcaaagtccacggaaagctttgcattggcaacaactccacgaaccccagagaaattttcatttgggcaatacttggacgaggcagagacgctgtcggtgaccccagccgatggaagcccaaatctatccccggccggccatgcatcctgacgacgagctttaaacatttggccatggtcgtacggcgaaagccttgggaaatccggaggcgcacgtgaggcccgcgtgtgctcctgctcgtcggcagctgctagttactgttacttactgcgctcttgcccagcgaaagaggaacagctgcgcctcgcccccatcctcccagcacgagatttcacgcagtttttaccgtgacctccgtggttaattaaccttcccgtacttgtacttaattaccctctaatgctacttctggtacggttcggtcaagctgctgtcacagtaattaatcaattactcactccattctaaattgatctacatattttataggtacatattttattagtcgttttggctcggttagctgtggataagaaaatttgttattggagcatttttgccacgcatgagacgagattgcccttgtgcattcatggtgttattgctctcagattatctccttgttactccttttaacgcttcttttccatctcatttaattttcgcatgccctcgagcgctatctgtactgaagctgcatgggctgcatgcatgcatggtgcgatgcaaaatcgccaagacagaaaaaaaaggtatgtatctagaccaggaatcgaactcaggtcccaagacaacaacatgaaagctctaaaccaactgatcaactgagagagcagttgttgcttgcttgcatgctacatctaaccatatttaatagggatatgacttcttggtttttaaaatcgtgtccgaaacgactaataaacccagcccgaagggagtattatatttacctagcaacaaactcaatgcatgtaacatccctactattttttagccaatagcaaatcaaaatattgcatgtgggttataaatagttgtgtgcatggatgcatgtatcaatgtccatttactctaatataaaaataacgaatagacttaatgaatgaatataaatatgtaaatcatttagaaataaccttaaaaaatattatatatagattaatttagaatggagggagtagcatcaagagatgatgctgaactgtggatttgagatagtcatccatgaagaagtatgaacataagaggctgtttcaatttgtaccagtaccatgtcatggcgtgttaacacggcgatatgagtggcacctatgaacaggacacggagcatggatgccgcagctggctagcctgttaccctgcacaaatctcggcacggctaattaatcaagcttaagtcgttcgtcgatcgatgcaaatgcaactgcatttgcctcgatcccttgtgtttgtgtgccggacaatgcaatattgcaatatatatatatatatatatatatatatatatatatatatatatatatatatgttcaccgtgcagttagtccacgacgcagccaggtgtaagccaatgcaacacatcgcttctcttctacggtaggaatcaatccaagtccacacctacaaaacgcacaagttggtagcttcgcgggtctttttgacacagcttaagtttcagccccggttttatttttccttagagtttaaccaaatgatgatcttagcttcactaaaaataagagtgaaactggttgagtgcttttataaaataaactagaaatgtgaaactgggtttagacgactctataacttaactcctaaagtttaaattaggagttggagtcctaccaaacctaaatcactcctaattaattaccgctggattaggattaattagagcaagtttaatagtatagctcactactagctctagtttatctatagccaatctaatagttaatttatacaatagttgcttactatactattaacatatggtaccacctatcatatataaattttgtcttagagtccgtgctgcagctagctacagatctgtaaccctccgttctctcttattttttatcttattataatatgtttatagctggttaatagtatgctcttagtgcgtaaatacaaggggttaacaccaacgagcggcgctaacagtaattatccggcgagtttagcaagcaggcacaataattaactccactttctcctcgtctcccgataccggcgcagtgctgtgccgacgtggcagcgcctgttttttctatacagattgggaggaaaccaacgatggccaattaattaattgtttgattgattttttgcttatctaaagcagcagcataaaaaaatgattagtgggagtacttgaggcatcagcgagagcaaaccaagaatccaaccctattaatatacaggacagtagcattagtaaattggtggtaatagttaagctaggttaattatgctaagcagatatagtgagctgcttaattgggccctctaagctaagctagcaaagtatcagttaccagtatccacttggcttcatgtgtagctagtttgctagctaattaagctaagctttggttgtgtggattaagaaatggccaagaatatagatagctagtgctccatcattggttacacatctagccatggacacagcatggagccccaaacccaaatgtacgttcttgcctgtaattatgcagccagtttgaaacggagcagcatcatatcccccggcaagattttggttgcttttcctgaagtttatgcatcgatttcacaaacaatcacgctggccggagcagcaaccgggtacacgcactaattaatggagaaatattgatcacaaatattgatctttcacactaataaatggagaagtattgatcacaaatattgatctttcacaaaaaagatatactccacttcagtggattgtatagtctaaaaatcatcagattaactgattaaggacaagaatttaggcaatttggtgtattagttggtcgatcgatgcaacgagggtatcagggtaattaggcccatatatgtgctgggcccatataggttcctaattcggcccggttttgtaccttctgccaagacgaaatatgggccagtagagttggtgactaaatttgctctagctaacaatggcagatttcggcattaaaaaagtttggttatgttggctgttgatgttagacaacataatggtgtagaacaaaattttaggtttcgaaccaaaggaacgccaaaactcatagaaagtacgccttttgggcacctgtctttcaagcaaaaatgattgtaatagaagatttactttttaaatggaatatatagaaagaactgatgagttaattttaatgagtacatagcttgaaatattttgttgacaaagctaagtcatcacattaaagttaagcctttcatttctttttgaaagaagctttggtttttctactaaaactgtacaatattgttaggagtaggacatccaagtcgcatgagtggaagaaataatatgagagcaattccactacacagtaagtaaaaaaactacagggcaatcagattcatttaccagaagatgtgatataccaatcaactggcatatcgtgtgatataccaatcaactgaacaagttctggatgaggtgcagaccttcagtacagaagacatccttataattctctcctgattcctctcaaccctagcataaatttgttcgctaagcaaaaccgatgcatgagaatacattgtcgctgtagaaaggtgttgaaaataagtttcgatgatttattgtcgctgtagaaaggtgttgaaaaacaagtgttgtgatggtttgtgtgttacgagcaccggcgagggaacggattggatatgaatgggacactagaggacgaggcttcggcagcctctttaccctgcccgtgacggcgagtgggaggaacagaggaagggaacagagaaaatgggatgagaagtgtagattgaatcttgcttagattaaccataaattcgtggctctaaatagccttacattgaactaatcttgctaaaagaaagggataacaaaacagtaaaacaaactgaaactaatcgctagcaattcgcgtggtactgtttctcatctgacacgctgctcgtccgtcttcaccgcgcgccgtctgcgctcatacgtgatgccgaccatgacatctctcccctccttcgtaaatagctcgtcctcgagctggaacgcaggatacatgtgcctgaattctgtctcgtcttcccatgtcgcgtctgcagccggcttgccttcccgctggatgagaacctggcgcacaccgcgtgccaaacgagcacgaatagctttcgccagcattggcaaaacacggccattggacaatgcaggcagagcaggcggttggtccggcggtgtacccttgaattccttgagcaggccaacgtggaagacgtcgtggatccgtgcgccggccggtagcttgagacgataagccacatcgcctatgcggtcgctaacctggtacgacccgtaatattttggtgccagcttgccacgacggaacctgggcagggacgcagcctgacggtgaagaaggcgcacccacgcccagtcgccaacctggaacgcgagttcccgatgcttgtcgtcgtagtacagcttggagtagtcttgtgcttggagtagacgctccctgatttcccccaaaaagtcatcccgctcgatgagggcttggtcgactgcgcagacgcgtgccgagcctcggtcatattcccgcagcgctggaggcggcctgccatagacaacctggaacggcgtcgaacgcagggaactctggaatgccgtgttgaagcaatattccgcccagggcagccaacgtagccaatgccggggacgatcaccagtcaagcaccatagatacatgccgatgacgtggttggctgcctccgactggccgtcgctctgggggtggaaggctgagctcaagttgagcttgacattcgccaggtggaagagctccgtccagaatgagctggtgaagcccgggtcgcgatcgctgacgattgagcttgggatgccgtggagacggaccacctcgtcgatgaaggcacgcgccacagtcgtcgctatgtaggggtgcccgagcggaatgaaatgggcgtacttggagaggcggtcgacgacggtgaagatcactgtcttgccgtggacgcgaggaagaccttcgataaaatccatggcgatgtcttcccagacctgcgtcagcaccggaagcgactggagtaggcccaccgggtgcaggtgttcggtcttgttccgctggtaagtggcgcatgtgcgtacgaactcctggacagcttgcttggcatggggtgtgaagaagtccgcccggaatcggtggagtgtgtgtttgactccttcgtggccagtgtgggcatgagcgagcaatgccggcagtgtcggggaagacgccgagacgtagacgcggttgtcccggaggatgaggccatcacggagtgcccaaggcgcgctcagcttgccgctggtgatgtcggcggcgatcttgatgaggtcgccgtcggtagccacctcattccgaaggtcgtcgaatgccgagaatgttgggccggagagcgccagggcggcgatttcggcgtcttctgtgcgacgcgacagggcgttggccacaacattcgtgcaccctgggcgatattccacagtgaaatcaaagccaatcaacttgcttacccatcgatgttgtggaattgtcgagaggcgctgatccaggagaaatttcaagctgtagtggtcggtgcggacgaggaacgccctcccccacaggtacgcgcgtcaatggcggatcgcttggacgaggccgatcagttcccgctcgtaggcggcgagtccggcgtggcgtggcgcaagtgcccggctgaagaaagtgagtggacccgccccctggtgcagaacggcgccgatgccagaccccgacgcgtcgcattcgacgatgaacggcagggcgaagtccggcagttgcagtacgggcgccgtcgatagggcctgcttgagctcggtgaaggcgcgggctgcatccggcgtccactggaatgcgtcgcgcttgaggagggctgtcagaggagccgcgatcgtgccgtagttgcggatgaatttgcggtagtacccggcgaggccgagaaacccgcgtacggcgcgaacagaacgcggacgcggccagtcggccaccgtgcaaaccttctgcgcgtccatggccactccgtcggcagagacgacgtgacccaagtagctgatctggcgttcaccgaagtggcacttcgagcgcttgaggacgaggttgttggcgcggacgacagtgagcactgcttggatgtgctgaaggtgttcggcccatgtccttctgtaaattagaatgtcgtcgaaaaacacaaggacgaaccttcgtaagaacggcgcgaggacagtgttcatcagtgcctggaacgtcgcgggtgcgttcatcaggccgaatggcatgaccaagaactcgaagtggccccggtgagtgcggaacgccgtcttgtggacgtcatcggcgtgcatgcggacttgatggtaccccgaacgaaggtccaacttggagaagaagtgcgcgccgtggagctcgtcaagtaactcgtcgacgactggaatgggaaatttgtccttggcggtgaccgtgttgagcacgcggtagtccatgcagaagcgccaagaaccgtcatgcttgcggaggagtaggactagcgacgagaacggggatgtgctgggacgaatgatgccctgggccagcatctcagcacattgcttctccagctcgtccttctgtagctggggatagcggtacggccgaaccgcgacaggggacacaccagtcttgaggtgaatacggtggtcgacggcccgggccggcggcaaaccggttggaagcgcgaagaggtcgtcgaattccgccaatagggacagaaggagatcgtcagcgtggatcgcagcgcatgtggacgcgaggcgttcgtcgaggacgccgtatagcatgacctcccggcagccgcgccaaattgccatccgcatgttgacgaagtcccacagtatcggtccaagagtgcgtagccactgtgtccccaggatgatgttgacgcatccaaggtggagcgcgtagcagtcgacgtcgaatacctcgtcggcaacacgcaggttcaggccacgcgcaatgccggggctggtgaggcgatctccgtttgccactaccacacggacaccatcgcggaccagcgacagcggaatgccgaggcggaacgcaaggtcagcgtggatgaagttgtgggtggagccggagtcgacgagggccaccacctgttcgttcgcgaggcgggttgccaagcgcattgtgttggcgccatcaacacccaagattgcgttcagcgatatgtgtggctcagtgtcctcatctttgtcggccgagtcgtcgtcgagatcatccgccgtgtcgtcgtactcgatgtagaagagccgtgcgcaccggtggccgcggacgaatttctcgtcgcagttgtagcagagcccttgtttgcggcgctccgcgagttccgccggtgtcagacgacgaaactagcgagagttcacgttgggcacggcggccactgccgtcggagccggggaggcgctagcggccggagtcgacgcagccgtgcgcacgaactgcttgctgacggtgcgcgatgggctgaagttggctttgcgttcatacgcacgtgccaaccccatggcttcctgaagatcttcaggctgatggagctccacgtcgatgcagatgtcatcgcggaggcccaccgtgaacagttggacttgctgccgttcggtgaggagatccgtcacacggctggacaaggcgaggaagcgctgctggtaggtggccaccgtggtcgactgtgagaggcgcttgagttcacccaacgggttgttgcggattggtggaccatattgggcatagcatagctccttgaacgtgtcccaatcaggcggccctttgtgttgctcgtagtggaaataccactcctgagcggcaccagtgagatggtatgtggccaaccaaacgcgatccccatccggcgaacgctgtgcacgaaagaactgttcacagtgattaagccaattgagaggatcgtcggagccatcgaacttgggaaattcgagcttgtaaaagcgaggaactgcgttgccggagttggcatcgtgatgtgcgccgtgtctggcatgtggcggcggaggtggtggtgggggtggtgggggaggtggtgggggtggtggtggtggtgatttaaggaggccaccgccggtcagacgtggaccagaggaagtggaggaagactgctccaaggcggtgatgctggaggtcgcgacagcgacagaacggctgagatcggcgaggtcacttttggaggccaaaagcgaaatgccgctcaacaccgtcgccatggattcctgaagctttgccagtgcgtcggcatcagtggatggctgcgtggaggaggaggattgatctggtgccatggtctctgataccaagttgttacgagcaccggcgagggaacggattggatatgaatgggtcactggagggcgaggcttcggcagcctctttaccctgcccatgacggcgagtgggaggaacagaggaagggaacagagaaaatgggatgagaagtgtagattgaatcttgcttagattaaccataaattcgtggctctaaatagccttacattgaactaatcttgctaaaagaaagggataacaaaacagcaaaacaaactgaaactaatcgctagcaattcgcgcggtactgtttctcatccgacacgctgctcgtccgtcttcgccgcgcgccgtctgcgctcatacgtgatgccgaccatgacattgtgagtgtggaatcatctcacatgttgggtatatatggatatggttgttcttcttagtggctgatactaggcctttctcatgtgagttgtgatatttcaattggcacccacttttgatttcctaccttattactctagtactatactggtacattttcaaatctcagttattgcttcatgttgtgtttcattctggtacagagttaagggcttggcaggatagagaaaactgatgctgcttatgtgcctggtgaatgagtaactgacataggaaaatcatattatgtattgtcgcaaaatgccattgggtagtgaatcacagatacttcatggaatgtataaacaacgatttgtcaagttgcttaaaatttccatctaatataacatgacacactcgatgaaatgtactaaaagagctctaactcaacttgataaatgctttaccgtctgttctgaatgcattattttagcagataacggggccaggcacatcaatttaaatcccatacaattgtaacatctaagaaaccaagtacgtttggactaaaaatgctaataacacattatcactcttgagcattttgacttgtgtagtacaagcaattgggtcaggtacaggtgcaaaatttactgaccctgaactttcttctgttgtgggtagcatgtttgagcataatgatcatggaaaaaagaacccaaggtacaagttgctaattcaaaataatttggtttgtttccccacttgttcctcaggtgctttacactgactgagctctctcacacacgcatggttcgttatgtccttgcaaagatgaaccatgaagttggctttgtatctccaattcctgaagaaacatgtccctgagctgtctgcatggtcaaacatcacagtggaagcttccatcctgatgcctcccaatcctatgaaccatgcaatgttttacatcgggatcactgctcaagcatcgccacagaaatgtgttgaaaatatgtgaggtatgtcgcatggtggaaattaatgaaaaactaggataatatatatattgaatttgatgtgctcttctggtttgcatgtgtgatggactgacggcagagtgtcgattgctaactagatttaaatgggtagaatcaggaaattatcgatgtacgtgcatggtttttttcagattgtataaggattctaagtacaatggtgggtagatgcataaaacacgacgaacgtgggatcgaaaaataaaggtgtaattgaatcttcaacgctagggatagacatgagtggatatataagtaacgattgataagttctggttcaacaaaattaacaaagtacataataaacttgaaaaaaagagtatattttagctgatttactacttgattgcagactcacattctgaaccttcttggagttgaatatctgatccattggtagcctaatccaaatgaaataggcataactaaactcgggcactaaacttcccgagagctccatcattggtacacatctagccatggacagcatggagccccaaacccaaatgtacattcttgcctgtaattttgcggccagtttgaaatggagcagttaatgttataaaaccagcctcagaatcagcatcactagctaaatgcgaaaaaacgctatagcagatccaacattaataacgacactgaggcacgatatttggtaacggagattcaaaagaattacttactcgctcgtagatggtaaatttgattaatgatattttttaggcaaattttgctacaggacatcgcaattgtgtgtatttagctcacggacaccgtgaaagtgaacatttgggggaagacatcccataatcgtggatatttgcccacggacaccgcgccgtctcctctccacttgacatgctgacatggcagacgggaggctgttttttggcccggtcagacgcaaatacccctcggccttatctcctcatatccactcgcgtataccgccgccgtcgcgcggcgccaccccctcacccatggcgagctcgctagagacaaccgtaccaccggaaagcacacacatgggttcacctccgccatcccattccccttctcctcctcctcctctccaaggagaccactccctaccaaccggcgctccacctgagccatccccgcagccccaccacgccacccccatcttgccaccgtctccaggtcaggccaccaaggagcgacccagggtggaagaaccgcaacctccgatcgatgggactccctgtgcggcaggcccaccgacgcagccttcgttcttcccctcgcttctagagctgggtagctcggcggcaccatctgcacccgcagcgacgaggcagcccgactccccttcgccccatcctcccgccgagccatcggtcgagttctaccccaggtcggcggcgtcatccccttcttcctcgtacgaaaccgcggaggatgactggccggcgccgccaccgcccactcccccaccactggtcttatgcgcctcgctagattcatcctacaccgagtcttcccctgtgcgcgatcgcttcggcgaggaggagggttcgcacgctgcacccgagccgccgccgctgccgccatcggagataaggccgaggggtatttgcgtccgaccgggccaaaaaacaacctcccgtctgccaggtcagtcaagtggagaggagacggcgcggtgtccgtgggcaaatatccacgattatgggatgtcttccccaaatgttcagtttcacggtgtccgtgagctaaatacacacaattgcgatgcgatgtcctgtagcaaaatttgcctattttttactgttcatgttttgtttttatagactttagagatggtatatttgatgagaactctaatgattatttcagactttagatcgaggaattttatggtggaatttgaattgagcataaatattcttgatttcttttatatagctttgattaaaatactcttagaatttatttcacatggatttttaataatattttagtggctaatatttcttacttttataaaatttacttttctatggattattttcctagccatactcctatttaggaagggctcttttacatatttattgatttggatattgtattgaaatcacactacaccggacctagtcatctgtgacgggctctaaccctcacctttgacggatttagtctaggttacattagtggtcactgatgactacacctcatctcaaacgggtgaaagcccgtcaatgatgattgacacctctgacggaccgaacaaaataacccgtcacaggtgagtctcacctgtgatgagtggatcttttcagcccgtcaaaggtgataaacacctctgataggtttcaacttaccacccgtcacaagtgtggaaaatcaaccaaaaaaaaattaaaagccctcagcctttagctctcagctctcaggcctcagccgcccacaagccatatctcatgacatgaagaacatctcaagatccctcatgacacaataactttgcattttattgacagatatgttgacacatgaagcacatccacacaagtaatatacatcacaaatccacacaactttgagtaataaactacaaatccacacaagcaaccgagagtataacccaatctgaaatttggcaattaaaatttgcacaacctacaagagttggagatggcggcggcgctagcgggtggaggagatggtggacgacgccgccggtcgggggtagaggccgccggatctgacggttggtgatgcggtggaggcggctgccgtcggatctggcaggcggcggtaggtggcggaggaagaggcgaccggcggtggagaggcgccggatccgacggttggcggtgcggtggaggcggcagccgccggatttggcatgcggcggtggggtggcggaggaggaggcgaccggcggtggagagacgcctgatccgacggttggcggtgcggtggaggcggcagccgccggatctggcaggcggcggtgaggtggcggaggaggaggggaccggcggtggagaggcgccggatccgcggtggggagaggccgcagtggaggcggctgctgccggatctggcagccgacggtgggggggcggaggaggaggcgaccgccgggggagaggcgctggatccgcggtggggtggcggaggaggaggcgaccggtggtggagagacgccggatccgacagtttgcggtgcggtggaggcggcagccgccggatctggcaggcgacggtggggtggcggaggaggaggggaccgacggtggagaggagccggatccacggtggggagaggccgtactggaggtggctgccgccggatctggcaggcggcggtggggtggcggaggaggaggcgaccggcgggggagaggcgccggatccgcggtggggagaggccgcagttgaggcggctaccgccggatctggcaggcggcggtggggtggcggaggaggagtcgaccgacggtcggaaggtggctgggggaggcggcgccggccggcggaggaagaagcggatgctgccgccggacccggtgctcggcgcgtgtatcgagagaagtctgtggagagagagagggagagagagtggagaagtggagaagaatcgagagaagtggagaagccagccttatctcttgggagaagaaatatctcgggtatatatatatatatatagtgacacaactcactcaaacgggttagggcttctacccgtttgaggtgagtaaacctcacctctgacgagccatccggttgcgacccatcacaggtagctagtcacctgtgacgggttgaaaatggaacctgtcagaggtgaggtaagcctcacctttgacggttttcacttccggcccgtcacctgtgacgggtcgaagctggatggctcactaaagacggcatctggtaggactcgtcaaaggtgactttcatcactgaccaacacttatgcccgtcacaaatatgccgtcaaaggtgtgaggatctggcgtagtgtcaaaatttggattttgttttatcttttgttcctaatttgaattgatctctttaactgtactttacttggcatcttctcgacctggatattatttattactaatgcgaatttcaaatatatctaaattgtattgtatttttagatggactattttctcaacattagttattttaaatccgaatttcaaatattaatatgttatatttctacatgaactattttaatttgaatttcgtatattttctatattatatttttacatggactctactttcaatattatttatttgtagtcttaattttttatatttaaaattttatttctacatagacccaaattaatggtctagattttattttgtttctcttactagtgtaaaaattcttataccttacgaacgaatatggctgactcctttttctatgaaaaataccattataaattttacggtagacaaaaaaaagttgcatgagggaaaaaaatataacacgttactgggtgatcatggtgattattaggaccaacaagttgcatgaggaaaaaaaatataacatgagagctcgtagctgcagcatgacactgcgtaatttgacacactaatttcagtaggcaatgtcttaagtgcaatagctactgggcggtcaaagttaattggccagtaaccagtaacttttatgctagccagtactggtgcaatttggagagttgaaccatgcaatcggaccaggagttaaagtccacaaggaagatcctcatcccactattgggaagggagcttctctcctggtgcctctcaaccctagcataaactggtttgctaagccgctaatgcaagagcatacatgatcgctatagaaaagatgttgaaaaaaataagttaagacgacgtgtgagtggaaccctctcacacttgttgacacggagaaagtattgatatacataatcttcatgtttggctgtgcacattcggttgaatttagaggccgggtttatcttattttctaaaaagaaaaagatattctttcatgtcactcataactagccatttctcgtgtgagttgtcacagcttgaattggcacccacttttaatatcctaccttattgcgatagtactatacgggccggtaagcttcagttcgattgttgccttttacagtatgttacatttcattcactagtacagagttaagttcggaggatgcagaaagctagtgtgctagtgagtgagttgctgacaagtgaaaaatcatgttatgtgtcataaaatgccattggatggtgaatcacaaacagaccatgggatttatacagtgatttgtcaagttgcttaaaatttgcatataaatctagtgcaagagcttgaacacaatggggaaatgaggacccctctttgaagattcggctaagggacaagtcaagcataagtcaccctcagggaacagatggacgcaaaggagaatacaagttcgggccacacagatgaataatacccactcctctgtgtatgtggactatcaatgtggaaagttacaattagatccgtgacttgtgtgagctctaattgctaaagaatcgaaccctctatctgttggcatggatcctccttttatacgcaaacaagagtccacaatgccaatgcatgaatacaggagaggaccccgctccaaagagttgggtatgcttagtcttttcgatgtccccatggcaatcagcgcccagatgtaacagcttcgctctccggttgacaagtggcgctggcgacgaggtgatctccaccccggtcaccgtggggcccaccagtcaacccttgagaagtgacaaggtagaattccgctggagtgatgcgggcgtgacacatcgcgcccctcctattccttcggtagacgtgggggtgtaggaggctacatgtggcgccacatctctaaaatatacctggatgagttctccaaatggctccctcctgcaacataaatcatgatgttagtttggaattaaacctccggacccacctagagaggcggagaaaaaccccaaaatgagctaggggcagtgggggtgcgcttgggcctccacctgggccccctagtcacttgtactgtgctctagggcagcctctgctcctcggggcagccgcaaacctagggcttcttgcttgcccggggcaccgaggatctctccctactttataggttttcttgttattttggatgagcttctcgaagatgttactgatgaaggagttcatagtgatcaccttcgacggagtagcaccaagcagctgtctgcctccttagcatattggagacataaatcttgtaggtatgtaccctctccttggcaccttggggatgtagacactgcgcatttcttgaagatgtagatcttgtacgtctcttatcgtaacatacaacctcggatgccccaaagaccccggaggaccagggactcatgttcccgttcctaacactatgggagtgttatgcgcacgtgctatggagaagaaagtagagtccaataatttttacatttgatcaaatgttcaaagcatagctattcctgttaaaaattgttatattttgggacagagaaagtaaatagtgaccgtggtaaattccggtataggttttgcaacagccaagggcttggcaccatgatgtgaatttatgccctttctactatagcaatttgttctaaacatgttaacttcttatgaccgtatgcgattatgccaaatcaccacaaacataatatatatgtatttttataatccttttttctttttttttggtaggctggtgatagattgacagtcaagattttattaagagaaggaaaataattaaaatgggcttagttcattggctacagtgtttagggccggtacaatttgcaaagttgaaccaacatgaactcaactttatgtgaatctcatcgtgctctgcttaagaaaagtggcagacctttacaagagagattcccatcccataattgggatgggatcatctcttctgatgcctctcaaccttaccataagctggtttgctaaggtgtgtatgcaagagcatacatgatcaccacagaaaggtgttgaaaataagttgagatgtcttgtaagtggaatcctcacacgttggtgttgagaatatatggacatggatatatgttctccatgtggctgatactagccacctcttgtgagttgtgactcttcaattgacacacccacttttgacttcctaccttatttctctagtacttatactatacttgcacccttcaattcaactgtcgcttcatgttgtatttcattcactattaattagtaccctctccgtcccataatataaagggttttggagggatgtgacacatcccaatactacgaatctggataaagagtctatccagattcatagtattatgatgtgtcacatctcttcaatcccttatattatgggacagggggtgtacagactacagagtaagggtttagcagtatacagaaagctaacatgactattgaatgagttaccgacaacggaaaatcatgttatcaattgtcacaaaaatatcattcgatggcgaatcacaaacattcaatggaatgtgtacaatgatatactccctccgtaaaaaaaaaaaaccattcctatcattccaaggtaaaattagtaaagaatgaaaatgacaaatgcctcattattgaaaaaagtagtaatggtgataggtagataaagggtattgaaaggataaaacttctcgatttatgtactgagagtaggtacgatggtaaaagttggcttttagtgggacaaaattcaaacagcagaagttgagttttttagggacggagggagtatatattacgttacctcaaatttcatctaactcaacacgcgacactcgagaagaaaaatatagtcaagagctccaactcaaacttgattaaggcttaccatatggtccgaatgcatgatttctagtagatagtaggtaaatacccatcaattggaagtctactatatatgagatgcaacatttttaagaaatataatcatatatgccccaccttcttctaaatgatttatgcttataaactaattaagtttggactgaaagtgctactaacactgtaccggtcacaatttgcatgagaactcttccaagaagcatatgctttgcattggcttgtgtaatcggcagggtcaggccgtatagtgatgcaaatgtactgacactggagttgtttatgttgttgtggccttgtgggtactaatatggagtggtgaatccaaggaaacaagaaacctggtctcaagttgcagaatgagagcagcttggttgatttccaacttgttcactaggtgcgttgcgccgaccatctctttcacacaactctggttgggattgcccttgcaaaggtgaaatatgatgttggctttgtatctccaattcctgcccaaggaagccccggagttgtccggttaaatattagaatgaaagcttcaatcctgatgtctcccaaccctatataggagcagcatatgcaattttttgtaggatcattgctcaagcatatatgaataattaatagccataggaaaaggtgttgaaaatatcctgtacagtagcaatgcatactaggagtatgcagtgagttttatgtgcttttctggtgaagtggtgagcgaagaagtaaatttgcaccggttctaagaatggaggatgtgttatagggttatacccggttttacggtcgagggagagaggactctatcaacagtaaaaatgaggatgagggagataaactagacatattcccatccactttgccctatcctaaaagtttgcggaaaagctaactggagcgtacacgctggcaacgcgcacttagtacggtggatttcctttttttcgtaacttttttttcccaagacgagtgcatctaacgtaactaatacattagttttagataatgacgataattaagataagatttttctttttagggatatttttttaaataacagattaaaaataaatctatatatgaagtcaaattttgaaaactttcaactcgaaatatgaattttttgcagtcactttcaacttttcatctcaattttgaaaaactttcaactcgagatttgaaaatttttaactcagatttgaaaacttttaactctagattttaaactttcttcaaattaaaaaactttcaagttaagatttaaaaactttctactcaaatatttttaaaaaagtgtatgctaactattaaaaataaggaaaaaacacgaaacaaaaataaaaaccgcgaggggagggaaagcggaaaaaagaaaaacgaaaaagatggcaaaaagaaaacgcgaaaaaaaaagaagagagaaagtgccgcgtgggggcgccagctgttactggggcgcgcgccaattagctgccccaaaagtttggcccaagcccaagcaaaatcctggaaaaagctcgacagactgtcacggcccggtccagttcggcccaacgggggcgccttgcgccaccgtgtcggagacgggaggcggcgtggccatctccgcttggctcgacggctcgcggcgcagaatcggccagcgaggccgtcgcttgactgcctgacttccgagctcctctttgcgcttttctcctttgaaccttccagaacgcgcaaggaagatcaagcagcgcgcgacgacgcgacaaattccccccccccctcccccctgccggctgcggacgaacgaacgaacgagcgagcgagcgaagcgaggaattaagatgttcatccagaaggtgaggagatgtctccagctctagtctctcgcaccattaatctgatgtcctcctgtatgcgtggttaattttggtggatttggttgtgtgggcgtgtgtgtgtgtgtgtgagggcgcgcaggcatggaggacggcggcgtttggggtctacggcttcacgcagttcaccaaatccggcttcgtgtaagcgtgatctcaccgagtcacctggctgatttcccccttgttttctatagctttgccaatttattgatattgtgttctagctgtgaaacgatagtctgtatcccctgtaggaatcctgattttttttttgaagggaaaatcccgaattttaggatacaactgctctggcccgttttggagatgtgatgtaataactgtgattatagctgcattgtgcgaattatgtgtagttcgatgccattatgccaagtagtgcaaagatagggaacccctgtccatcaataagtaccggaattatttagttatcactggagcaaatagtatcgaaggattttctgaggaatctatttgcgtgtagcaggttaacaactttcacacaatttggtactgaatgaaaagctgtcaaaggatgcaattgttgacaccatggctgcattatttttgtgttccatgctaacgaggattcttttattcagggaacatgccaagaaattcagagaggaggatatgcagatccggctggatgggaaaaattgcctagtaactggggctaattccggcataggttttgctacagccgagggcttggcatcacggtatggatctatacctttcctactatgatgatttgttctgaacatgtaaaattcttgtgatcacatgttttgtattcttccagtggtgccactgtttatatgctttgccgtaacaaggaaagaggagagactgctctcagtcaaatacgatctaaaactggcaacatgaatgttcatctggaggtacatgatgcttcagaaccgaattttactgcatgctaatttgcaataaaccttggtgatgttgtacagtaactatacctgaactaagtctctaacacaacaatagtattgtgttgcagatttgtgacctttcatctatcagtgaagtcaaatcatttgcaacaaaattctcttcaacagataaaccacttcatgtcctggtgagctttgcctcttcaaaattatgtcgtatatgtgtttcttgtctctggttgttgcttcttttatgttataaccatataattcagtaaagtttttttgtaaattacattaatcatggttttgaataaccagctataacatatgggttgttgttctaggttaacaatgctggtttactagagcacaagcgtgtgactacgccagaagggtgcgtgatactctgttgtttattgtgctcaatatattctcccctagttactttcgtactcactaaaccagatatcttgtttgctttcataacttatccttttattttaaaaataaaaaaggttggagctcaatttcgctgtgaatgtagcagcaacatacactttaacagagctagtaatgccactgttggagaaagcagcacctgatgctcgtgtcattacagtttcttcaggaggtatgtacaccgagccattgaacaaggatttgcaggtaaatttgtttcctctatgctcttattccacagttgaacacaatgtgtaaattgtgaaaataaaacttaatcattacgattttttcgtttgtcatgctcatgcctctctttctcaaaacctttttcgtttctaagtttgcaagagtgttgttaggagaaagatatttatacagtagaacttgctaagagggcccactaggaagttagcaaaacagaacaaaataatatagttggtggagcacttgattttttgttttcatacagttcactttgtggtgcaaaattcaagcaccctatttatctagttcctcaactgattgtcactgaaaacgaattagctttggtgaatttcagagagtttgtacaattgcatttctccccttttcatcttttgtcttataatggtattatggtctttctatgcatatctaaagtgttttacgaaatatgcatgtctaaagttatggaaaccatagaatcatgatgttttgttttgtcataaaaatgaagtagcatgtgaaagtagtcagatactgcaataacagtcctttttcactattgtttatacttcagttcggtgaaaacaacttcgatggaacacagcaatatgcccgtaacaaaagagttcaggtttgtaaacctcgaagtggtttctttatttggaatgctagtctttatgagattgagagaatataacaatctatgaacttcattcaggttgcactcaccgaacggtggtctgaaaaatgcagcaacaagggggtaggtttctattcgatgcatccaggatgggctgacacacctggagtctccaagagcctgcctgggctttcagagaagtagggctttctgctgtcctaagtcctaactactgcctatcttgatccatctgcttttcacttaacatcaaacccataaacttgtattacaattattatgctaggttatcaggaaacctgagatcaaacgatgaaggtgctgatacagtgatctggttagctttgcaacccaaagagaagctaacctcagggtctttctactttgaccgagctgaagcaccgaaacatctgaagtttgctgggactgcagcttcgcacgggcagataggctcgattgttgatagccttcgctccatttgtggcatttagggaaaaaatatttgctgggactgcagcttcccacgttcagataggctcgattctagtttctggatagccttggctccatttaaatttgacaaaaaaaatgaatttgcaccagccgggaatcgaacccgggtctgtaccgtggcagggtactattctaccactagaccactggtgcgttgtttagaggtggtgactcttatttgtaatcgttgtttggttttacaactatcatagctttaagtaaggaacgtggatatttgtattttgtaatggaatttttttcctatatgacatgaaaaaagggagcagatttttttttatagaaatttgacttagaagaaatgactttgtgtttgataacactttgataaaatcccaggtacaaatgattctcaaaatgattggcttgatacagaaatggaagatgctccacaaagaagaaggaagtgcttggaagaacgggctactgaactaatcatgaaggcaagaagtctgtgaaccagtgatgttcatgttctaccgttagatacatagtaagtttgtttcttatgaaagtggcagtgaatgatatccctggcttgcatgccgtagcacagatggatttggctattgaacatggattaacagttttgtgaatcagcttgaattctgtgtgtgaatgagtgaatcggcctgactaacccgagacaaagacaagaaccgcctgacgccgtacaaatgattggagaggagatgggcaagaaagtggcgagaccaagaagcgaatgcatggcgcgttgccacaaataggcagggagaggccctacacttcatgtcgaattactagtttcatggacggactccatatatcctttcttggtagctcacccattgccattctttcaagctccccgtccaaccgatcgtacgtctcctcagctcatccgcttgcctcgtcgctgctgctgctgctgatccacaagcgttcgtcggagatgaacgacctgttctcgtcgagctcgttcaagaagtatgcggacgcgagcccggcgagcggcgtcggcggcagcgacatggaggccggcggcgagggcgtggtgaacctggacaggttcttcgaggacgtggagggggtgaaggaggacatgaaggggctggaggcgctgtacaagcggctgcagtcgacgaacgaggagacgaagacggcgcacgacgcccgcgccgtgaaggccctccgctcccgcatggacggcgacgtcgagcaggtgctccgccgcgccaaggccgtcaagggcaagctcgaggccctcgacagagacaacgccacctcccgcaaggtccccggctgcggccccggctcctccaccgaccgcacccgcacctccgtcgtcgccggcctcggcaagaagctcaaggacatcatggacgacttccaggtataagtcaacctaccctaactgagtgacatgcaaacaacgagaggatgtcatgtccttgtggaggacggcgatgaacatggaatgcacgcaggggctgaggacgaggatggcggcggagtacaaggagacggtggcgaggaggtactacacggtgacgggggagaaggcggaggacagcacgatcgattcgctcatcgagtcgggggagagcgagtcgttcctgcagaaggcgatccaggagcaagggcgggggcaggtgatggacaccatctcggagatccaggagcggcacgacgccgtcaaggacatcgagcgcagcctgctcgacctgcaccaggtgttcctcgacatggcggcgctcgtcgaggcccagggacaccagctcaacgacatcgagagccacgtcgcgcacgccagctccttcgtccgcaggggcaccgtcgagctcgaggtggcgcgggagcaccagaagagcagccgcaagtgggcgtgtgtcgccgtcctcgccggcatcatcctcatcgccgtcctcatcctcccggtgctcatcaacctccgcatcttgacgctcagatgattcattcatcatttcctccctagctaacctgctaactcagatgtgtcaaattaatttatctactattttttttctccatcatgtatgttaatttcgttttcgtttaaaaaggaaaaaaaatctctgttttttggttagaagttgtaggcttcaaaatttgtaccttcctcattgaatgagaagcaggggagatgtatattacagtgatgtaacatttcttgatcatgattattccatactggcagcaaattcaatcttttagctaggattctctatgtttgagatgggaaaaaaatcaacattctttgaaaggaactgaataatattagcctccatcaaattacatcatgataatgccatgctaatgtaaatttaatcagttatggccatgtttgtttaatctctcccataagggttttgagggatatttggaagggatttattcaacagctattgtggtgtgaaattatttctcctcgatccccttcattcctcctctcttatggatattatacgaaaaaggtctaatagggtattatctgcattccatttcaaaagaaaaggacacatccggcgagcagaatttgcaaaaaaaaatcacaacagatttgaacgctgcaaaatggacaattcaattcatgcatagataggatatgttgaacgaaaagaaacgaaaatgaaaaacctattgattatcctatctatgtagactactatgaaaatttccctttttttaccaggtaaacatttttcagtttgatatatactccctccatttaaaaatatatgacgtgattgacttttttttataacgttaaccattcatctaattaaaaaaatattatttattttgttatgacttattttatcataaaaatataatcttaacttatacttctacctattcattactaaatctttgaataaaacaaatagtcaaatattatgtgaaaagtgaacaacgtcatatatcttagaacagaggtggtattatatacacggacaacgtaattttacaagagaaaattaaggatgcatccggcgtgaagaatttgcaaatgtcacaacacatttgaacgctgcgaaaaatggacaattcaattcacgcatagacccactctcactacatgtacgccacgcacgcacccacccacccgtctcacacggtatgctcacaccagcaccatcaacaatgccagcaacgccgccgcggataagccgacgccggcgacggccggcgcggcggcgctgatgatctggatcgggaacgcgcagccgcgcgcggaggcgttcttggtggtgatcttggcgaggccgtcgaagtcgcaggcgcgcacgtcctggtcctgcatctggaagtacatgttgaaggcgtaggagatgttgctcttctcgtcgaggccgttgcaggagcacccgtagccgagcgccgtgcagtcgccgctggcgcacgcgtactggatgttcccggggagcttggacttgtcctcggccccgtcgtcgaacacgcaccactgcttcgggaggtactcgacgccgggcacgccggcgagcggcttgtcgttgccgtggccggagaggtccatcgggaacttgggcttgccgtcgtaggtgaagatgccccaatggcgctcgaagttgcccgggagaatgctcttcatgtcctcgtcgaagaggccgaacatgtagacgtccatcttgccaggccggagcggcgtgccttccttcttggagagcttcttcaggaggccgtcgtagtagcgccgcgcgagcttgaggttggcgttcttgtcgccgtcggtcggccagccgacctcgccgacgacgacctttaggcttgggacgccggccttcttcagcgcggtgaccagcgtgtcgtagttggcgtcgaacacgttggagtagctgatgccgcccttgtcctggatggtcttgccgccgtcgacgaaggcgaactcgaacgggaagtcgtcgctctggtacaggctgaggaaggggtagatgttgacgacgaagggcgagccgtgctcgtgcaggaacttcaccatgtccgtcatcaggccctggatgtccggccggaacgcgccggaggacggcttgttgtccggcgagacgtacacgtcggcgttcagcgggacggtcgccttcaccttgtcgccgacgccggcctcgttcagcgccttctggatgttcttcagcgccgggaaggtcgtcttcatgaacgatccgttgtacgccttgagaaacggctcgttccccacggcgacatacctgctcgatcgatcagactcacgattaggatcatcgcggggattgcggccatggacgaacaccttggcgagcggccggcatatgcccctacttgatcttgagcttgtcgccgtagctggtgacgttctccttgacccaatcctgggcgttcccgtagctgttcatcgtctccagcatgtcgttggggatgccgagcatgacctcgatgccggagtcgacgagcgcgccgacgggccacgggtcggcgtcgaacagcttcaccttcaggatgccgttctccttgagcatctgcacgaccgacttgggcagcagcgggtgcgacagctgcgagccccagttcacgccgacgtccacggcgttgccgtccgccgccgcacgggacgccacggcgagcagcagcagcagcgcggccgcgccggccggcagccgcggaggcggagccatgccggggtttgccgtctcagctctgatcgatctccccgccccctgtgtttcggatcgatggcagctaggtgagagatgatcggatttggtggtgttcgcgcgctgcgggcctccctcccctcctgtggagaggaggacaaaatggcgggtaaaacggttggagtttgaccagaaaacatgcaagaaaagctcatcacctgtagacctttgttgaccacaacaatttcgcgtagaaaaaaataaaataaaacgaccatatagttgcatgcacacgtgttgtttttcaataaacaacgcaaatctttgaaaactggggcacgaatatgctgcacattggctatcggaagaataccaaattaacattcctaaaagtgttcctttgtgaaaacctacagctgcatttgttgttggatttaattccccccatatgtacaagttgaatttgattatgtactatgtttgcggactgatcacttcattgcaaaaataaatttgaccaaattttgatatttttatagggtaacaaactaaacaagattttaccattgcaaccttaccaaaatctatcaaaatttgactattccagaaccttccattaacaaaatgcaccaaattttagtaagtattaaactaaacaacattttcacattcattgacttgacgaaatttagcattgtcaatccttggttttaccaataaatggaagtagtaagatttattttggtaatgaagtgaataaattcgtcatttggaaaagtccagtcatcccttgaggggcaccttttttttcatgttgctcaagaaatcataaaaaaattatattttaataagataaattaatatgtgatacatcataaaaaatatgcaagttgatatttagcatatgtaaaatagaaataaacgataactttgactataaatagtatgcaccatttgctgtcaattttgttataattgtttatatgtgtaagtataaataaacaaatatagtgtcttaaaattttctttaatatttctatatatattataataaaaaaataataataaaagttgtttttttagattgtgttcttatccaaaatggtagttattattcacccgagggagtaacatttctcattgttaaggtcaagaaagccagaggacatcatgctcttatcggttaagaaatgcaactgtcacattgatcgtgttgctattagtttttaaaatcatgtttccttttctaaaataaattaaacagacacctacacatatcatatttggcagtatttctcactcccgatgcatagaatgcatagaatgtgttcaatgtttaagcctttaagatcactgtagaaataagatgggacccacgcattcttacgttcatttgcatatagcacatgctacaatgtatatagctttttcttatagatctttaagctgggacccactcattaaaaaattttatttaacatgaatgaaagagcaccatgcatggtgcaaaaggtacgaactaattttttatttcttacgatctagccttaaggttggctatagatatttttttcactttctcatctcccaatgtataaaggtagaacaaaaatactattttattattttgcatgcaacaccgtggatgcagtaatactattgaagtttcgaactcatcttgcctcctttcttcttcgccgcacggcaggcaagcgcctgcatgatctcgtcgatgccggctgatgctaccacagggatgacagcaaaaggaacaatgatgatagcagcaagggtagtatgcacattagcacatactcctattcattctagtgcaaaacatgactgcctcctggccttggaacttggaagattacaattcgaagaatcaggagtgtctagggcatgtttagttggcaaaaaaaaaaaaaaaattacccctgcatggcacatcggatatatggacatacatttatatacatttgtagtattaaacatagtttaataataaaataaattacatattccatcaggaaaccgcgagacgaatttattaaacctaattaatccatcattaacaaatgtttattgtagcaccacattatccaaccatggtacaattaggcttaaaagattcgtctcgtaattttctggcgaactgtgtaattggttttttatctatatttaatactccatgcatgtgtccaaatattcgatgtgacagcgtgaaaaattttgtttgggaactaaacaggccctaactgggcagtagaactttcactttcacactattggattggggcaagatactggtctaacatctatggtatacaaaggttaaaatttgagagaatctattctataccactgagtttgttcgagttcaatgatttaccattgatattgtctctttctataatataccaacgactttatcaattattctacagtacgccattggctgaaacttctattcaaaaatacccaaaatacccttagagacatacaagattaacaattgatttatctcatcagaagttttaaaaaaatatgaaaatttttatgtggcctctttacacaatttggaagtttgtatacaagtttcaagttttttcaagtatatttagtttttagaaaaaaaaacatttttaagtggtatatgagggagaatttgcttatacaagaggtaatagcataaaaatatcttatatagtgaatgaaagatgatttatattgaaaacaacaataaaaaagtattttatatagcatataacaaacaagttatattttgttaaaaaaataaaaatttagtaaaaaacttgaaacttctatataaatttccacgttgtgtaagaaagccacataaaaattttcatatttttttaaacttataatgagataaatcaattgttaaccttgtatgtccataagggtattttgggtatttttgaaaagaagacccaacataatggcgtattgtagaacaattgataaagtcaccggtatattatagaaagcaacaatatcgatggcaaattattgaactcgaagaaactcaatggtataaaatagattctctcttaaaattttcagcctggaactcggtgccaagctgactaacgtgaagataacgatatgtgaaaaagaaactggaatgcctgaaacgattaagctcataatttttttaaaaaatatttggttctaatatttggagggaggtatctccctttaaatcatttttttatagtttagaaggttaagtggccaaaaattgtttgaagtaaaatggactacctaaataggttgaggtagtaaagtgaactttttttagggtgtgtttgtcacggtcatgcatggataggatatggacatccatattttgttggacatagcgaaccaattttttgtttggtttgtatggataggacgactaaattttgtttggttagagggatataacatggatgggaaaagccaaaagtttgtgggacctatttgtcatatatacatatatgtatttatatttttattaacatataatcattcgagatcttgttttaaatatttaattgtaacaaatataatggtgtaaagataaatggtttaggagaaaaaaacatttagagcttgcttcacagaaaatcaaaccaaccacagccaatcagaatacgacatatcacccagaccaaaactggatggcttcatcgagcatattgagggaatattctatatttcggaccaccccatctaccctgccctctaaccaaacaccacaaaaattcagacgatcatctcctatccagactcatccatccaaccaaatacaccattaatgaatttgtattgtgcttatcagaggtataaacaagataagcgagagagtacgtgagcactagttttctcgatggatcc

SEQ ID NO: 28430 - DNA, 4014 bp, Oryza sativa
ttcaacgctctctttctctactcactcatttaattcctttatctcctaatttttaactaagtaaagaaatatcaataataagaaatctaaatgattataattcttaaattaaatcataattttaacttatttgaatttttgttttatttacaattaaataaaatgtttaagatccatattacccatatttcactttataaaaaatgaaaatatgtcatttaagcatagacatcgttcctttgcatggtaaccaaatagaaaaaacatggaccataatacaaaatgaaaataagtattatattaccgtaaatcactggacatcctctgagcacactcaaggcgtcgcgtgttacaccttaaataaaaataaaactttacaaattggaagaaaaaccatcttagcatcagtttccacttaaataggtagatccattattttcaaccaatagataatcttttaagaaaatcttaagcaaccatgtgttacgtcttaaaaattagaaaaaataacataaaatgtgagaaaaaatatatcatcggtttcacttaaatcatttagataaaatagaaaaaaaatacccctccacttcaccatccccccacacatacgcacaacacggtactattcgcccaatcctttctcgtcttgagctctccactctaccccttcctgtttatatagccggaaataataaaaaattttaaaacttgcataaatttcaagctacacattcgatttctaatctagatattgttgtatttataattaaaagattgatttaaagatccataaagcctatattttgagctggtataaaatataaaataaagcaagtaatagaaaatgacaatagagactaaattaaactatttagagaaaacataatagttagtaaaaaattggttctcacatttcactaaaattggaccaacccattgcatgttcctttttcgtaacaattttaaaatgcttagacattaatgtccttacatctatcctatatcatagcattatgagtttcttcacatattattacacatacaaaccgcactaaggttcgcactatatagttcattgaaaagttatatttgttactattaaatttaaaattttggattcatattaactaggtattttcttttgaaaatatagtacatataacacaaatcgcaatgaagcgaggtatatgacatgtctttattaatttatatataagtatgtaaaaacttgcatcaacttaaaccaactagaaggagaactacttgatgctacaaataaatcatatttattaacaataatagttctttagaatttgttaaaaaaagcgagtaaacattctattaaaaagggacaaaacaccttacttctaatttatacttgatttattagacacattttccaaacaaactaaatcgaacttcattctatataataaaacgatcatagataattatttatatagatgtattaaatattatatattttaaaacctaacaaatatcttggaataattatcaaagcaaaatgccaatgaacagcggaggcctcatctgatgtgtcttattaaaaaatagtacttttaaatatgggaggtgtcagtctattgatttatatatattcaaacgcaatatacaatacatgcccgcgcgtgaatgggcgggctacctttctagttgtactaaatctagtccacagttattgacgccatatcccattggctaagtataaagtcaaactagcagccgcggtaattaaaatagtcacaaacagatctcagcttaccgcggtatatgtttcaagaacacgttactcaaagacaaaacttccattccccaactccaagcaacaagcacacccgtgccatggccgcctcagccaaccgcgccgccgtcaacggcgccgccggcagcggcgagcctgaggcgagccgcgaccatgtcatcatcttcccgttcatggcgaaaggccacacgctccctctgcttcacttcgccgcggcgctgtcggtccaccacaagagcctccgcgtcaccctggtcaccaccccggcgaacctcgccttcgcccgccgccgcctgccggggtcggtgcacctcgtcgtgctcccgttcccgtcgctgcagccgccgctgctgccggccggcgtcgagtcgacggacgcgctcccttccatgtccctctacccggcgttcctgcgtgccacggcgctgctgcgtgagcccttcgcggagttcatggcgtcgctgtcctcctccccgccgctcgtggtcgtctccgacttcttcctcgggttcacgcacggcgttgcgtcggacgccggcgtccgccgcgtcgtgttccacggcatgtcctgtttctccatggccatatgcaagtcgctcgtcgtgagcccgcacgtcggcggcggcgccgccccctttcacgtctcccgcatgccggaacatgtcacgatcacgccggaggagatcccgcctacggtggcgagcttcgccgaccccgacaacccgattgcccggttcatgatcgagaacgtcgaatcgacggacgtccgcagctggggcgtcctcgtcaacagcttcgccgcggtggacggcgactacgtggcctccttcgaatcgttctaccagccgggagcccgcgcctggctggtgggcccgctcttcctcgcttccggcgacacgccggagcgggacgaggagaacgacgaccccgagggctgcctcgcgtggctcgacgagagggcatcgcggccggggtcggtggtgtacgtgtcgttcggcacgcaggcgcacgtcgccgacgagcagctcgacgagctggcgcgagggctggtgcggtccggccaccctttcctgtgggcggtgcggtcgaacacctggtcgccgccggtggacgtggggcccgaccaggggcgcgtcgtcagggggtgggtcccgcagcgcggcgtgctggcccacgaggcggtgggagggttcgtgagccactgcgggtggaactcggtcatggagagcctcgccgccgggaagcccgtgctggcgtggccgatgatggccgagcaggcgctgaacgcaaggcacgtcgtggacgtcgtcggcgccggcgtcaaggtggacgccgccgtcggctccgtcgccgtcgtcgggagcgcggaggtggaggagaaggtcaggagggtgatggacgccggcggcgaggaagggcggaggatgcggacgcaggccgcgtgggctcagcgcgcggcgaggtcggcggtgagcgacggcggcacgtcacgcgtggcgttgcagaaactgattggagacctgcaggaaagctactagtatgtcgtcaccgcagcagaatgaggtgagaagaaattgttacaaaaattgagtttgaccataccgccggacagcagtatacacatcatggtttgactaggaaccttatttattgttgcttcagtatatgtgttgctttgactctattctaaacttgtttttatcaataatttatttgagattgctccagatgtttctaaaattcttctagttatcctcgcaacatttctcaactaaaattacttggactagtgtatatgagaagatattgtcgcaatatggagtttgttccaatgaaacttatttgtaatatatgtgtttactttttggaatatttagcatatcttatttttgggtgtatatactttaagtaacaattatttttatcttatagatgtatttatggatttttagatatattaatggatgatatttcttaaaaaaatatggctaatagaattgtttaatctaattaaagataaaattctatgtacttgtctcttttcatatgctttcttattttcattgaaaatgaattctacttgaaataagagcgcagttatatgcgtagtgtatttttaattagtatgtatagagtattttgaaatgtttaagtgtcgtagactaacgtatacttgtgttagggcaattctttaaagttttgttttattgcatgacttctcatatataagt

SEQ ID NO: 28431 - DNA, 6783 bp, Oryza sativa
ttgacagaaaagttggaagtttgtgtgtaaaaaagttcgacgtgatgttttatttttgggggaggggggttcaaggtttggaactaaaccggggcactgtcaatctttccgctgtctgccacgttcatcggcatcaatgcttgagctgaccaacccaatggctgctggcttggggagacaagaggaatatgaagattcagttttacatgtgggatattaattattttctaatatattttgctgacttagagcaaatttaatagtacagtctactactagctctaattcatctatagccgatctaatagccaattcatacaatagttacttactatacgattaatatatggtcccacctatcatacacacattgcatcttgaagtccgtgctacagccagctataaatctgtagcctgctactcttctctctcaccatttatcttattaaaatatgtttatagttggctaatagtctactattgtaactgctcttagatggccatgtctgtgctacattggcgaaaccaccatgcttcaggcaaggagggggaggttaatttgaacggttttaagagttgaggggtgtatattatacccagttctgaagttaagggtgtaatttagataactgctacgttatagttcgcgcggggggggggggggggggtaaaatggacttatccctttctttagggataagttagttattttaaattgaaactagcatggtggcctgcgcagattgcgcggctagcatcattatattttgtatcatataatagcatatatgttttctcattgtatttttcaaagatattaaaataacaacataattttaaattttgaactaactttacgaaactattaatgtgtaatatttatattgtattttatatacgtgttagttattaattattttaaatattaaattttagttatttgtaaattatatttatatatggactctatactcacctttcaatatttctatttttttaatttcgaattttcgttatctgtaaaccgtatttctatatagactttaggctcttcttccaatattatttatttttaatttttaatttttattatttctaattgtatttctatgtggactctaaactcatctttcaatattctttaatttttaatttcgaatttcagttacttctaaattgtattcttatattgactttagactcttcttcctatatttttaatttagaattttagttatttgtaaattatatttttatacggactataaactctactttttaattttattatgtttgttccgatttttagttagttttaaattcctatatggactctatactctacttctaatattccttatttttaatttcgaatttctattatttcctaattgtatttctatatggactctatactctacttctgatattccttatttttaattccgaatttctattatttcctaattgtatttctatatggactctatactctacttccaatattctttatttttaatttcgaatttctattatgcctaattgtatttctatggggactctatactctacttctaatattttttttatttttaaattccgaatttcagttatctataaattgtacttttatatggactctagtctcatttttcaatattccttattttttaattccgaatttcaactatttctaaattgtatttctatatggactatatttgtctttttctccgattaatatgagaatttctagatcgtgagagcgaacgtggaggctttcttttctattcctttaataagttaatagattccttgggatgattaatgcttacagtaaacttttgcgctcttcgacgtgttattgctctcattgacgggccatgaaacaatgttattccagggtatagcttcagcccagcacccggcccacgtaagacaacctgcgtgtggcatcacactgactgtgtcgacggtatcgtttgtgcaactttgtgctaaactagttggcgcaacggttggactcaacttggtccggatcggatcggagtatcggacagagtcgtcgacgtgctccggtgctgtgtgctccgctggccatcgcagattcaccgcccggccggccatacgcgtcagcagctatacaagggtgcagcgttcagtcacagcaaacctgaaagccggcgccagctgcatgttctcgcctgcgcttaattagcttacttccaccgctaataggaaagaaaactgtcggaaattaatgcttaaggagcctgctttggagtagtatgaccagcatattttccacccgtaataaacttacatttgtgatcgtgggttaccaaagttaccggtgaaatgagaaccctttgtacacgtacgtgttgtttgggagaacatcaataagctcggagttctaagttcttttttttaataatggaatataatatcccgacctttactcaaaagagctacagccaattattatatagtaacattcaagaacaaagtgtaaatctaaatgaatagaacacaccgtagagaaaagcaaagaatccagtctaacgtaaggagatcacaattattgaagtctatttgtaaatctccaaccataattagcaaaaagttgcataaccgtagtctccaattttcgacatgcaatttttagaaactcttcatcttctagttgtgcccaaaaccgaagccaatgagttgccctgaaaatgaccagcatataggaaaatgatggtgatttattaaaaaccatatcgttcctacaaagccatatttcccaacaaatgacagaagctccaataagtattagtttactcattttcttatcaactcacaaaaaccacccattaaaaatatgagataagctaactggaaaattaaaaccaaaagagaactgaactgttctccataggaatttcacaaaatgacaattcataaagaaatgttgaatagactcattcttcaaacaaaaagaacacttcaagctgccattccagttacgccttgccaaattatccttagttaacacaacccttttaagcaagtaccacatgaaagtttttatcttaagtggcaacttaaacttccaaatacacttatttatctcaatatagccattattaattaaagctaggtatatagacctcaccgagaacaagccattctgatggaaattccatctaaaactatcagacgaatcattcaactggatatgtactatagaggcacacaactcatgccaacaaacaagattctgactaactaaagctctcctgaaagaaacattaagcggaacatatcccataacagtggcaatagaagatgttttccttcgaacaattgcatacaaagacgaatatttatccttaaaagccaagttacctaggcatttatcttctcaaaatctaatttgttccccattatagacagtccaagaacccatatttaagaaagtacttttgacattcaaaattagggggtgatggcgtgaggcgacctcctcggcggcgcgctctccctcctccctctcctcgagtggttccgccttgttgtggggccgggcggtttcgtcgttgtctgcgaccacgccttttccaggcacgtgctatgcgagaaaggggctcgttgccgaggtatccaagttcctcttcggccgcttcgccgccgaccatgccgctatcgccatcgccattgcaggagtcaaagtcgaagtcgccaccgtggcctacttcccccgcctgccgccgttcccctcatcctcccactgccgcgagccgccactgccctcgcccgcctgccctcccgccgtcgcccatgggctgtcgccgctgccgctcggccaccgacgacgtcacgatgccgggcgccgggtggtgcaggtggtggtggtgcgagaggaacgacgagcgacgcgacatggactccagcccgctgcttcagctccagtccaatgccgccgtcgctccagctagctcccgccgccgccgccgccgctcgctccccacggatggccgtaggggagagggagaaataaagagagaagggaggggggaagaagaaagggagaagatggcatgtggggcccacatgtcagtgggccccacaattgtgtgtgtgaatgacaaacgggtcccacatataacttttttaattgaaatgccacctacgcgccacgtcagcacacagactaggtcgatactgccacgtcagtgaaaccgccctccaaaaccgccgagagagtcaaattgcaccggtttcaatagtttgggggttaagatatccggttctgtggtttagggtcacggattagattttgattacttttgagggtcaccaagtaaactttttccgccaatgtgacgccagcaacgagaatcaaggatgggaggaggccactgaagtagatcgagctagagaggagggcctgcagagtgggctgaatccaagagaaatcgtatggtgttcaaggattctaaagtgaggataattaagattgtctcacaagtgctactaagcaggttatctgcaacttgctcttctttaaaaataaaaagggtggacagatgcccttgcttaaacacctttttccattagaaattattaacagggaatcgattgcacaattgtctgcaaattgttttaaagataaaaacggtggacagatgccctttcttttctgaacatttcatgtactctcctccactgagaacacaggaacattctttcccatgataatacagaagtacagttatgggattcccttaaaaatgaatacgtataatgattagaaacatgggatggacataccaaaatgatgattttcgttgttttattttggttgattctggattaaatttttggatgagtaaagagaagggaggagggatggaggatgatatacgtgccttttggcgaatcagctcaaggcggggcaacactattgaaaaggcagagaacggtggcagcacggatgcaggcgacggacggcgcgaaggagaagggagaggggagagaggcgaggggagtcgggggacgacgtgatggagagactgaccagacgggcggaagagaacggcggtggcggcaatgggaatcgatcggtggcggtgcgacggatgttccggcggtggcgcagaggagatcggtgaagcggctgtcgctggcgatgtgggcgagcaagagtgagcggtggcggcgggtggcgattagggtcgaggggtgggagcgggaggcggggcacgggttggggtgcgatcgactgtgcgaggatggagaggtgtaggtcagaggtgtagtgtgtagagtccatcagaatcgttcaatcggatatagaagatgaatatggattgttggatttgatgaatcaggatcgtttagtcggatatagaagatgaatacagattgttggatttgatgaatcatgatcgttcaagaataataagaagatcgtactctgtaacaataatatatccattacaaatgaagccgttggcaagtgtagattatttatagtgatggtagcggcatagccgcacatgtttaaatcgatggatacatgtacaaccacaaccaataatgacacactcttataaccagctaccatatgattataaatacaatgtatcgacagcttttataatctcaaacaatagcccatcgtgccttcgggccggcccgactagtattgggccgtgcctgagccgtgtatgccgcccgtgggctggcacggcacggcccggtgcatcggtcgggccgtgccggcctgacaagcctcggcccaggcacggccgggcttgggccgtgccgtgccgggcggcccagatggccatctatagtctccatgcagtatcgtcatcttattatcttaaattcttaattcgttttgtggtgtgaagagtcacccaactttgatgacgacatcgtcgtagcttctctgcagctctccgaccagcttctgcagcgctacgcgcgacgtgccgccgtcgctcaccgccgacatcgccgcccgccgggcccacgcggcccgcgcccgcatcctctgcgccgcctctccgccggcgtccatcagcatcctgatcttctcctccacctcggctctcccaacgacggccgcgccgccgccggagtccaccctgaccccggtgccgacgatgtccacgatgtgcctcgcgttcagatactgctcggcgatcatcggccacgccagcacgggcttcccggcggcgaggctctccagcgccgagttccacccgcagtggctcacgaacccgcccactgactcgtgggccaggacgccgcgctgcgggacccaccccctgacgatgcgcccctggtcgggacccacgtccaccggcggcgaccacgtgttcgaccgcaccgcccacaggaaggggtggccggattgcaccagcccgcgcgccagctcgtcgagctgctcgtcggcgacgtgcgcctgcgtgccgaacgacacgtagaccaccgaccccggccgcgctgccctctcgtcgagccacgcgaggcagccctcggggtcgtcgttctcctcgtcccgctccggcgtctcgccggcggcggggagaagcggccccaccagccaggcgcgggctccctgctcgtagaacgcctctactggagccacgtagtcaccgtcaagcgcggcgaagctgttgacgaggatgccccagctgcggacgtctgactggaagacgttgtcaatcaagaaccgggtcaccgggtcgtccatgtcggtgaactttgcaacggaatatg

SEQ ID NO: 28432 - DNA, 7795 bp, Oryza sativa
agcaggacatgccgtggaacacgacgcggcggacgccggcgtcggccgcgacgccgtgcgtgaacccgaggaagaagtcggagacgaccacgagcggcggggaggaggacagcgacgccatgaactccgcgaagggctcgcgcagcagcgccgtggcacgcaggaacgccgggtagagggacatggaagggagcgcgtccgtcgactcgacgccggccggcagcagcggcggctgcagcgacgggaacgggagcacgacgaggtgcaccgaccccggcaggcggcggcgggcgaaggcgaggttcgccggggtggtgaccagggtgacgcggaggctcttgtggtggaccgacagcgccgcggcgaagtggagcagagggagcgtgtggcctttcgccatgaacgggaagatgatgacatggtcgcggctcgcctcaggctcgccgctgccggcggcgccgttgacggcggcgcggttggctgaggcggccatggcagggctttgttgtggctgggtgcgcgcttcagagttgaagctgtccttcaccgatgttttttttttttttgagaactaccgatgtttttattatatagtaaaacttacgaagtaggttcgtattcccatgatcttcaacaacttgtttcaaaagaaacttttattctttaaaaaaggtattcctttgtctgaaattaaatatctgtacgctaaggagtaaagattatcatattcagccccactccggtgctttatactctgattagaaagcaatctgggccattgatcgtattttattgtagagctgagatctagttctactctcactagtattagtggaagtagaaatatgaaagggtgttttcgtcaagagaaaataatcgcgtaggggtattatcgtattttttcagtctcttactcagcctatcccgatccgattcctctcgcttcgtcgcaatttcaccgctgcccgtcaccattccactccatccctgcctccgtcgcatgtcctggcgcctgctccccctccagcgccgtcgccctcgcccttcctcgccgccctcgtccttcatcgccgccttctaccccgccagcacctctccgtcgacgtccgcctccccgcctcccccgctatcggcggcttccctccgtcgaagcccattactcgtcgccctcgccgccttctcctctggcggcgtctccgcgccggcttgtgagcccccaccgtcgccgtcctcctcccccgcccccttctccagcgagtcgcgtcgcgtcgccgcccctccacccgcctcagccggctctcgatgaggcctcttcaccgcgtcgcttccccccgccaccgccgccacgttctcctccccatggaccgccgcccccttcactccaccgctgtcgccatcgacctagccgccatcgcggctctcccctccccataatttccccggccccttctccgtggacatcgacctagccgccgtcgcggctctcccctccacatcatcccccgcccccttctccaccgtgccggtaccgctggcgtccccctgcaatcgccgtccccttctccagcgagtcacctcacgtcgttctcttccgcgccaccagcaatcccgtgtcgatctcctccgagtctccctctagcaacctcctccttggatggtggtaagtaaacatgtcaaaatttcttactgttatgattttgcagattaaggttgtttgttcttcaatccattgtattgttctttgattatttgattgaatggttgggagcagggtcagtttgcaagatgttggcatgcgcgaagggtatccgcatgccggcgaaggggttatcggagttgaggtgcgacgttgaagcagatgcacgtcggtgacgtcgacagcttactgccctgagtcaccccgaagcgtaaggtttcatataccgctccttctcaacaagtattcaaatatgaaatatgaatattatctcaaaaaggcatcaatgtttgggatccgtcaaatacccaagtagtatgtaaatgatttaataaggggaagagagcatagtaaggtaattgtggtaaatgttcgaaagataatccagttatgtcgtggttggtagcagtggacgatctttaatgttgttcagttcggagttgatcaaaattccggctaagtcctgtcgaaatgttttcacttccttctgcataatgtaaagggagtgcactttaaatgatttttcatattgggaagcactggtgcaaaatatgaatagaggttgttgtagttgcctgtagttgaatttctgggagataagatccgctccaatgctccatgaacttaagggtgtacaggccacacgagacgctacaagaattttgtcgttaggctaacacgtttccgtaattgaataatgtgaatatcatgtggaagagtttgagtcacccacccgtctccttgctttggcaatttttggactttgttgtactcccattcggtaatattgaaattaggccaatcgtgttttaactgtgggtgctgtttctctgtcccgtgtaatcccctctcgatagctaacagctaggaagttttgtgcaacgttggtaccatctttactgattggctttgcgagcgaatctggtatttacacctcacgtcgcttggcgttaataacggctaggtaccagtgtgtatctttaatattaattgggaggaaaatctacagatgttcaacagtaagatagagtcataaattgaattagccattacatagatagcttaagtaagtattaccatgtcaaatgctagatagccgcgtgccatatctctaatccatcgtttatttcgaggtttgcttgcttcgacatgcactccctctacatttagtagacttattttaatggccatctctaggaaggccttgccatctcccctgattcctttcactttatagcggaggcattggatgtatgcatccatgacctgaatttgaggttagttgagttacataacaaatatagttataaaagaatagtaggcttgttaaataggcgaacttacatcatcattcaagaattctggttgtgttagtactttcattcttatccatttaacctccacttgttcaatatgcaccatcactttgttatcctctgtgttattaatgtaggtaatgaaagggtcttcttttttagtcaactctacgaaggtaggacaaattagtaatagatctatagaaatgttaaatggttaggcattaccttctgaattttttaacggtgtctagccattcatttttttttcttcttttgacctcttaaggcgttctttggtgggccattgtctatgatttgttgggtaagatcttccttctcgatgtacactagaatagggtaagtcaaatcagtaacacacaaacatagaatataagtaaaaaattatggatgatgtagagagttcatacattcagatatttcatacggtgtttggttgttttgtttcctcttcttttcaccccgtaattcgtctgtgtctggcatgttagcttctttatccgtttacgcttgaaaaggaggaaagttagtaccatttacatgagcatatgtaactattaaatagcatagtacctattgttttctttgtctgtgcttgggttctgattatgtccttctttttacccctagtttcgtagatgaagtcagtccgattagtcggtttgtatgttcttccagtaggacctgtaagtctcttcctgctttgattgctctggttactgttgtcctgttaggtaacaaagtgcacgttagtattatgataagttgtagaaacgttagcgagagaattaaaattcagtttaccttcgtttcacaagtcatgttttcattttggtttatatagtactcttcgttatgatttgatacatgctccctaggatcaatttgttcttgttcaacatcctgcaatagcgtcaacctttttttagcggtgttacgtgagtaataatgattaacagtctagcttatcatctttacctcaaacacatgcgtagtatcttttcgttcagggcattttgaatcattttccatgcaatctagtatcaatgctcgcatacgtggccaaaaatcctttgtgaaatcgttgaaattatcttgtaaagtttggatgctttcttgtatcctttcttgtaaagtgatatcggctgattgttctgtggatattatagagtgtacctgaataccacaagtgagaaaaggatgtcaaacatattttgtcaaatagagttcgtattaaaaccccataatatatacctcttcagaagtgcatacaaaatcttcattggtacgtgtttctgagtcattgtcgtgcgcattttcattggggatttctttgcaatctatagttcccctaatgtcgtcgacaacctatgttttagtcaaaaatgtgtattagagattttacagacaattgatataattagtgtatagtattaaaaatgagatagttacctgcccttttccaaaaaggtaaaaaagtcgttttttttcttttattttgtcccagtactgaattagttgcctttcgcggccagaatgatatattgtcacagccaatttatctattcgcagtttttcccaataccaaatctgcaagcatttgaacataagataatgagtattgctatgaaaatatgttaatgtcaattttgtaaacatactcaatttgtgcattgttttgaaacgaacctgtaagaggcatacattcccctcaatgtttgtttccttctctctaaattttaatatgcctttcagtaactgattcagggttagactagaccagtttagttccctcattttgtcaacgtcgtcgacgagattgagatatcctgagcgcacatatctttgagttgtaagacatatgaaggatccaattgagaaaagaataaatcttcgaatgaagtggtcatcgtagctcgaggagttgattattgctacccgtaatgcttctaaagtaattgttgtttgtccttcttttttgtacaggttgaacaattcaggtttattgatttttggtgcctcaaatatctcatctcctttcgatggcagtccaagcaaacaatcgacatcatcgagtgtcatcgttacgaacgtaccattaatattgaatgctttcttctccttgtcgtagcttcttgcaatctcattgcacaagtcccggtaaatatgtattttgttaatctttagcaagttgccaagtcctgaaacctcgatagctttcttttgaggtggacttagatgtagtattacctcggacatggcatgtggagagcaaactagagttccctgattaacagaaaagagaataagagtttagtccatgtgaaaatttatgcaattgcacatatatatgattgcacattaccaaacctagagatcatttaatcctgctagaaatcaattagaaatcaaaggaaataatgcaacaaacttaagctgtaatgtatgcattaatcatttttttatcctttacaaaaatacatgagaaaagaaaagaaaattcatgctctggcatgttactcgtctgacatgtttaagtgatgtcctccatcactgttctggcagtctatatggccctctctataatttgtttaatcttcattcttatgtgcaggattcagtgaggttgaggagtttcaggggagcaacatgagtgaggtcttcgagggcaacatagtactgtcaggtctgtgccaccttcacccatgaccacatccctcactttggtttgaaagtttgatagtgtgaaattctgaacatgcagtggctaatatagatcggtcgtcgaggcgtggtaattatattgaaatttccaatcaattctaacatatattcagtataattcataagatctcaattgggttgacgattcaacaaatataaatcagattgtctggatggaatatcatgcattattgagtttctatgctagatggtcacagtgtgtctgtgtgtggcgtagccctgctattttacttctttgatcatgaggccaacatttcattcaacataaatatgcactgcatgtttccaatttcattgctcatgaggccaacatttccaggattcaacataaatatgcactgcatgtttccaatttcattgctcatgaggccagcgccatagttcagacagtaaaaaagacaggctcagaaagcagtacaatcgtttctaagggtttgaattgttgtagtattaacaaaattaacaaacagttggtgctaatgaagtgctgtagtgccattgagtctagatcatctccgcacattgttggctgaaatttcaacttgtaatcctgcataagccgtctccgaagaaatctaagatgtgagcttcgcattgggaggaaatctaagttatgagatgttcttttgtcaatgagatgttttatttttaatattctaagttagtttgcacggatgatcatttagaataagctagttgataaatatttattaaatgatacactatttggatatttattaaatggaactatattccaaattggtcagttaaaagaacatgatttcatcagattggctggtcagatcatatgtacagtactaggctggatctctgcatgctcacaatcgtgatgtcccactgtgtttttgatcgcgtgagatcgattcgccgtctgtctgtgcggcgacacaaacctatccttcattgatgcttcttctccagcgatctggagtacccatctatcaaaggacacaaatggatgtgcaaaatcaccatgaaaacaacaagaacatactatgggacaaaaacagtatatgattttctcactataagtatctgtagtgaaggtcagcaacattactagcataaatgctaaaaacagtacagtgatacaaaattatgatatatgtgaacttatatacaaaaacctaggcgatgaagataaatactacccttagcctgatagaacaatttcctcaacaaaatacagaaggcctcaggttttatgacgctttgatgttccacctgtgtgctgaccgtggaccacgagtgatcccctcataatattgggatggaagctttcctttgttccaagttttcacaaacttctcaaacagatcacgagcagactccaaagaaagatcagagaaaaatttgcctttttcttccttcgaccaggttgcgaactcgttgttctttgcaaaatattcatctttggatatttctttgaaatcctgtttaagtaaaaacaaaagaacaatgataagcatggtctcaaggagaaaggaaatggagagttcaaagggtgcagtatgacattatttatgttttgaacagtttaatacttccccaaaattgttgttagtcttaaaaatataaatggcatacatgacacaactgctgtccacctctccagatacagataagccattttggttcttgtgaactgtgaccttaaacaagtacctacttggtatcactaattttcatcacagacacacaaaaggaaataaccttcaaactgatatcactaattcaattcgatgcaacagtaaacaaaagcttttactttatattcagtcttcagagacaaatacatcctggcaaggttctgaaaaatttcattgttcaggaaaacaaaaggggctcctaatcaggctgggtaagatggctacagaacatatgccagcacggcgaaaaaaatggtcgtaagaaatctgcgataatctatccctgattcacgtactgaagaattaactgaactagggacatgctccagtttggttctacttgtaaa

SEQ ID NO: 28433 - DNA, 6875 bp, Oryza sativa
gttttgttgaagctggactatttttgtcagtcttgcaaaggctggtagatcttgaagagaaattcctgatgcacaagggaaaatacttaatatgcacatcttgagaaaatattaaattaatccaacaaaaaaacaatgccattaatacaaaagatacaaagtttgtgagccacaataaccttattggttatttgagtgcaaggtctcacggaatggccttcatctcttcgatggagctccttttcccctaatttcatcaggatcaaggactctcttctctaatggctggttactagataaaaagtgagttggcataggaccaaattctccggccacgatgttctcatgggatgacgatcctttatccaaaatcccctttaagaaatccatcgtcttttctgtctgctcagggttcctagcggcctcaaagaaagcatcacttcccagatttcggaggctacgataacgaaccatgtgttcaaaccacacattaggatcggtattcctgtatgacctaaatgccgcctttgctcccattgtccacctatccacgacacaacatcgagggatggtgtcaataccaaggaacatgagtacaacaaaaaatgtgtgagcaagggatgtcttcgcactccatcttccgacagtgacactccacaccttccaaagactggcctctaaaagtaaccctcacttcatcccacacctcattatcatccttcaaaccaaaaacatacagtgacgaaccatcttgattagtcccactgatgacttcaagtccagcaattagccgtatctgtgcacgaactttcttgaacacgactgctgtgtatatacggacagcgtctttctccaatgggtcggcgtctattctacaaaaagggaccgaattggtagacttagcgtccaactgagcctccttcttacgcaggcgttgtatgcacaacttaacatgtttgactaagcacattagtgacatgtttctcttcagaagggtgtgaagctttgagtttagtgactcactacgttggttgctgcgcatacccaacaagtatttcccatctgtataggcagctgcccacttctcccttagtcggtacatcgatcagggcgatccattgaccattccccgtgcctccattctccttaaaatcagcccaacgtctctcgaactcctcctcatccatactcttataaattaattttcttagctcatcgagttttggcttacgaaggtgatgactcatattctcctctatataccaagtacacaatctatggtaagcacgcggcattaccttactgatagccttcgccattgctaggtcgccatcggaaattaatgattttggatgcacttgacgcattgcctccaaaaaagtctcaaggagccaacagtaagagttgacagactcattggatagaattccgcacccaaaaattgttgtacttctatggtgattaactcctatgaaaggaatgaaaggaagattgtacttgttcacacggtaagtgctatcgaaaataacaacaacaccaaaagcagcatagtctaaacgtgattcagcatctggcccaaacacattcctaagacgccctccctcatccgtggtgtatttgaggaaaaattatggatcttcttcatgcttccttgttagatatttcaacacatcttcagcatcacgacccttgatattcttcatctcgtaccgagtaaagaaattataaaggtccttcctcacaaaaccaacctcgtccaactcatcgtagttattctccataacctccatgatttgaaaggccctaaggccactcatgcgaagctcgaccgcttgggctttcttagaatcactcatcacacgatgaactccttaaaaaagcaacatggtcaggatttgcaagttcgtgcgtatgttggttatcaaactccttaacaaaccacacacccttctcctcgttccgctcaatctcaagcttagctaagcaaccacagcaggtcagtgcccgtggctccctttttcggtctgtcctctcaaagtgcttcaactccctgtacccttcacatgagcatacgaattgcctccatataatctcaccgtccttccgcttcaagttgtttttcctcacactgaaacccttccccttagcatagtctacatagaatttgtaaccttcctcctcgcttgaaaaaaccacagtacccattattttatactcttcctgatcctctaggctcacatagctcgaagacattatgtcagacctcacctacggaaaagtagaaaaaacaaacagaacaagcacccaaatataaccttatgtcctttatacctcataagtatataaaaaaaaagaacaaccatcaactgcatagatacattgccactctaaactattgaacaataattactacagatcccccacaatggctgcaaattctgtttgtaagctaaaagaactaaggcaagcactaataaattaattcaatgtactgctagtagtactgatgaactatctgcacaagatatgatttaacttcccacctttgctgaggtttatctatgtagattacattctttccatgccctttaactttatccatttcagcattgaagcgtcaaattgacaaatactctaactacagaccatgacagaaaattgggcagtgaacaatgaagtatcaaattgcttatacttgaataaaatcatgtgaataaacagatgtgtgaaacatcatgtcaagcaaccatgctaaattattagtgcaacacatataaaaggatctcttgctttgcagcacaagcttgaagaaaaaaagcagcagcataaattcaaaccagatgatagcagtgacaccgacgagggcagtggactgatctgagaagactctcaaacaggagatttagagtggtcctgcaaatgtcccactctccctctgttcattccacttctcaacctgagacaggaaaagctaatgatgaccaagaaaaaaactaaagtgtggttcttttaacagctaaatttcctagtcatgcacaacagtaataacttgtaaaacacacacacacacacacgcacagagggcgagccaatgcggtacagttaagaactaacacacataacagtcgttgacaaactgagtaaatctccaccgtattctatagttcgtttatcagataaataattttgcacaagccacatcgttcacaagaatcaggtcatctttattgaatcctaatgattcaacattggcagatatgtttttcactcaaagatgcattttgcacttgctactctgtaggacatgttaacatcaccactgaagcatcaaactgacagaaacgaatcaaatatcaatgtgtataaccaaatataccgaagggaatgtgctgttttctacttctgaccagtgatgtgatatgaaaacatcgatgggaaacaactaattttatggactggtatttacaaaaacaatagcttttaaaatccagaagaaaattttcagatttagattcagcaattcaggtaacacattagtcccatttcggcaagttcaactgctattgaactgaaaaataagatttccccgtttatattcaagacatcaactataattcttttactgttaaaataatatattaaagtcaccactgaggagaggaaagggaacagaaagtcaggttgggggggggggatgggaagagtggatacctgatgatttcgccgcacccagccactagcagcgccgcaggccacgccgccgcctgcgtcggacagacgcgacgcaccgcgccaccagccgcgacgccgcctgccaggaggaatagccgccgggcgcgctgccgcctgccggtgcctgcctccgaccagatgcgaaccgaagggggaggggggagatggccgggccgacggacggcgccggagggactggagacggcggcgagggcgggaagggcgggggaggcggactgcgacggagggggcggagaaggcgacgcgggcggaggagagggacggcgactgaggaggcggacaaggcggcgacggcgagcgatacggacggatgcgggcaaggcagcgacgccggggaaggaatagcctacgatgtgaaccgatgcgaaccgaagatgcgcaccgaacaaaacaccccttaccaaaattacccctaaaggatattagaagattacttatctaccctttaaaataaacggtccagattaattctactcggagtataatatttcaagtatattgcaccggagcatcactctatcatattatgtgaaattgatgcgtcaatataaaatgctgagatccaggcatcttttgtgccacttaattaattacctgggcagcaactagtattagctagcaagtgtgactgtcgattgggctatggcctgtgaaagtctattattactctcttccaattagatcgagagtgaaaacactgccaactactctcaatagaagagagaaacgaaatcaaagtggtttaagcgattaatcctaaaatataagtatttttagactctgacacagtcttgaagatgctactttgatcaataatatctataaaaataattaatatgttttaaataaaaaattacatattataatagtttgtttaatgataaatttagtaacatcaagtttacatgattgattttttttctaattctgattaaagttgaaaatatttgatttgtcattgtgtttaaaatgattatattttactatgaagggggtagcatatatgtaataataattaggacacaacagcaataaatgtaccatcccgagatgagatagatggttggtactctcttcgcgaataatataaggtattatagatagaaagagtacgagatacaagaaacacagaatatgacaaaaacctaagttggtcggtgagtgatggaaataaaaataaattgagagtgggcggatgtagcattgccgttgtatggcttgttttatacggatcaaatatttgaattaaaatttgaaatatatattatttttctcgattttatatatatatacatgcttctaaatattttacacaaatatacctctcctgtaaactggggacgcggcaccgcaccattggctcacatcaaacatgtgggaccgattaaagaggacggttccgcggcgccaacacgcgcgactgtcacggtcccgcaccaaccagtcagtcgcgcagaacgggcaggcggcaccgcgggtgatgccgcgtgaccaatctgcgccactgccgcaaagtggccatacacatatacacattcatatatagcacaacacactaattagctaatgctatgggcattaggaataagtttatttgattatgtacttgatcgtttgcatttggcgtggtgtcgctcgaccattatgcgggatcataatccagtcccacgtttcaacctcatgccatcgtcactcccttccgttcccattggtcccgcatggccatggcgcggcaccgatcctgtgccgcccggtcgtgcatgtgttggcgccgcgggaccgccccctacagccggtcccgcgttttggaggtgtcccgccttttttaggtgccccaacgatacggaggtgcgccaacgatacggtgccacatcactaatcaacgggagaagtatatttttataaaatttttagaaatatgtatatatatatatacaaaatcgagaaaaataatatatattttgaaatttaattctcgaatatttgacgtgtgaactgcgtcgaagttaagtcaggctcaattgttgaacttatcgtagcattaattagttctgtacgactataataaaaactacggttgcatttcttaataaccaatatgaccatgctagctagcatggatgggcttaacagtgagaaataaaagccattggtcagagagagcgtgattctagcatgtagctaggatatatagatattgctttcatcgttcttctgtctgggaccaaccctcttaaatgaatccacgggtggagaaaggagctttactcccggttcgtaaccccttagtcccgattttcaaaccgggacgatcaatccaggactaaagatcactatctttagttccgggtgaaaaaactggaagtaaaaatacatctttagtcccggttggtgttaccaactggcactaaagatagagcatttttagtcccggttggtaacagctagcctagctagctaggtccggttgctctattattattttcttttcttcattgtgtttttaatatattgattttactctatccccatcctaaaataccaaataaattatccccaatcctcaagtccccaaatcggccatattcaaatagatcacaaaattttaaaacaaaattacatcacaacttctacaaaattcatcacaaatacatcacatattcacggacatcacacacaaatcaaatacacagatccgaatcacaaattcttaaaaaaaagaaaaaaaacacaggctgtcggccgctgccgcgccggccgccgccgcgccggccgccgacgcgctacccgccgcgaggccccgcggtccgccgccgcgccgcagcgccgcccaccaccgcgaggccgccacccgggcctccgcccgcctgcgcgccacctcgaggccgccggccacccgatgggatgatggggagggaaggagaggaaatagaggagaagttagagaggaggaagaggaagggatgatgggggagggaaggagagaagttagaggagaggaggaggaggaagaggaagagatgggatgaagagatcaggtcagtgaatgaagaggtgaagagataaggctgcccgtctcctcctcctcgatctcgcagatggcagatgcctcgtactttccg

SEQ ID NO: 28434 - DNA, 11005 bp, Oryza sativa
  unsure (1)..(11005): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccacctcgtcgacgtccccactctcgggcagtcggctcatgcctttggtggggatggcagcgagctcctgctgtgctgcctgcacggcgccgaccatagggcgcgggagtgtgcggcgatgactggcggcagtgtggaggaaggcgttggcattggcggcggcggagggacagggatttgaagagggcggaggagacaccgagccgtgacgtccgttttccccttatgcactttgagcgatagccgtagcctcgcgtcgcacaatgagacctgaaccgatccctcctcgtgatctcccccttccgctcactcaccaccatcgcgggagaagctacttcattacgcatggcagcgtgccccgccacgagcacgtacgcgcgctgcacctacccaccttctgttatcgcattagggtgacggatcgatattggagggtcacactttatgtgggatatataccacacctttaacaaagcaaggtgtggcaaaacttaagggatgtttggttgagtactttaaattaccagagcatgacataagttttcagctaacttatgtaatacgtggttagcaatatcagaacaacagtttagctagcttgagctactcttttttacctcaatggcatgtggaacttacatgatggagaaagcatcttgtgataagtatggctatgaaccaaacaaccacctgaatcagttaaacatgtaccaaacttaagatgcgataatactaatcaagttgtgggagccaaccaaaatagccccttttgccaccgaccaattcaaacaacccagccactttgtacactgacagtttgacaccaccttgatgcctacttgcctagtactatttttattttttgtgttggtttgtgtcttggtagtgcctcatttgcaaagaaatggtatgctttttctcctatctcagtaattctctttgccacatctaatttgatactatgtgataggccattaattaccataatcactatcagcattggaagagtacactgctcttagcattgacaacaccagtcttttatttcctttttagaccgcatagttacacgctcacacctgttctattccagctaatgaaacacaagcacacgggacgggcattattcgtttttaattagtaataacacaatagtgtgctgtagctagcgttgtaccccgctcaagagagctagcgcccggccgttcgccgcacgtacaatatgcgtatgtaatctctggtgtgcgtacgtttttatcacacgcacgtacttaattagccatatgcatatataattaagtggcatcatgacggccggccggccggcatgaacagtcatcatcaattcatcacggaggcgggatctgtttgttctgcggtggcggcagcggcggcgacggtggcgccggcggcgtctgacggtacggcaaaggtcgcggaaaggggtagggacgtaatcggcctgggccggtgcggcaaggcccgtcgttgcacacaacatggcgggggccgggaaagggaaaatcgaagtcgggatcatccatgctgccgccgcgtcggtagtagccagcagcctgcaggtcagctggacggacgagaggacagggaaaattaaacgtccagtagtacgctgttgttagtatgatactgatgcaaattaaagtcaaaatgagctgagagagggggttaggggaaggaagaagctaggtagctgaccctcttgggcgccgtggcagacgtggacggagcagccgatgatcaccgcggagacgacgacaagcagcgccgcgaggagacgggtacgttcggtgaaggtcgccatgaatgcaagcacaaaacacaaccagcaaaggaaacggccaagacaggtatagtaccaacttcccttactctgtaattagctgctcgcagtcgcagctgatcgagatgttatgacaactcttagaaccaagtcggtatttatagacagctcgatcgaggaggagagaaaaggccagatagattggctcctccatttaactttacatagtatcttttatttgagcatatactacttaaaaaaataggttttccggcagccaaaatatgttttcataggaggctgacacaaccgccagcgacctaaaaccagtaaaaatcgatgatttttgctagcggttacggtccgcttgcgagcccctaagacgaccgattgcaaaattcgattttcgcatgcagcactactaggaggaccaccagcaaaaaggttatttttccaataaaaagttaatcaatattaagagaagagaagctattgcatattcaaatccacatctagagatccaaattcaaatcctcatcagatccatattcaaatccatatccaaatagcactacatagatttttcactccattttcaatttgcaaacaacaataacagatgcaaatgaaatagcatcgccgtcacccgtcgccgtgctgttcatcattgtcgttgcaccgacggtggtcgtcataggtggagtgggaaagggaggacttagctcagcaagatctggaatcgcgttgaacaagccgagccgagcaacgctgccctctcctagtctctttcctccatcgccgatgagaaggaggagtggtcgtcgccgtcacaacgtctatcgctgccatggacgagctcccctcgccaacaccatggacaaggatccactgtcggagcctcatcgaagccacccacgccatgggacctgtcacctccaccggatctatgcctgaggtcactgccaccactgcttccatggcttgtcgtcatcttcgccaccgcctcctccccttccgctgctggatctgtggcatccaggcaccgtcaccaccgaatatgccgccataagatccgtggcttgccatcgctgttgccaccagcctcgtcccttctcgtcacatgatccgccgccacccgcctcccgttgccatcgccatcgctgccgtggcatcatcaccatcgtgtggcacgcaggcacggtggaggtggggaagttgaagggaggagggagctgaggagacggaggatttagtgggtggcatggatagtgggccatagggctgtgcgattttaatgccagcgaaacatcaattttcgttggcggatacttaagaagtctgcttcaaaaaatagagttttttttacagacctcctaagcattcgtcggtgaaaattggttttttgctggtggttcatgacctaaaatccttcaatacatttttacaagtgtttatttcattaacccgtcaataaaaataaaagggtgacaccatgaaaaaaatcgtttttagtagtgataataatgctatggagtgtctagtctatttctatatatttgtatcacccacacaatcgtcacttctcttttgggttttagtgcggttgctcttttgggtatatacatggagaaatctatatgcatggtagtgccggtgctgctcgctttctccagttagtcaaggctgcccacaaccatgccgtgcatagaacggaaaaatttggaggcacgaagatatggggtcaggtcaactagtgcgctactacctagctcgctccaccgatgacccaatggcacaccacgcacgctcgcaacgcacgtcgttcggttcggtccgctccgttctcttgccgatgcacaccggtgtgaaaaaaagagagtcagaaatggtcgcaaaacacctttaaccatttccatatcctagaaaatgggatcgaaattaatgataaaaccaaaaacgaatacggaactatatacaagacggattgaaaagtgataattcatggcatgactatataatgtaatcacagaaatttaagtctataagttataacatgtaaattacaaactatatatctctctcctttagcagctatgttctcaaaatggatgatccaactatgggtcaaatatgtacaatagatattgagctatttatagataatgaggtatttagaaatacggtcatttatgtagctaggactttaatttctcggttcgggtcgatatattctaatttgttgctaaaatcgttgcctatcttgacatatcagctttggctaaggctgcattgcttgatcacttggtttgatctggtacatccatcacatttgtatagatctatcggctaaataagtttttcctattatatcctattgtataccgtctcggttagatccgatctattagattgttgctaataagtttacttctactaagtcgataggtttttatgcaatattcatcggagttctagccgcattattctaagctttagttatcatattatcgattcattagctgatgtacattttaatctacctacgtcggacctccagccaacatatgcttaaaccttcagacctgcatctaccactatatcagtattggtcaattggttcaatgttttgattattcctatcatccttgttagttgcaggattgaactaacgggcacaccctgaaccgatttttagaaattgcactagagttcggcggatctctcagaccttcgtgtgttggacaaaattttgtggcaacatattttggcacgcccaatggaaccattatattcaagccaacgtgttgaagaaaaagccgatgctaacaacatgatcccagtcacaatagagaatttgaaggaggaactgaggcaataggtggagcagtccgtggctgattttcaaaatctttgtctagagtcggtcagcatgatgcaacaaggaccacttaagaagccataatttccaaggccagttctgatcggtaaaccaagccaagatgagctcgctaatccgcagaagttttttcaagatttggttcatgaaggcatgaagctatgcatcttgcatcaatcggtcaatctgaagtgttgacgctgatggatttagtcaagcaaacagtaaatgaatgaattgctcaagatcactagtttgtcttccaaaaaagacgatggcaaactttgatatacagatcgatgtcaatgtcaatgttgatgccaatgatgataggagtgcctcaaatatcttaaggacattcaacttgagaggggggggggggcaccacaatgagattcctcctggaaatcatcaaacaaccgatagagggcactggtaccaagtaccaacatggtgaaattctttatcagtatcaaccactaagagatcggaacatgcaaggaacaactcctcatcggtataatatggacaatacaagagatgatatgtgtgcaagaagatagctgaagtgatgaggtaatagtttgggcttaagcccaaagagcaaacttttatgtatcgacggccattcctgagtggtttaataaggttccactacctcaccgatagagggccctaaatttctcaccgatacacgctccatgtggtgaagcatcagatgaagaagttttgcaagttagatttttttttcattatcattatctggatggactttcacatagttttcatcattacctccaaattctatcaagatgggccgatcaagaaaaactatccaacctgtatttaccacactatatcagtactagccaattggttcattggttcaattattcctatcatccttattagttgtagaatcaaactaactgacacgcactgaacccgacttttagaacctgcattagaattaagtagatctctcagtccttcatgtgttagacaaaaattttttggcaacagctagtcatgtataacttccttgaattttaaatcttcaaaatcgtttggcatgcgcttttctatggatataccataacattgaggtgtttctatcatcaggtatactcccttagttttatgaacgattgtgttgagtttttatacacatttaacatcttttagaaattatataataattatttatttgttgtgactttattaactatcattaaatatacttataagcacgacttacaattttttatagttgcataatttttttaaataaaatgaatgatcaagtgtttatctaacattaactgtgtcgactatcaacaaccggagggagtacgtgtgaacctggaccaacacaatatcgacaattaacacagcggcactttatttgtttgaaaccagtcacacacactcacgcacccacctatccgttttattcctgctaatgaacactagcacatggaagacggaagaacggtatatatgatccatatagctagtaacaagtatacgttctagtacctgcgagagatcaacgtatatacgtacgtacgtacatacgtgccctcgacatatatagatacatacatacgtatacgcgtatactattccgtcccatacaaagccaatttctaactacgaacctcgacacatgtgtgttcagattcatagttacaattgaactctttttgggatggaggggtagcttatagggtgcattgggtcgcgtgaggtcgtcgtcgcggcggccggccatgctcgatcacggcggcggggtgtccccattctgcggtggcggcagcggcggcgtgggatggtaggggagaggtcggaagcagggatagcgtccgcgtccatagccgggggcggggagatcaggcctgatgggtattaggccaccgccgtggccggggatcaggggatcgtagcagggtccccgaggcccgtagccgccctcaccaccgccaccgggaacgtagacgtcgtcgtctttgggacggtgatcagctggcgctggatcaggacgggaaaatgctcctgcatcaacgcgcgcatgcatccaagcgttagaccacacaggcacacatacactggacactgatcaaaataaagtactccctccctccgtttcaggttataaaacgtttagactttagtcaaagtcaaactgttttaagtttgatcaaatttataaaaaaaaatagtaacatttttaagctcaaatttgtaaaaaaaaagtaacatttttaagctaagacaaatttattataaaaatatatttaattattgatttgataaaattaatttagtattataagtattattatatttgtctataaacttagttaaacttaaaatagttttgaccaaagttaaaacgccttatatactgaaacctgaaaatggagggagtagtagcaagtgaagtcaaaatgaaaaagctgatctgaccctcgcgggcgccatggcagacgtcgacggagcaggccatgatcaccgcggagacgacgacgacgagcgtggccaggagactggtacgtccagtgaaggtcgccatgcgtgcaaccacagccgagaaaacgaccgactggtcgatcacgcggatgctgtgatgacaactcttggatggagccaagccgggttttatagaagtctcggtgagctgagattaattgggcccctcgatttgatcacctttattttttagcctaacatagtaatattgctctggtctattctatgctcatcgctcacagaattctcacttgtttttggttttagtgacttttctcgtaaatatactcacgcttgatcgttaattgtgacgtacatggaggaggaatctatctataggcatggtagtgccgttgctgttctgctcactttctccggttagtcaaggttaagttggccacaatcacgccgccgcgcaagaactgaaaaatcaagaggcccggcataaatatatcaattttaatggatcatgtcgtgtcactctcctctcgatcgatcagctcgcacgcaccgatggagacatggagtcaactggtgcgctagcttagctctaccaatcgaatcgcccactagcacacaccaccaggcaccaacgctagttctcatatcgccccgatcgatcgatccgcttccggtgtagtacgcgcgagcacgcgggatcgattcatcgatattcgatacgactgcgccgatcgatgggcgcgtcatgcgtctcgtcggctggtcacgagtcatcagcaaagccgtgcaaaaccgcgctcgcgtatacggctcacgcgcggcgcgcgcgcgggtcctccgcttcgtaatcgcgcggatacgtctcacgggctcgtggcccctgccagcgatgaagcatgcaacggaggatggaagctgtaggccgcagcgctagcccacctgttggcactggtgggctgggtgctgatccccaaaaccgaaacgaataagttcatccgagatcccttaacttgtaaatgaatccgattttcatacttcaaccagaaaaccatatacaaaagtcccataaatgtcaaaaccagtgcagatgaggtccctcggtggttttggctgacgtggcgcatacgtggctaatttgaattggtcttcatatgatatggcattgacgtaacgctacctcagcaatttgacccggacaaatagtaaacttcgtgggacccacatgtcagttacacacatgaattaattataaaaatgttgggtcccacatgggtcccacgagtcattctcagcccctttcttcctcctctcttcccatctccctctcctcaactctctctcccctctcccatccccaatgcttctgagcgcccgccgccggcgccgacgcagctcccgccgacgcagccggagtacgcccatctgcgccgactgcctcgcgttctccctcgaggctgaccccttctgccgggagcccgacccgtcggccgagtcgtagtgcgggaggtggaagagtccaccatggcgcagacgtaggtgggcacgagaccagcgtcggcgtcggcctgcatcacctcgagcagcttcgccgggtcaaggccgtagtctgtctccgctccagtggggatcgcccggatgttggctggatcgaatataacatgttcgtgtggctcaaaggtcaagcacgtgaatagtgtagtgatgctaaatgttacttctactcataaagcatttaccgaagcaactctaggtgaggccctttatcgtttcaactattctatatatataatctctaaataatcatctaagagatatcatactcgtttctaccgttgtacatggtatgagtaaaaaaggagaaaacttggtgagaattgaagagaaatacagatgcattttttcctatcgcatgtattcacctttagtaagagagaagaatcagcatgtcgcagtgatagatccaggaagaaataataggagggtctccagtgatagatccgggaataaataataggaaggtccgaagaaactaaaacaaatctaaagccctcctccctctatgtatggcagaaaaaatatgtgaaggctttgtgaaggcttcaatgttcctcacgccccccaaaagcggattgtggaaaatctctctcgcagctccagtccaagcccctctaccgtctatggcgttctcaccggagctgagatggaagcatgtggaaaaattgatgattatactttagttacaaatgaggatgcttatagataggatatttgtacattggttcttgtaaaatggatggtctatagtaacttattaataaagttcctttcgagggaggggcggagacaggagtagggcaattagggctgtagccctactcctgagtctaaatattcattagaattgtactttaaaacttcgtaaaatactccatctataattgaataaatttataattgaataaattatagatgttttaactttagtcaagatctagaaaaagtagtaatatttacaacaccagcataatttcattaaatctataattgaataaatttttataatatatttttattgggttaaaaatattactactttttcattaaatctataattgaataaattttcataatatatttgtcttgggttaaaaatattactactttttctataaagttagtcaaaaacttagagtagtttgactttgacaaaaattaaagtgttttatgacctaaaatgaagggggtagaaaattaaaggaaaagctatgtaaattacattagttgaggcctaagaatcctgattccgccactctttggagggatcgattcatcccatgtgtgcctgcgtgcatcgtcagttattctatggacagagagagcgtacatactctttatataagtacaaaacggtctgacaattgcatcaattacaaaaggagaaatacgtgttggagttctcttaataaaggaataagtaatactccacccaacaaattaataacctgcatgtttgtgtgcagaaataaggggaaattgattgtgctgtatgcacggaccttaggcagatcatatcagattacatggggcgatccttcattaggtgggtaacatcgagaggcctttttccagcaactaggtagcccgtgcaaaatacgcgggtatacgtcgtacgctaagtttgagacactaaaactaatatattaaccggagaacgtctaccccgatttcttcgtaaatgatttttgttagcattagttgcttttataatttttaacatattagctttatattatatcatatttaagtaatatctatatgcagttatttataatcttattcatcatttgaaaagaaggtagacttattttctttagaaaatatttcaacgaaagtaaaagtaagtgcaaagcaaaagtagtgtgtttttctttttttattgcatatatattatcatggtttattagaggatgaatttggtgggacatgaagctccactaaattttatatagccctaatacgatttatgtagtttgagagataatccatctataaacatttcatg

SEQ ID NO: 28435 - DNA, 678 bp, Oryza sativa
tggtatcagagaccatggcaccagatcaatcctcctcctccacgcagccatccactgatgccgacgcactggcaaaccttcaggaatccatggcgacggtgttgagcggcatttcgcttttggcctccaaaagtgacctcgccgatctcagccgttctgtcgctgtcgcgacctccagcatcaccgccttggagcagtcttcctccacttcctctggtccacgtctgaccggcggtggcctccttaaatcaccaccaccaccacccccaccacctcccccaccacccccaccaccacctccgccgccacatgccagacacggcgcacatcacgatgccaactccggcaacgcagttcctcgcttttacaagctcgaatttcccaagttcgatggctccgacgatcctctcaattggcttaatcactgtgaacagttctttcgtgcacagcgttcgccggatggggatcgcgtttggttggccacataccatctcactggtgccgctcaggagtggtatttccactacgagcaacacaaagggccgcctgattgggacacgttcaaggagctatgctatgcccaatatggtccaccaatccgcaacaacccgttgggtgaactcaagcgcctctcacaatcgaccacggtggccacctaccagcatcgcttcctcgcct

SEQ ID NO: 28436 - DNA, 714 bp, Oryza sativa
  unsure (1)..(714): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattcgagttcgnnnnnnnnnnnnnnnnnncaacgtagcccctctatcagaatagaaattcaagaagtaccatttctggccaatcttatcctgttagaatccaaagaccttgatatcatcctagggatggactggttagccagatataaaggtatgatagactgcgccaacagaaaagtaattctcaccagcaatgatggtcgagttgtaactgttcatgcattatcttctgagtctttaaggtcaagtctgaaccaaatgactttggaagagattcctatagtccggagtaccccgatgtgttcccgaacgatttacttggtatgccgcctaaaagggatatagagttcagaatagatctggtaccaggaacaactccgatccataagagaccttatagaatggcagccaatgaattagcagaagtcaagagacaagtagatgatttgcttcagaaaggatacatcagaccgagttcatctccatggggagctccagttatttttgtggaaaagaaagatcatacccagaggatgtgtgtggactatcgtgcactaaatg

SEQ ID NO: 28437 - DNA, 39360 bp, Oryza sativa
caggctttctaggaggtggatgagagtgattgagtgtctgcagttcatatgccttgattacagagattttaaacattggaaggttgagaaatttgctcgctttgtggacaacctattactcatccgttctaaagtagacctgcatactttccagctttattggtttcattatcttccactgaactgcaatgatcttaggaagtggatcctctatgcggtgaagcacaatgttaaagtgcttgatgtggaactggatatgtatgataaaacggccttaccgtctcgcattttcacctgccgttcagttgaggagctaagtttgcagatgggagaagcccctgatgaagatcttgaacacgtaggccttgtgcttccggacataattcaacttccttctctcaaaaagttgactctctctgatgtagaagtggaccagctttctctgaaccaattcatcggtcggagccctaacctagaagatttgcatttgataaactcggcaacatatcttgatctgattgcctccaaagtgctaaaaaggctaactcttgatggcttcatgcatgggcccaaaagattcacaatttccgcccctcatctcgttcactttgagtgccagggttgtgcactgcaagatgtttcttggggagagaaaccatctctagagagtgcacacatagatacttgggggaagaaatatgatggtgaatctgagtttattggagtacttttatctgccaagacactcgcactatttggttctgacgtcaaggtatattcgcaaaagacaagcctgctgtcttttgttacttctctactcttttgttttgcaaaaatcttgactatatttattctagttaactactctgaatgaaaatgtgcatggcttgaaactataccaacttggtatctagggcttgtgtaaccgactagaatcttggggatttgatatggaaaaaagggttctattctggaaagatcagatcatagctgtgtctgtgtctacttgctgtatatcttttctaattttgcccttcgtatatgtgtcctgcaaaaagagtaagtttgctagttcagtaattagtagttcctttgatctgttagtttctcccatacaactttcaaagctgtcagctgtagtatgaaaaatttgtacgatatggtctcacggtaatctcatgggatgaatgtggaattttctttcacatgtcaatattacattgttattatgcttggagtttggaaatgtcctggttttagttcttagttatgacttgctcactcactcaatacaaggttatgttggaaaaggagctgccggcatgtccagtgtttgagaggctcacaactcttgaaattggtaagtggtgtttaactgaggatttctatactgtgcttcgtttccttcaactttcgccgagactaggagaactgacattgatgcaagaggaggtatgccgcacgtaaaaatcttgcatcatattggaaattcctcattaaatacacccctctttttatttatttcctgttatgtctctagcttcctcacgcagcaagaaaaggagcagaaacagatgctatgccaattgatggaatgaccttccaatgtccgttccttgagactgtcataatacaatgttccaagggcgatgatgggatcaacaagctggtgaatgttctggcagcaaatgggattaacccaaagaagatacaggttaatttctatgaagatatcgaagagatggagcgggctgagaacaggcgcatcatagaggagcgggagaaggagctgtgcaacttcgagaagatggcgaagaaaaacccagaatgggtcgacgaaagccgttatgctgacagtaaccctgaaactgatagcgatgagtatgatgatgactacgatgatttctagagtcctgcagggtgtgcttccatcctttcgcggccgcatgaagcctgcattttatcttcccttggaactgacttggtgtaatggtgttagagactttaagcatttgcctgtttctgtttattttgtgctcgtgactgctggactataatggagcaaacaagacaatttgtaggcactaatcctttgcggtttctgtttgatcatattgctttctccatggtacctctcagccttttgctgctcttgacatatcttgagctctttgaatttgaaagtgaacttgagagtgttttgttacatgaggtcgaaaatcaaaaacaaatttataatgagaaaatatcattggacagaccaatgacaaaccagttgtccaatcccaagctgactggcaagatttggggtcggttcaagggagccgtccgatcgtccgttaacggatacgatttagtcagaaacaattgcgaggaattttaacgaaggcccttcttgtcatgggcctcctttcttgtgcttatgttttggcccagtagcttcatacccatacccccaagcaaaacctagccgctcgccgcctccgcctccgccgccgcgacgagatggaggtcgacagggccgcgagcgccgccgctgcgggggagtcctcctccgccggcgcgatggcggtggagaagccgcggttcgaggcgctgatgccgagcgagatgagcggcgggaggccccagttccggaaggtgccggtgccgcagcaccgcttcgctccgctgaagaaggcgtggatggacatctacacgcccgtctacgagcacatgaagatcgacatacgcatgaacctgaaggtagataaacccgatgctaaaaactcactcttggttgtatacttatgattctgttgttcggggcctcaaattgggctttcgtgtaatatgtggttgcgaattcggtttttaaaaaaaacgtggttgcgaattgcgaagggtgagacatgtcctgccaggcttcgtgatttttgagcatgacgccggggtgtaaaagtttcatcttagacatttacaggttaagcgattgtgtgaaccatatagtaatagttagaacaattatcgcagctgttacaaagttggtagtgacatgcttggtgctagaggatatcttagctggtgctaggactaaatggtggtactgtttagttcagtggatcatggtgtaaaagtgtgctccttttatggccattccttatgttgtagattcctcattggaactggaaagcctttcatggatgcgtctggtgtaagagctttcatggatgagtccggttttaacaacaaagttttggcaatatgactgaatataggaatacaaaaagaactaagttagtattgcttatagattcaagtttgccaaacacttggttatttgtatttcgattcaagtttgccaaacacgtggttattagtactatgaatgtactatgccaattcagtaaaggaaagtgatgcagaataagtacaaatcacaagaagaatgcaggttgtgtctaaaacgtgtaggtaaattggttttcttgtgaattttcagttattactaaactcgaatggtggctaccatgttttctctgatgttttttaggtaacgcaacgactgccatcagtgcttacattattttactttctgaaaaagaaaatcctgtattaccattttaatattgaatgctcatgcctgcactgtatccactatcaagcttttcaacctgtttctgttatcccaggcaagaagggtggagctaaaaacaaggcaagacacaccagatgtgagcaatcttcagaagtgtgcagacttcgtgcatgcttttatgcttggatttgacatcgcagatgccgttgcattgctccgccttgatgacttgtatgtggattccttcgagatcaaggatgtgaagacactccggggtgagcatctgtcacgtgctattggccgtttgtcagggaaaggaggcaagaccaaatacgccattgagaattctaccaggactcgcatagttattgctgacacaaagatccacatacttggatcctttgttaacatcaaggttgctcgggattcactctgtagtctcatcttaggttctcctgctggcaaagtgtattcaaagctaagggccgtttctgccaggttggctgaaaggtattaaatgagttttggtccaatcatatagttgcagttttgatcttatagtatgttctactagctgatttgtgtgagtgggcaacttattgtaatgttccgatgaataaccaaatgtatgctagtaatagatttgtaatgatatgccttttctaccgcctgtttgagggaatggtaagtcgtgctatgatgtactgcatgtaaaatgtttacatccagctgtgccactgaaatgaattcagtgccagaaacctgataagttgcttcctagaattgtcaccccgttccttcagaatgcaagaaatgttgatatcgtcaagctggtgatggtcgtttgttcttttgtcttgcctattatgctccgtcattctggttttagttcttattaccggtctattagaagaagccattgcaaatcttgtttgtgctgagaaactctgcctgtcaacactgcacaaattactaaccaacaaattgagattttttttcgtctggtttggttcgtgtggaagtctaaaaatgacttgtgctgggatgcattttcggatgcttgactatgatgccaaatagaacgtgtaaaaaagaagtgactagtttactcccttggtcccctgtctcaaaatgtaataatttataattctttaggtgatagcgaatgttaagaaggaattatggtagaaatagctacttatcttcgcaggatagataacccgctgactcggattataatagagtcaagagataatagatgtaatatgggtgatttatactctctccgtttcaacttataagatgttttgactttggtcaaagtcaaactactttgagtttgactaagtatgtagaaaaaagtagtaacattttcaacccaagacaaatttattataaaaatatattcaattagcgatttgatgaaactaatttagtattataaacattaatatatttgtttataaacttagtcaaacttgaaacagtttgactttgacaaaagtcaaaacgtcttataacctgaaatggttggagtagtaaacgttatctttatactccatgttctagctgctatgttttgaatagatttaaactctagaactttgctatattttttaatagtactataatatgtgaagcgggactaatatgacatccttcaccttcagatagatacgatcttcttgagaagactaggggctttcctgaaaaattcttgagactaggttggcaaaggctcgaacacctgaacggcaaacctctccgagactccgatgcgcgctctcctccgcctccgccgccggttgcctctgcccataaacacgagggccttctcgccgtcttcaccctcccctgcgccccatgagatccccaccgtctactccttcctccagccttccgtcttcgcgccgcggcccaaaccccagccgccgccgccgccgccgccacctacacctcccgcgcacaagacgctgcccgtcggcgatgccgtcgcgctcgaggacgagctgctcgccgccgtctccgaggaccgctcggacgacgcgtggctcgcgttcaggtccctggcgtcggcctccctctcgccctcgcctcccgccgccgcggcgctcgtctcccacctcgccgcagcgcaccaccaccgtctcggcctcaagcgtgccttcgcggccgccgtgttcctgctcgagaagagcccccacgcggaccccgtcccggaggccgccctgcaggccgtcttcacttcgctcgccgcagcggcctccgccgctccggccttggccctcgtgcgcgctctgctgcgctgcgggcgccgcctcccggctttccctgtctggggctccccgcttatagagctcacgcgcgctgacacgggcgccttcgtggccttcttgaaggtcttcgacgaagcctgcaagcaaatggtgtcggagaagtccccctctgcggcagcggcgatgcgtcctgaccttgctgcctgcaatgccgttcttggtggctgctgccgtctgctcggttcagtcacagaagctgagagggtattggagatcatgtcggctattgcagtgtcgccggatgtggatagcttcggatgtcttgcgttcttgtatgcttggagagatattccaagccgtgttgatgagctcgataaattgctggatgcgttaggattcggcaagaagatttttttcaagaatttgatcagtgggtatttgaagagctgcagctttgagtcagtttcatcagtcattcttcgtgtggtggaggagagaagagttgggggtagcaatgcatttgatttagaaagctatacagaggttgcacagcgttttgtagataatgggaggatcagggaattagctcagttgatcatcaaagcacaggaaactgagtcattgcagcagtcactggcagttgaggattctgttgggtttgggattgtcaatgcttgtgttgagcttggcctattgaacaaggctcatagtatactcgacgaaatgactgctcaaggagcctctgtggggctaggtgtatactcctcaatcctgaaagcgtattgcaaggagcaaaggactgcagaggctgcacagcttgtctcagagattagtgcagcagggctgcagcttgatgctggcagttatgatgctcttattgatgcttctatgacagcccatgatttcctatctgcattctctctcttcaaggagatgagagaggcgaggttaccagaccttaggacaagctatcttactataatgacaggcttaacagagaacaaccgtcctgagcttatggcatcattcttggacacagtcgtcgatgatccgaggatagaaattgcaacacatgattggaactcaataatacatgccttttgcaaggttgggaggttggaggatgctcgaaggacataccgaaggatggtattcctgaggtatgaaccaaataatcagacctacctttcgctaatcaatgggtatgtctcagcggagaagtactttagtgtgcttatactatggactgaagtgaggaggaagggggctgatttcaaccatgagttaattgatgcatttctgtatgctttagtcaaaggtggattttttgatatggcaatgcaagtgattgagaaagcacaagagttgaaaatatttttggataagtggagacacaaacaagcattcatggagacccacaaaaaactgaaagtggcaaagctgagaaagcggaatttcaggaaaatggaagctctgattgcatttaagaattgggctggtctcaatgcatgacattataatctttttatcagtctatcatgactgattttaatggcacgtatctgagatggcatcccatagtcctcttggaagtaacaagcagcggaccttcagagatgaacaagtgaggggttttgtcatcatgtcaaattttgataaggttaggaaggccggtgcgctttcggtttcttcttttacttaaagtaatacatgtttaactatataggctgacctgtctctgtactagttctagtcatttacgctgatgtaatctccaaaccatgaaaatcttaaatgagctaatatcatgtttatcctgaaatactcatgcaatacatatttgtgttcatttggttcatttagattctccaatccattcactcctcttactgttagtccattacatggacaaggaacttctgctatcatgtttctgattaaaatagtttgtacggacaaggatgtaagaataactgagtaagcagctcacatgtttctgctctctcatagtgttgaatagtgaaagcaggaataaccaccatagttgataagccctcaacactaaaactgaaacattctaaaattgaagtctagatgtttcaagtccagtacgaacagcttgtggcaattgggctcatagtaagaatgtaagtttttcctttttactcttcaaactaaaagagaatgaagttttggacttttggttttcgaaaaattgctaagttgtgcagtgaaggttttcgaaaccagtttccttaaaaaaatatatattcaaaaccaattcggcaagcaaggcaaatggaggtaattgaagaggcaatttaagttctaaaagagcatccatagaataccaaatctgcaaagaaaactgcacatcgatgttctaaaatagcacccatagaaattaagaggcaacataggttctaaaggagcatccatacgatagcaaatgtatccgcgtctctgcgaagcaaactgcatcggtacacggcagtcgacatccatcaggcgcatactacattattacagcaaagacacgatataagtttggccttaaaaacattattacaggttgttaacacaaccttaaagttctaattaattcagcaaattctgggagatgcagggtgatcggagccgatgaatccccttcgcatgttcttgatttttatctgcacacggacctcccttttctccctgtacaaaacagacgagagctcatcagcaacactagcataatatcaggaatcagatggaacttcattagcctagtttaacaggaaacttgtcaatgaaatgattacctctggtgtttttctgaatctaggggtggaacgggctaaccccgtagataccagaatgctcgttcatcagcgtcttcttgacgagggcaatggtgtcagtcatgagcctgattgccgatgccgcagaccgggaatacatgcgatccccactggcgagcttcaccggaatctggaagcccatggtcatgagagttcccccaacctcgccgagggcgatgccgctgctgtcctgggcagcctcgacgtcagggagaagggagaagccggtggggtagagggacggcccgccccgcccgggcggcaggtcgctggggctcaggaccatggtgttcatcagctcgctgtcgatctgggagtagaccatgaacgagcccgacgcgtcgtacccgttgttctgcaggatcatggtccttcccctgtcctccctgccggcgcgctgatcaacaccgcacatattgtcggagtcagccggagtacggcacgagagatggccggtggaggtagcaaaattaaggtttgtggtgcggtaccttgcagtggaggacggtgacagtgtcgtcgttcccgacgcctctggcgatggtgacctcctccttcaccacgctgccgtgcaccaggacgtcccactgcacggccggccggcgtcgcggtgagttcgcgagaattaggaaagaaactaatttttcttctcttctttttttgtttcgtgtacgtaccttgcagcggtgagtaaggttcctgagcagatcgaaggttttcctcatgggcagcggcagacgcagggacgcggtgacggacaggatcgcgttgtagctgctgctgccctcggtggtcctcctgtacgcgaccctgatgtccttctccgtgccggcgccgatcacgacggtccacgttcctccgccagtggcggcgatgccgccggcgaagctcgcgagcaggtcgtccgctagcttcattagattcttcctccccttcgtgctgactgagacacacacacacacacacacacacgcacacaacaaaacaacgaaaggatggaaacgttgttcatgcaaagctggaaacggctccctgttctgacaggaatgcggcaattttcagagtttcaggcaccgaaaggattttacaggttgccattaccttgcggagctgtcttgttgtgatgaacatctctcatgcgtgcagactgccgcgccatggtcgccacccagcgccgagctccgaagacgagtccattcatacaaggctggtagagctcatgaacaccggtgtcatccgcaaggacgtgctctatggcagtgacctgccaagaagatatcatacgacagatcagatacgggattgaatatattggtaaaaaacaattcttggccattttttttataacgtttgtgtgtcacaataccttgcagctgtttggccttatggattggatcagaaaccctgatggcattttacggcatttggagaagatactgccatcgtccaatgacacatcaatgacgaccactaatccttcgttcagcacattacaatagcgcaggaatgtgcatttcctagccggtaccaggggcgatgggaacatcatctcgacagtcatctgttgttctcaagaactgttagtaccaactaaaaagcacatgaatatatatcaccaaaaggtaagtactgctgattttgcctgcactctatttccccataagatatactactagtctatacataccagttgtataaccccattataaccatcactggtaggccacgtgtagatcctgttggttactgccccggaaataacttcaggaaagaaagttcggtagttgtactgcagtaaaaatttaacattgagatcaaattgcaacttgaaatattatctaaaaagaattgatacgggcattcatattcacatctttttagcaaggcactattaaaatctatataccacttacaggatccatgaggaaatccacaacgcttttgtagtccatcatcaccatagaaactgcacgagtagcctctgtcttgaatccaatggcgtttgcactgttatccccaggatatgcttggtcataagccatcttgttcaatacttcataagaacagccagggacgggaaaccatagagcgacatgggattcggccaaaataatcaatgcgtgcattgcgtttttggctagttcagcaatcatttgttggtcatgttgccctgaaaatacatagtctgctgatgaattaagttgaaaggcaaggtttgcagccgggggtgttccattcgaccgtgcaatctgacaaacaaacaacacagcattagttcaattctagatacagtctctataggactctggagcttgggaaataaattccagacaaactatttaggaggtaaccacaatctatagttagatagggtgcagattggtaatcacaaggtagatcagattgtgcaaataaatgaatcatattgagaacatagtttaacatgtatggttgcagctcgaacaaatccattcaagatactgaattgaaaattcaacatgccaagtaattgtaatttaataggagaacatatcagaagatgatgtacctcttgttgcagccactcactctgccccattaacctttccatctcaacggcaagctggttctgtactgatgaattacagcaagtgaggcatacagcagtgcagtgagctatcttaactctcctgttctcatccctcagaatttcattctccaccgacaacttatagttctcttccttccagcacatagtctacattgtgtcatggaatttttttttaatcattccactaaacttttttgttcatcagtacatagcaatgttttagaacaaacctttacttgtgttcttttattctgaaaccaaaacttcacttgatctaaaccaagacctgttgtctcactcagatgcctcttttgtccatcatcgggatgcccacagatgctgaaaaacctgttcatccaagaaaaatgaagataacccacatgatgaaattctcctcagaaaggagtaccatactgcaacatacacaatatatttaaccaggatagaatcctttctttttataaagctaatacccactaaacatttttataaagctaattctcactaaacacctaaaactcaacatgcaagcattgtatttattagcactcttaaaacctacatgtcagcatgcaacatcaatccattaagcatacaaagctcaacatataagcatacagtaattatatctataatttatttcattctaaaactaaacatacatatgctaaatcatcattcttaaattattttcgtaatatttcaatctaaatcatttcatcatttctccaatatctaacatctcgcatcaaagcgcgggtcatcatctagttataacatataagagatggatatatctagaaatatttgttgatgtaataataataataataataataataataataataataataataataataataataataacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaacaattataattgctagctttcaataaatgatgatatgtgcttcaagaaacatacccctcaagtacctccgactgtttgccagtgagcctctgtagacgcctcttccttttttcattagtgttgctactgttcacaggcaacaagcctgagtcggcctcaattgctgcaaataattctcttgctggaatactcattctctgctccccatcattctgattaaaagaaacaagatactctcagtgctagattcacaattcattctacaaattatagtcagtcagagagctaaaacataatactccggcacattgaactgaaaaaaaaaaacaaataatttaaaagccatcagaaactgataatgtacaaggcatctataacatgccaaaaataacattcacctttgttcgttggttatacactgccttttctaatccttcctctctgacttagtacataagtttaggtacagtaaaaaaggaaaaccaatgactagtatatttaataaaggcatctggattgaaattgtatacgtactattaaggcccctttgttttggcccatatctaaacaaacaaatatcctttttataggcacacattattaagtcaaatgctaaatttaagtagattttttagttacgtaagttagagttaggatattatatttaaacttaagacttaaaagccaccgattaacaaaagtgtacactgctgggcaaagccccggcagtatttccggtcaaaaaaaaatgtacaagtcaaaaagtcaacttaaaatcctaaaccgaacagaaactatagatctcactaattaccttttaccaaccacttaccttgtttatgatctcatttatgatatacctcacgagactttaatattttttcgccgggccggcgaatagccggccaatgtatattaagagtaagaaagggaatgtacaaggtagcgcggtgcgtcaatgcaccaccattacagacataaaaagaaagctaaaatctcacagaatgagttgctacagagtgacacatggggctaacaagacctgcagctatccaagtctcccattcatcccccatggcggaacagagctggggaatcgttgccgcgatcccttcggactttaatattaatagaacccttctagaaaagatggctttagtgatcctaaacatcaaaataagcaggccagggtaattaaacaactaaaacaacttgtctaaggattattttttagacagtccagaggtatcgaaactttacgggtaaaaaagaagaaaggcaggattgacaacaggatgtacagaaaagaaaagaagaaattatagctgtacaagtgtctatggattattatggtctggagttagttttaaacctttactactcttttgtcttttagagcttgtttggaatgtataaattaagaaaaagaagggaacatgacaaaaaagtaggaatcgccttacctacatgagaaagaatcgaaggattgtgttaaaaatagcatttcattatactggtccacagtaaacacaggggacatatgttaaacattgcatgtatgtggcatacatgtcatacaccaaatgccctcacagaagatttcaacaaaggatttgttttttttttcccacaaggatcatgaaaaggtaccgctcaatgtggttttcaaaggaattttgtgcatgtgtccccttttcttttcaatcataacatgtaaaaaaaacataaaaacacatgcatatgctattttgagatctctactattgttaaaacgaaatcctactccaccatcgtacttccacacctaaagaaattatacccaaaaaaaccaccctacccaaaaccagtacttttcaccaacaaaataaaacacttatactgaaccccataaaaccgtttgtttgtgttcccgcagatcccgttgcaatagacaggcatagccgtagttagtgaaacacagtaaaaatgagaaacgagagttagaaaggagcatctaatcctttcaaaaaaaaatatagagagagagaacatataaacagaaatcttgccaaactatttcaagagcataccaaatataacactagaaatcaaagaaccatgcatgccagcaaatcttcaagattcagctcggtatatgcaaagataatggaccaaggaaacatgacgctcaccaaaaaaaaacttatttacagaacagaagtatgcccttatgtgctcacattttgtgaaaaatcattcttctatcccaattctttcggaacacaagcacaaaattctcaagagaagaactatgaaattttgggagaaaataccggtagtgttgccgtcccgtcaccagcaaaaccgttcatcaaggccacgaaagattcgttgccctcattatgctgttgattcatttccatctctggagattcaaccctaaaggttgcaagtgactcccagtgtgtcgttcacccagtattctgtatttcgattctgttgtatttccccgtgtatttgcctttgccctcccctctatttatatagcatttgccagaaggaaaaaatatatttattatatattggtgtttatctgtggtcctcatctgtgtatgtgcacgattttttttaattaagttggcttcaataaaacagtaacgttcgcttaagccgagcaaaaatgataattcattgctccttaacaaagtgacgatgttggtaatctcttcgcggtaaaatatatacaaattagtgggatttgtgggcttgtggctccttaaaagcatgcatcatgccaatgcatgcaacaaatgtgtacttagtgaggatataaaagtaattgtggctagctaagtgattacagtttaggaaaactgaggattgcaatcaaattcaaggcagatatgtccatgtataattcgtatcctaatggatatataattttcaacaggcatttagaaatgctctaccatttagcgaagtaactgttgataatgaaaattgtgcaaatttagtttctcatgtacgaaatgattttcagacaccgatgttgaatgaaatataaagccgttttaacaatgcgaccgataaactaggttagtaggaggaaggccatatttggcccagcttcagattataatctaaagcagcttaatttgaatatacgaactccgccaaatatggccataaaaaccaagacgtcatattagttggattgtgatgggccattatgcgcgcttatattcgagtcaatagttagcagaattacaggttggcctggctagatcgctgcttggaatgtcagatatccgtattagatatgtaattttgcatctattattttataaatgaacggttattctttgatggatgtagtatcgttgacatctccctctttctcgctgtgttctctttgaatagttagtatctctatcccataaactcagatgacagttatattttgttgacagaagaataatgcttgcagtttctttcaaaaacaactaggtagttgatcaataattataaattatgtactcatttcccttcgttcatcttgattatgaaagaatgcaggaaaagaaagatctatatattcctttccattcgttcatctcgattaaaaaaaatggtttcaaatcagtagtaaaagcatgtgtagattgctgcaacgatgccaataacagcgagatatagaaaattagttagtcttaagcggctaatggctatgtgagaaagttaattagatgacagaaaatcaggagggttagttagaatattagtgattcttaagttattttctatccctaaaatgccctttggagcatcaacggtggatattaagtatcttaggaagtacatgaggtaccttccaagcaccgtaaaaggcctctttttttttttgggccgatcaaaatgatggacccaaaatattacaagatttccacgaattgcgggagcatagaaaagtcgagaaaaatgccgacaatctatgtattgattcattcttgtattggaccataatatgttacccatatctggcccaatgcttctctttttcgacatgtgaatcgatacatttagaaaataggtggttggatatttttcgaaaatagacatgaaaaacaaccatctttttcttcattttttcatagtatatatgccctcctaaagaattgttgctcctaaaagaaacctgtttagtttctcttttttaccacaacaacaatgaattgattaattatcaatcgattatatcacattgaataggaacacttattacattattatagcacatattagcaacaaacttaatcaaaccaacaatgagtacatctttctctgtaagcaaagcatccgtgtgactgtgttagtgtgttatgcttgatccacatcaacacggtcatttcaacaaaacgtatcaaacgagtgcatagaacagcgtcccaatggccagcccggccgcgccggcaatgcccgccgccctggggcgcgccgcggcgttgatcgactgctccggcgtgggcgagatctcgatgcccgacggaggaggcggcggcgacggtggcgagttcgggctggtggtgccggccgacggggccagcgccggcgccggcgccgtgccattggcggcgcgctcccccatgaccacgacgatgagcttctcgttgcggttgcagttgtccttgttgccgctgatgaagtagtacgggccggaccgggtgaaggtgaacaccgtgttgccgtcggcgaacgtgtcgatcggcgtgttcgtgttgcaggcgtcgtacgagctcttgtcgacgagcagcaccgagtcgttgccgggttggtaagagaacgctgcatgcaattagaggtttgatcagaatcagtaattccctaatcaaattttttgagagctgacgtcacgtggaagtttaactttctaccccttgggagtaaaccaaacggtgacagtgtcattagccggtgacaaaagatcgttagcacttaaacacagttcgatacaacctaagggaaaggaaccgtcattctatctcgcatctgtcgtgttgcgtctcaacgggcagagagtggaagttttgccggtggaagcttcgcggagatagagagatagagagatcaagcttagagatagaaacgacgtaagctatctagccatagcgtcaaaagtatgcatcaacagatgggattggagatatgcatctgtggttctccatggtcaaggtggggagaaggagagccagtacaaaattgcgcacaattgtcaggtgtgactcataaatgaagtggccctgtgccccctgtgtcatcctggcagcccaacgtcgcttgcaaattgataaatgatttcgatgctacggacgcgcatgatgtgtgtgcttcggctccatgcaactaatgcaaacatatctgataacgctccacgatttagcaattttagcggacacccaacactacaacgtctatcaccctttaatgcagtacaataaatatacatctgatcgaacggctgggaaagagcagtcaaagggagtcggtggagagcgagcgttgattacctatggcgtcacccacgcgaaaccgggtgtgctcggcccactggttgtaggcgctgacgttgccgctggcctgctgatccgggacgcgccactcgcccgtcccgcccgccttgaacacgaacgcggacgcggtggtggagaccgaggccaccacgcacgccaccaccacccagcattgcatccgctgcacgcgcccgtgtgccatcgcgcgcgctctgctacgacctctggttgggttttttttgggggggacgctggtgtagtagtgaattgctggaggcaatgcggtttcggttacgatcgattgaacgagacggtgaaatatatatacgtgcacaaagcaggttggttgtatcggcgttcagatgtgttacggttctttacgtaaaagcgaggggacgtgatcgcggggaactggaatatttgcgcgctttatgttctcgacgtgccatgctctgcatgatgtgactttagtgtttgtgtgttatttatttgttgtttaggagttttttcgtttgctggcacgggagcttacgggaacgggaagctatgctttgcttcctatgtgttgtggaatatccatgccttgagagctggttcagagcaagtggccgggcctcgatcctacggagaaaaatgaacaggttcactttaggtgtctcaatttgattttcatctacagtccgcaaaaccaaatacatcacatcccttaacttataaaaccagtccaaacgaggtgccttagcactattgtccctatttttggctaacatggctcctttgactaggtcttcgtcccacctgacattgacgtggcaatttcatccgggaaacaataaaaggagctgacgtggtagctgagtcaagtgtggtacccatatatcagggcaatttagtctaaataaaaatattaaattggtgggccactgttaacggaaaaatttggtaagccccgaaatcatcatcggtctaaagtcagtattggcttcaaagtactagaatcagccgatgagcattatagttggatttcttgatgggttcgattaagaaaattaatcaattaaagaagcttatctagaagatatcgagttcaataaggatgtgacatgtcaatatatctattaattaggtagagttagttagttccctttagttgttatgaaagtgtgtttagtgtcctttcttcgcccgcaggcctgttgacgaaaaatccgtgctcggccgatggtgccgggtctgtgttggcacaaactaagttgacgaacacaatggtctgggagatccacttaactccagtgcagatctaaaagttgatgagatgcggacgtgccagttagtttgatcctacaactgacaagatatagaaataacatatcaaagagccaatcggcttacaagccgatggagtaattctagccgatgtcgatagggttttgagcaatcagctatatgtccaatgtagatgatgatacaaagacaatcggctgatgatgatgatgtaataaaataataatataatccattaaaccaatcggctaataataacatgatagaataaatactgatcagaaagttaaagcatatatcggctggaggtccgatgtcattaaatccacaagattagataaacaatgaaatctttgttgcgatcggctaaatccaacttgtatgtaatccttataagccgatgcaacgtccagataactcatcggctaaaatcccgatgtaacccttattggcaaacaagaggcagaatagagattacggttctaaacatgacttagtaggtcgaatgtactgatgcagcactaagtatgaaaagaaacacaatatctagacaatcaagcctttgaatgatttttagggtagtagatgtctaagctaatctaatctagcaagacgatttagccgataccgacagataccgtaaagcgagaagcagccgatagaggtagatcgatatgctaagactaaattaacatagatatatgataaattggtaggcaaatatatcaaccgaaccaaagcaatccaagaggtcgaaacgatgcagccttgaacgatgtcgacgtagccaatacaattgccagggccggcagaacgtagggctgaccccttcgctggagatcgaaagccgatgcagcctcgcgtcaagtgccaagttccgccgaatgataagtaaaaacctcggtaaagagagtggtgatgcgccgacagtagttgtattgatctatgagatcgtttacaatgaccccgggtgtacatattatacccatgggtagatactagtccttgttgggaaaaaaaactttcctaaagataaaaggaaaacataaagtcattattggacactaaacacacttttctaaaattaaaaggaaaaccaacagactatttctaattaaaagataaactgtcatgccgcatccaccttgaactcggtcacttctggataaactttcattagtagattaatttcttaagaatccgactattggcgatttgataatttccatcgaccgattccaagactctaggccgagatgacttcggggctaaccaaatttcactgttaataagcccccccgcctagcgctcgtctatccatcgcggcccttcaccccatcagctatcgggcgccgctcgcccgctctgctccgtcggcctactctggccgccgccactccgcgctccatgccctccgccacccacatgccaaaatagggaagggagagaggagtggagcggtcgtcgccgctccgccagccacccacctcgctccgcccactcccgccttcttgtagggaagagagaggatagaggaggggagtagtgaggatgacatatgggggccatgtcacatgggcccacccttttttattagttttgtgtgtacctaacatgtgggccccacatgttttattatttttcggatctaattgccacgtaggacgaagacctagtcaaaggatccatgtaagtgccatgtcagccataccggggttaatactgcgcagggtactcgtttgcatggttttgtaagtggcggatccttgcatctggttttccggactgaggatgaaaatcagacttgcgacttgagggacctagagtgaacttattcagagaagacttgtgcttcatgggccattcctttgggttggttgcttcatggcttgtgcgagactagactagattgtttacatccggaattcctttacagcttaattaggactgctactatcaggcttatacttgggcttcaactggaacgtacaggaccgaactatattatgcaggccttattaagcccagaattgcatcgcaaagtttggtgttaggttggggaatcccctctagcttaatccagccattagtacgagtacgaacaccacaagtcttaaggccccgttcgattcagatttatcaccggtatataaaacaaacaagtcgcacatgactaggtggtaggtggtgtttgtatcttctgaagaagatgaagattaaataatttacgtaaaataaggtggtaataacgtgtgataaattaaattttaattattgcaaacttgaaaaatgaattaatctgatattttagaacaactttcatatagaaagttttcgcacgaaacacaccgtttaacagtttaaaaagcgtgccacgaatatccaaaacttaatccagtttttaagtggaaacgaacggagccacatatatacaaaattttcaaataaaatataccgtttaacgtcggaaagtatgctaactaaaaacaaagggatatctcagttcagaagcggaaaaaaatttcaacctaaagtggaagtggagaaccaaagattgcagatgtgggtgttcttctctcctttggggcttctttcccccaaaggacgtcggcaggcactgatccaaatagcaacaagacaaagttagattcttgatggcttgatgtcggtggtcttcgaattccacagccttcgatcgccacaaattcaagtcagtttgagcgtggcatattggccctccggcgttgagtctttggtgttagcaagtctgcatgaggaattggttgttgttgagctagggtgccagctctaggttgatttggttttcggctaggtaagtttgcaggtggcaaacgccatttgttctctttggggaggttgtctctgtgttgtattatcttctctgtattcctcgtgtattctctactactatcctccaggacacctgcgattgcgtagatgaagcctgccctgtgtaaaatctcttgatgcaatatattctggtggagaaactcttctctctggtgacttgctaaaaaaaagattgcagatgctgtagtccaagcaatgagttggatgttttttagcttgagcagctagtattaccgtggtactagggtttatatttttgcgctccttaccgatttatggaaaccattaaaaattgacaactttggattaacactatacgaaaactaactaatattgatcggttttttagcggtttcacgaaaattaactaatattgatcggttttttagcggtttcacgaaaattaactaatattgatcggtttttagcggtttcacgaaaaccaatcaattttgtgaagcttgtccgctaatttttcagtcgattagcagacttacaaaagtatgcatagtgcatctttcgaagtatatgactcatctgaacaacttgcaaggatcctagttgaaactttgaaagtctgcactatgcggtatgcatatcactgaagtggaacgatacactacatcctactcaccactccacaaacatgcccatcgatgtggtaggctgtaggaagatcagaacaaatcagatccaatctcgtttgtcagattggctagctgtacagtactaacatcctcctaaaataacctcgctatgaaggtatgtggcgccaatgagactgtcacttttatccccactcccactccggcacttcaccagttcaccaccgtggcactccctgggactgaagtggaacgaactagtccaagactcggagtcgtctcctccctccgtcagcgcttccatcttccactccacatcacgatcgcgggcgccggtatgcttcttccattccacctatgtgtttcttccttgctaacaaatcaaccaatttgtccattccctatgtcatctcctatagaaactctagccaattcgttcgtttcttcttaagttccacagaatcccacctgatgctcgcccaacagttgcatcttgtctgctgatcagatcgaggttcagaaattagtccccattcctctcccataggcactcgaatccatcaattcgttcccaaatccagtgcttcccctttgtatgccactaaaaaccggagctttcttggtaaagatcgaggtttttggttgccggagatggagttcgtggcgtccatcgtggacgcggtgttccggccgctcaaggactacttcgcccggacgttcgggtatgtcatgtcctgcggcgactacatcgacctgctgggccacgagatggacgagctcaagagcaagcgcgacgacgtgaagcgcctggtcgacgtcgccgagcgccggggcatggaggccaccagccaggtcaagtggtggctcgagtgtgtctccaggctcgaggacgccgccgcccggatcgaggaggagtaccaggcgcgcctccgccttccccccgagcaggcgcccggcctcagggccacctaccacctcagccagagggccgacgagatgttcgccgaggccgccaacctcaaggagaagggcgcgttccacaaggtcgccgacgagcttgtgcaggtccgcttcgaggagatgcccagcgcggccgtcgtcggcatggacgctgtgcttcagaggctccacgcgtgcgtccggcacggcgacgtgggcatcgtcggcatctacggcatggccggggtcggcaagaccgcgctgctgaacaagtacaacaacgatttcctcatcaactcgccggacatcaatgtcgccatcaacatcgaagtcggcaaggagttcagtctggatgatatccagaaaatcatcggcgaccgcctcggcgtgtcgtgggagaacagaacgcccagggagcgtgccggaatgctctacagagtgctcaccaagatgaacttcgtgctgctgctggacgacctctgggagccactcaacttccagatgatcggaattcccgtacctaagcacaactccaagagcaagatcgtgttgacgacgaggattgaggacgtgtgtgaccgcatggatgtccgccgcaagctcaagatggagtgcctgccatgggagcccgcttgggagctcttccgcgagaaggtcggggagcatctcatgttttccagcattgagattcaggaacaggcgaaggcgctggcgatgaagtgtggcggcctgccgctcgcgctcatcaccgtcggccgggcgatggccagcaagcgcacagaaaaagagtggaagcatgccatcaccgtgctaaaggttgccccatggcagcttcttggcatggagatggatgttctaatgcctctcaagaacagctacgatagtttgcccagtgacaagctaaggctttgtctactgtattgctcactgttcccagaggaattctccatttctaaggaatggataatagggtactgcatcggtgaaggtttcattgatgacctgtacactgacatggatgagatttataacaaagggcatgaccttcttggtgttctcaagattgcctgtttgctggagaaaggggatgacgaggatcatatcagtatgcatcccatggtccgtgccatggctctgtggatagcatcagattttggcacaaaagaaacaaaatggcttgtccgtgccggagttgggctcaaggaggcaccaggtgcagagaaatggagcgacgctgagcggatttctttcatgcgaaacaacattcttgagctgtatgagagacctaattgccctctgctgaaaactttgatgctacaggtcaaccctgcattggataagatatgtgacggcttcttccaattcatgccatctctcagggttttagatttatcacatacttctatccatgaattaccttccgggatcagttcattagttgagttgcagtaccttgatttgtataacacaaacatcaaatcacttccaagggagcttggagcactggtaaccctgcggttcctgctgctttcgcatatgccactggatttgataccaggtggtgtaataagcagcctgacaatgctgcaagtattgtacatggatctcagttatggagactggaaggttgatgcaaccggaaatggagttgaatttctggagcttgaaagcctacgcaggctcaagatactcgatatcacaatacagtctctcgaggctctggagagactgtccttgtcgaatcgcctcgctagctcgacaagaaatctactcataaagacatgtgctagccttacaaaggtagagcttccttcaagcagactttggaagaacatgaccggactcaagagagtgtggatcgcgagctgcaacaacttagcggaggtaatcatcgatggcaacacagaaactgaccacatgtatagacaacctgatgttatctcgcaaagccggggagatcattattccaatgacgagcagcccatccttccaaacctgcaaaatatcatccttcaggcacttcataaggtaaagatcatctacaaatccggatgtgtccagaacataacatcgttgtacatctggtattgccatgggctggaggagctgattactctcagcgatgatgaacaaggaacagcggcaaacagcagtgaacaagctgcaagaatttgcagagacatcacacccttccctaacctcaaagaactgtatctccatggcttggcaaactgcagggcattgtgcagcactacgtgcttcctgcggttccccttgctggggaacctgaagattgtcgactgcccgaagctgaagaagctcgagctccctgtcggtaatctgaatgcggtacaatgcacaagggagtggtgggatgcgttggagtgggatgatgccgaagtcaaagcatcttacgatccactgttccgtccactgcactgattccagttttagttaccacttaaccatttttttgtcatctgctactgttgcttctctgatcgttgtgtagttcaggtctgtgtttcctcacttgtatgatcttacaagttgagtggttttactacctttttgcacagaccatgttccacacacgtcaggtacggcagtaggaaaacttagtatcattagtactggatgtatagatgtgagtatgtaacctgtgaatacagagcagcaccaaaaggacctaaacagcatgtaaattttcttctttttggactataaattgatgattcttcattcacaaacgatcagatcaaaacagaatgattgtgtaagactaagatctgagtctgactgacattatgcctgcgttgtctttcagggactctccgcatcagttgcagagataaggtttgacgttttcaaagcagattcggccacgtaaaaaaagaaaaaaaaaagcaagttattgggcttactttcgtcttagctacataggtaggctttagcttagtacaggagcatggcccggcccagcaatttgcgctagtgtattgtcctttatggtatggaccatggaatataacacgtgaatacggcgtggcagaacgaactttgagatgcacctccgatcagattgatctgatctgcgccattagcatgctttattgcttttatttcctgatgatgacgatgattagtactccgtattggaaccaacagggtgcatgcgaacatggcaactcgtacaagatggcagatcaataatctctacccttctaatcagagcccctcgttgtagttgacgccggtggccttgagccagtttccgccctggatgaactgccccacggtgaactgcatggcgacgctctggtccgtgatgacgtggtacccgggccagttgacgcggccggccgtgctggcgccggggccctggttctggtactcgccgtagaagagcgtcttgagcgcgaagtcggcgccgttccactcgagccaacccctcgggtcgacgtgcgagtccaggtaggacagcatgtacaccgtccgcgagtactccttccacggccggcccaggaacgtcgggaactgcttcgcggcgggcgccaggtcgggcgccgggacgacgcggcaccggtggatggacgtcccggtgttctggttcgggtcggtccggccctgcgccgtgaccgcgttcttctgcgcctgcgcggggcgccgcgccgtgagcacgcagccctggagcaccgccgcggcgttgccgaacacgaagtccaccgtgccggagacggcgcagtcgcggtagaactggcggagctggtgcgcgtacagggtgtcctggtagccgtccaggcggcagcggttgatcacggcgcggtcggcgctcacgcggagggccaccgcctgctgcttctcggcgcccgccgtgttctccaccttgaggtcctggaggatgatcccgtcgcccgacaaggctgcacgcacgcatatgttacgcatatatccaaggtcaaacttagtcatgactgcttgcagtcagtcaatgcatcaatgcaagacaggaaaatccacgcaaattgttcatgtacaagctattgggcatgttgttaactcaagtgtgccatcgtggtctcgtggcggcgtgtcgtacgttttgggccgtctactttgacccttgggcagggctagtggattggaaacagggcattttaatactgttcgtcaagccgtgttcgtcgttaattggtttgtgcgagaagctgggctgtttcaggctccggttttgcactcgccgcggtattccatcgcccttgtgtgccgcctgctaattaaagtattcccagtttgcaataagtgcttttggttagctatatgtcaacctttgattcagagaatgtgcctccaagcgatggttcttctacacttctactgttctacacagtacatactgctacaattaggatgagtcggccagtttgatggcaaaaatcgagtaggaggctaaaacttgggtcctggtggaagaaaaaaagactcggagattggcttacagtatagttagctagggcctaaggccccttactcatacagtttatcccttctttattcagctagaaagaaaacccgcgcagatgcgcgggaaatttatttattgtttgtaagaaaatagattgtaatagtaaagaaacaaatatttatatcctagttatatgtgaactcgcatatcatccttcttcgcaaatatatatatatatatatatatatatatatatatatatatatatatatatatataatatatatatatatatatatgagttaatatgtgtttgtttttttctttcattatacatccgattcaccgatgcatattcatgggtaacaaacaatagaataatctatattgtcaaaattatttgtgctaattatcaacactatttaggtgagaatgttataattaaaagggatataatgtggttccatgtgatattttttatcgtaagtatatatgttttttctagcgaatagtagtttcccctgtacgaatgtacttttctccttttataaggtaggtgtgtaattgtatttataagttgtatgtgcctgcatttatatgagtgctcacaatacccttttataccattagtaaaataaatactttgaagagatttggtgggatggtgtgaagcagcaatgtggtggcgtggctttttcggcaaccccaccagaagtggtcactacatatatacataatttgagaaaaaccttagagctgcaaagaaagaaagagaaaactacttagggagggattagccggtatttagtagcgagggattacttgatagatatattctaatggttgacaataatgaatccactggtctaagtgtaaatcaatggctaaatgattttttctttttcttataattttcttacattttctctattttattagagtgtcttgtggcatcttaattagaagtatatgcaggtgtgtaggaacactattaataatagtcatattctacttgtagtcaactatttttcgtggtggcttggtgtatctctacttacatatcatttattgatggttaccacttagtacttcctttatctttggtacttgataacatatgtacatgcttattggatatcaactaattattagttgcataatgcatgtatgcctcataactattatgacttggcgattggtggatagtaatttctatatagaacttatatacatgggattagtggaaacatacgattgatatatatttggctattcctattgataaattatattatatactacatattaagtgtttaagtaagtaaggttgacttttaaagtgcttatctgattggctactttattatttatgacgagcatgttcccaaactacaaaagtttcccgaactaaacaatgcgtgttttgtaaatactttctatacaaaaatattttaggaaatcaaataaacccatttttaagtttgtaatatttaatacttaattaatccttttttgatgacatgtatcattttgtgtgccttgataaactcagccagatcgattgaaggcctaggtaggagataaaggacatcgacacggtatcaaaagaatatacttcgtcgttaattttctagcaatatatgaagaagaaaacatgatacatgaaaatattcaagataaatttagtaatgtcattttgtcatatgaatatttttatagtaggtattgagtaaattttgaaaatgctactcacagtcgaagttgttttatttttgaaaataaaaatctaatataattatacatgttgttatgtgatatatctataactttaatttatttatatttttcctggatgtttccatgagatatattttttatttgaacaaattatagttaagatgtgctgattattaaattggtttttcaacaaagtgagaaataaaaaaaaggaaagagaagtacgtacaattttttttggtcgggtgtgggtttgaggatacatatgtacaactcacgtacagatatggaacgatgtagatctttcgagatataaatttgattgataattttgacgatagatctaatagttaaaaataatggtcccaccaaattaaatgaaaattaatggctagatgctttattttttcttagattttctatgatttattaaagtgccacgtgacgatcttggagcgtttgtaggagtgctacgtggcggtttgagagcgtttgtaggaagtttaatggatttttagtatataatatatgaaaatcgtttcgttcgaaaaaaaaaaacaattaggacgagtgaaggcgataccgaagaatgtcattgctttatcgcctgtggtgcagtttcagcactgttatgtactcctagtaactgtgttgcaagaaaattatgtaccaatggatgccttgacagctttctgtcctgctgctatggttactgaattaagggcttttttttacttagataccatttttaactttaccaagttttaataaagttgtcaaaaaaaaaattagatacattagtttgctgtcaaattttggtaactatataagaaattctgccaaaattttgtcatgtcaccaaaattttgacaactatgccaaaattttggcattgccataatttggtatgtttttttttcatcaaagtgatcggtccctaaaatccacgcattaaaagctgaaacgtggggaaactctctttgccatggaaaaatcaggtgggaacacgactctcccctccgatgatttaaaaaaaaattgaaatgtgggtgaaaccaccatctagaaggtttgaaaataattaataataaattagaaaagtatataatctaagaaatttaaattatgatgcccaccctctaaaggattcaaattacgatgcctaagatctaaaattactaaaaaaatcagaaaataattactacgagtaaaccatgatactccctccgggctgataatacttgtcgttttaggcaagggtgaggtcaaactttagagtctttgattatgaatcatttttaaaatatttgtcttttaaatatggtgactacatatatatagattagtcttaaaaagtactttaataaaatcatatatttgttaacacttttatacatattataatagaaaataatagttaaagttgttttttggagaccgtgcccttatccaaaacgacaagtattatcaacccagagggagtataaaaaaaactcaaatcccgatactcctaaatgttaagtatacgtaggtgcgttttcaatgaggctaggaatgtatctatagtccaacaacagagcatgtgtttgttaaataaggctgtgtttagatctaaagtttggatccaaacttcagtccttttccatcatatcaacctgttatacatacacaacttttcagtcacatcatctctaatttcaactaaaatccaaactttgcgctgaactaaacacacagcctaaaaaaatagagcaggtatttgtggatgtgtaagtgcggtgtatttatgtagcagtggagcatggcatggagcacgtagcacggacatgtgcaaaattaagtacgtccactgtgtgatgtgatgctaccaccatttaagccaaacaaccattgccgaagattttaagtgctttgcttttggggataactactctatgtttccacctgtgtgtattctagccaatggcacatcgatctgcacatgcgcaccatgtcaccaacaaccactggtaatcatttttctatctgcttatactatattagtcaacgaattagattatgagatccacttgttgattcttttccggttatttcgaagttgacactaactgtttactgacccaatcctacgtacgtgagcttagcggggcttatattatggagtatatcagtgcactacagtactgtgcctcgtacacagtactgtgtagactggtataccgattaccaagctaagtttagatgactagtgtatatcaagcaagaaatgcgtagctatccatgcatgtcagtaggacgttacgaagaaggcaatctgaaagaatacccatggtttagtttgaagaagagaaaagaatattcatgcgcgccaacgttcaggaattatcatgttgtgatttcccttttgaaaaggttgtattatgcaaagtaaagatgcggtttgcgaaatagtcgtagtgtcgtagatggaatgagtgcgaatttcagaaagtagagagagacaaagacgcagacggcgatcgagagcatcacctagcgtggcggagttgaaagttgtggagccgtcgaccacgttgcggctgccggtgatgaccgtctggtccatgccgtcgccgacgatcatcagcacccgcttcgtcttccccacctcgaggttctccttgtacacccccttcttcacgtagatcacgtaccggctcttgccgccgtcgggggccgcgtccaccgcctcctttatcgtcgtgtacttgccgctcccgtctttggccaccaccacgtccgcctgcacggcgcccgcgcccgcgtcgaggagcgtgcggtctctcgccgtcagccacgacgggaacctgtccacggcctccgcgagcacgtcccgagcgccgcggccggcggcgctgagcacggcgagcgacgcgctcgcgagggacttgagcggctccaggtgcgcccccacggagtcgcgcagcggcccgtcgtcgaggccgtccaggcacgtcacgtggtcggtgagcacggcgctgagccacgtcctcgcgtcgtcgacgtcgacgtcgacgtcgggcgcgcccgccgcgtcggcgagacggtcgcgcgcgagccccatcagctggacgcagtcctccagggccgcgcggtgcctcgggtcgctggcgcgccggcgcatgcccgccaccgcttccgcggccgcgtcatgccgatcgagagacgtggcaaggatggcgcggaggacgtgcgccgggcggctcgggtgggagtgcggggacgctaggacggcgtcggcgacgatggcttggcacgaggccgggtcaggggagctcgcgcagaggttcgtggccgtcggggagagtaggaggaaggcggcgcccgcgcagaggcagagcacggtggctaaagagagcagcgtgaacgatagaagtttgcatgggtaggcgtttctgtgcgagggagaagagaggagaggctcgtctctctgacgcatggtgtcctatccctgtgcgacaagtgaacctgtttacaactactgctgcaacctgtgatgtagcggctcatgatgagacttaattaggtcatatttatactgctggggacagcggttggttttgggttataccttatcgcgaacatagttaattagcgctagtacttagcaccggtgcatgcattaattgttctcaactggagtaggagtagttttctctggcgtcgcctgattctgaatagagactggagagtagtagtccggttcgatttttcgttcagctcactgaatgtatcgacctgtcggtagatggtacccgttctgtttttcgttcagccacgtgcagttcactgtgctgtcccctcggtggatgatacccatatgccatacgttccagcacgtggtgttttactgccagaccattgtactatgaacgaaccagaccattgtactatgagctagtatcttgattagtgctggtgttgatgtatggttttgattcagttgctatatactccatggccgtatgagataataggcatgtgttcttcccccatacgattggcatcgacgatcctcacgagttaatctcgcactttgcaagtatcttgttgtggagcttggacatggacagtttgatgtggatcgatttgaaggttttatgcttttttttagctagggcttgacggtccccatttccattactagaaattagaaatgatactcccttcagacgatcaaatgtaagtttactgtcttaaaactagaataactctcacggtcaaggatcctctcacgtcgcccctccaggggcggctcgggaggcgacgacccggccgcccctctcccccacctcccttctccgcctcaccgtcgcctaagcggctgccggcaaagccgcgcggccgcaacgacggcgacggcggggctctcctcgtcttcttgtgctcgggcggtctagggagctgcccagagcggcaacggcggtgaccgccagatccgcgccgttccggccggatctggtggagtggttggcggcggggacgggcgatggtggtggtcgaggtgagttgcgggtggagttgtgggtgatggcggcggggatggcgacagcaatagggcagcggttgtggaggccgcggatccaacggtggccggcggtgggcagcgcatgcaggcatcctgcggctgccactagcgttctccggcgctcctcttggtgtcggccagcgttggtggtgaggagggcggccggatctggctcctcttgcccagatccgctgcgtcctcgggtggggacggggtggattggagtgaatattggggtggatctcgtctgtgcaggtggtgtgaatattgcaggtactctcggtgtgcaggtaacatttggtggctcccgccttggatgctatggttgatgggtgctccaaggcaaaagccttgctccgctctcggtgctagcaacggtaacccctttgggcgccgttcaccttctcgaaggtgttgctactggagccctcattcaactcaacttcaagagatttctccgggtgaaaacctagattcattaggatcagacgatgtcgttccgtcagcgtaaccttcttgaaagcttcgttctaggagtttttctcctgttggacggctgtacttaggttcaatttgtcaatgtcggggttttcgccggttttcttttaattaaccgtgctgttataagatttttaagtctgattttcttcttctatagtgaattgcaggagcaccctgcctgtcccctcgagaaaaaaagaaattagaaatgattaggaagataaagaattcgaaccaaaccaaaaacacgagctgtcatcacagcaaagagcctagaagctgtccatcgagggtagagaaaaaacagaaagctgctctaggcctcccaactatactagcgagtagcgacgcagcacaaaaacacagtttggagctccagctgacagtctctcatctactctaggtgccttgtgcagaccctccatccaaacctggaccgaagacctcatttgctacttgtcttgtaagtttggtccccagcagcagtcttcttcgccttttctccagcttctgcaaattagcctaattttcagtcaaatgacaggtaagaaaaaatagttcaataggatcataaggcatctttttccaaaacatgctttgttcctggctttccagtcttccagagtttatgcagatttataaaggtgctttggtgaaattctggttaggaattagcccgttgtttctccttggcttgcatctgcacggaatcgactaatttttccttgcaagtcgatttgaggggatcacctcgataggatagaggataagcaataatatcacgaatatgggcgtaagatcccatcctatgagattaaggtttctacgaggagttgtgttgtcacttgtcagccgaatgattgttcctcagtttcggagggctaaatgttagacaatcactgcattcgtcccaaaatggtaaccttttttagataggtacaaatattaattaagtaggtaaaaataattagatgaaatttgtgattggttgagaagagaaagtagatgaaaaaattaaataaaaaataatgtgattggttgagaggaggtagtaggtttagaagtaatttcattctaggataaatcattgtgctaaaatagttacatttttagatggaggtagtattacatgtagtccttcatcttaaaataaatcaactattgaagttaaaaccttattctaaaataaaataattcctacaatatcttcttacctacacttagtcctagaataaaaaaaaatatttcttcatcacttcatgctactttcttaccttaccttaccaacccactcatcgatactactttcttgaagtgggtaacagggtaagtgatgtaagtgggcttaaaaattaccacatcagatttatattatggggcggagggagtagcataaaaaatctgtttctttttaggagaaaacctttactgtggaggaaaagttataggtgcatggttatatccgtgagtccaaatctcaaaacggagaaaattccttacgtgtacatgagtttttccttcctctaaattttgtttagttccctaaatgccattgagttctcattttaatcatctccatatccaatatcagttagttaaccatgggttaaacatgtttttttttaaaaaaaaacaacaactatattgcctgtccggccctcaattatacttatgtgctgaattgttgagtaaaataaaattctcaatgtgaaaaaagattcatttgtgatagaattatttcatcacaatttaaaatttaaaattaattttataaataaatttaaattaaaattgatgaaatttttaaaagattttcaccaaaatttaaactcaaataaaaataattttgatttttagtttctcgctgaaacactataactcttgtatggatttgatcgtttttgaatttgtttgaaaatttcaaattttgctttccaaatttggcaggaaataattttattccatttgattttttttttcaaaaagttgatatctatatttttaaagtaggtagcacataactatgagaaaggggcattatagttatttagaaaaatctaatggtccactaacgaaatagataagaagagatcaaaatgaaaactcaaagtacatgtagagtatgaagcaaaatttataggcatgaaaagggttgagccaaaactcacgtgcacataagtaattttctataaggttgtgtttggttgaaggggttggatgggtcgggtggggttggacccaatttatagggttttcgtttttgggatgggtgaaatggaatggacatattccatttagatccagatctaaatcagccaacaaaatcaagcggaccatctcaaccaacatggacggggcacacaacatgagtctcgccgctactcccagtcgtctgcttgccagccggtcgctacccttcagtgtcgtcggttggcaccgctcctccttttttttaaaaggtatacgattttaacctttgtctatttcttttttttaattataaaagcattattttcagtcttgactcatatatttgccatgtgttaaaagacattgtgatagtacacatatttcctgtgtaactgtaaaaaaatggttttcttgtctaaatggatgtaaaccggtagcccatgcatggagatttcaatcgttccacggaattacttaacaatcaggagaaggcacaacacaacacggtcatcgcccaacttattctacgatgctacatgaacgaaggtaaaagtacagaggatgaaagcgaaacggtagagacggcccggagaagcttctcgcaatctcgcatccacatgggcccaaagcatcctagcaccctgttcctttcggcagccacacgcaacctgctgctagccgtagttgagccggaatatgtcattctgcacgaagaagcttccctgctcgttgggcaccagctgaaacatctgggatcaaatcataacataaacacgagatcagaccgtttccaaactgaaagtaaaaacaagagaagggaaatgaagtcgtgtcggtgtcagccaagtgctaacgggttccaagaattgttacctggctgaacctgagctggtgctcctcgccggcgagctggaggttgccactgacgaagacgaggatgcctcccgggaaggacggcgtgggttggcagtcgacggtgcagacggcgtgccggcattgctcgaagggcagccccaacagcttccggccgatctcctcggcgccggccaccatgtgtccctcgaaggagagcatggacgtctggccgtagagcgcggcgagcgcggcgcggttggtgtcgaacgtctggtagtagtactccacgaaggccctggccaccacgtcgcactgatcgctccagccgccgccgccgccgccgctggcgccgttgctgctgccctccttcccatgcccgtccattgcccctgtctccgcgcgccgtctgtgtctagctatccgtggctctcgtgtctcgtgcggcagaacagacagagtacgaaacgctcgccgcgggcgcgccggctatttgtatgcgcgctgacggatgggacgaacgatttgtatatgggagatcgaagaggtgtgttgctatgctttgccgttcttttttctgcatattggcgtaggtcgcacgcccatatcgtgtacgcgagtgcgtggaggtggagccacgagagcgcggacgcggagatggacgaaaagcagagacgattcagctgaacacggaaaaagagaatgagaaaagtgggaggcaggagaaaagcggcaaaggatggatatgaatctctgcatttcggactatgggtgtgtctagttcacgctaaaattgaaagtttagttgaaattggaatgatgtgacgaaaaaattgaaagtttatgtgtgtaggaaagttttaatgtgatggaaaagttgaaagtttaaagaaaaagtttggaactaaactcagcctatattgcctgatcacagtagcggcatatattatttgatgggaagttgcaaagttgcaatgcacatcatctcaaactccaacctttcatctgaaatactgatcctttgcattgctggctgcttcggaagatgcacgcaaagaatccacacgtggacgtggccaatcccaaatatttggctgacaaggcgaaagataattcggaagcgcttgcccactagccgcttggagcgagccttcgaccaccatacaccgaaagccggcggttgctttcggccacggaaaggcgacccgatccggcgccgtcctcgcgtggtcgcacagcggaaaccgcagcgctttcgccgaccacacgaggtgccaatggatcgcaccattctttgccgagtcgccgcagacacagcccgcaggagttttttttgtttttagatttttttttaatatttacagaaataatctatcgacaaaaaaaattgcagaaatagcccctgccgccctaatggtgggcggcaagctgacgtggcagacggtgggtcgaccgcgccgtctgccgccgtcggccaaaattgcgattaggcccttgctg

SEQ ID NO: 28438 - DNA, 1926 bp, Oryza sativa
ggcctaatcacaattttggccgcccataaagagcttgcggccgtactttttcatctgggtcccttgccgccccacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtataatttgaacatgatacgattatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgctctactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcgaaggagtggcctgcgcctggtcctgcgtctgcaccggcggtgcgcctcccagctgtgaggggccaatgacgtcctctgtcgagcctgaagcaaagtcgaagtcagtgatgtcgaagagcacggtggaagacaacaagcggtccgacgaggtcccagcatggtccagtggtggaccctgactcgacgtgccggctgcctgtgacgctgaccctgcagcctgggagaagtgggcggcctgcgtcatagcgaactgggcaaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcatgaaaccctgaagcaatcggcaagtgaaacggctcacttatatgtgtgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtcggcacgacaggtgagcactcggagaaacgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgttccaagggagcgaaggtgaccctagtacgggtgcgtggctggtaccagcgtaggtaggcctggtaagactcctcagtgtgtggctctccctcgtagtccatgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggtagattttaatgcaacaacggaaa

SEQ ID NO: 28439 - DNA, 17407 bp, Oryza sativa
  unsure (1)..(17407): unsure at all n locations
cagatgtcgaagaccatcggaaccatagtcatccagtacgcctggtccctggtgcagagtgtggacagacccaacggcgcacgagcctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgtgtgctggtccacctcagggcggccgatcgcaatcctctcagctgcccagatagaaagaaagagagggcaccaaccaaaggtcgcgctgggatccgtcttcgtgcaagactcacaaagtgcacggtacagagccgccaacaacgcggaaccccagctccactgaggcacctcgcctaccgcgacgtcggcgatgctcctggcgtagtgcacgagtcccttgtcgaccgcgtgcccgtgaccgccacagaacatcacccagccaaaaagctagagcaagtacgcctccaaacatcggctgtaggagtactcgtcggcctccgcctgtagttgctcaacctgcaagcagtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccatggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacgaaggagtcgtgaaccgtgagtagctcaccgcacgtccgtgcccggaacgtcccaagctgagccccctgcaccgcagtaaggtgagactggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattaccaggtagaaaacatgtatgcttggtaacgactgacactgtccaataatccttccatttccccttatacgtgtgcactctccagggacaaccatctttttccttaacacaccgaacttcatattgcgaccggttcgacttggcaaccctaaactctctatgaagtgacactgcaaaatgttttaccgcctccttcatatcttctgctctactataaatcgctccctgaataacctcattttctttgtactcccatctcacactatcctcttcagagacgattagcccagaaaaatcctcactagcccattctgctggattaatatccgtctcatcatctgacgaatcaccttcctctacacgctcgttgtcagaatcctccctctccatttcatccacaatagcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagagggtacactcctctcagccggtctatcaattcccctttctgatacaataaaatctgacagatctaccccagttggcccgtaaccgacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaaattttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcgacaaggggccgcctgcaaaatagctggccccgactggcttttttgcattcgggccccttgccgccccaccagagggcggcaagggttttcctgcaaaaaaccctccctccgttaccgcccgttcctcccccgtttgccacgtcagcttgccgctccagaggtgggcggcagggtctatttttgtaatttttttggccgatagattatttctgtaaatatttttttaaaaaaatctaaaaccgaaaaaaattccagcccgcagcaaggctgaaattacgtcgtgggctagctaccttggaccaggccttggaatcataattcacctgaaaaggtacaccgaaggtccctgaacttgtcagagttaaaaacatcctcaaaccgcaaaaccaaatatccggcgtcctcgcacgccgcctccgcccttcgccacgaactcgcccgccactgctctgctccgccggccgtcgcgcgctcgcctgccgcctccgttggcgattgcttagccccgctcaccgccacttgttgctactcccctgcggcaaagagaagaaaaaaaaagaagagaaaaatgaaaggggaaagacgggatgctccgcgtcgccggccaccggacctcctctcccgccacaccgcatcgatctcctccccacccatcggctggcctgcaagagaagagtgagaaagagagatgaggaagggaaagaagaggggaaagagagagatggcgtggcatcctgacatgtggggtctacatgggtcccacgctgactcagccatcacgtcggacaaaaaccggggtcaaaaccaccgaaggatctattgttaccggttttgattagttaagggacaccggatatctggttttgcggtttgaggacgttttttttacctcgatgacaagttcagggaccttcggtgtacttttcctaattcacccatggtttccaatccctttcggcccaatataaggggtgagcttctgtgtcagtagaatagttagcgcacactttttccgttttatcgtataccaatctcagtccgactccccagcgctcaggcgcacccacgcgtgccttatgacgtccgtgccgctaattacataattagcaaaaattaccatcattagcattattttctagaaaacacatatacacataatctctatctctactattataaaaattaaaaatatttttgccagtactttggtacgtcatccattaatgagtcaattttaatttcgttcgcttttggaaatacatatctatatttgagttgggttttaaattcgttcgcttttgaaaatacaggaggggtcatgtaagaaatctctttcaataaaacttacatgctaacttgaaatgatcggacttctatttacagctcatgattttctagaaaaatatatatccaagcgaattctcacggtgacactattataaagattggagatgtttttgctagtactttggtacgtcatccgtgtataagtcgtgtttttggtacatcattcatatatgagtcggtttttaagttcgtttgtgttgacagaaaacacgtggcctaggagatctgcttaactccagtgcaggtccaaagctccccttcggatgttgttagcgtgccagttgatttgatcatgtaatcaacaagaaatagaagcaaagaaaccgtggttaaatctataaatgatagccgatcggctagatgccgatgacatatcatttatctttgagctgatgtcatctgtgtatcgatcggcagttatgaataagtaaagaagaactaaatctactcgatcggttgtagatattaacgatatatactcttatatcgatgtatacttaaatcaagtgattgggatagatcggtcaccatgccgagacagtataaatcacttagatcgaaatatatatcaataacaggactatatatgtttgtagcatagccgatcagatagatctagcatgtatcggctaatactccgatactactctatatcaagatattaaagcaagtataatatatcgagcaaaagcctaacattcttagacacatcaatatcttaatataaagggcagatttaacatatcattgaagcatatagaacaaatatagttaaatcagatacgatcggctgaaactccgatgctattctaatcggcaactagaaggcaggctagagatcgatattctaagcatgactcaataggtcaaactcaactgatacagcattaagtatgaaaagaagaacgatatctagacaatcaagccgctagaagtttcagagaatggtagatatctcatatactctagatcaacatcaagatctaacctaatcggctgccctctgcgtacagatattagccgatagtagattaggtggcgatattgctagagattatgtaagatatatgataactcgacgaattatataaataagattagagtatcataaagatggaagcactaatcctaagaacacaatccgtcataacgaattttacctcttgttgaagatcgaaatcgatgcagctcaacccgaaagcaagaactcgtcgaaacaaaactaaagcaaaagggtggcgatgcgtcgaaattatattgaacgtgtgtgttgttaattacatagggctcagggtctatttatacctgagaattacaatatatgcccataccggacacgactattatctctaataaactctaagataccaaaagtctttgcggcagacttttgcccacatttatctataaggaatttacataagatatcctaattaatagatataattgtcttcccaggactctatccgtgcgtggcaatcatcttgaagtacattaacttgaacccgatgtcgcgtacaagtcatattgtcgggatcggctacatcggcttacccagcccgactcagacccagccgatcttatcgtagccgatctagattccagccgattcctgctctgttttcaaactcgatctccgcttccgactttgcttcgatctaatcttctttcctgacacagatgttaccaaatttggttgttaacacatgccccccaagtccgggatatttgataatgttccggatttgccatgtaccgactccgagcaagtttcgcactccgccgcttttgaccgtcattccagcactttaaatactaactgttacccccgagaaatctcacgccgtgacttccgttttcaccactcaagcgaaacctcttctctctcttctccagcgattcccccggtgcaaaggcgatttctaggcaacttcctcctcgacgagatctccgcccgcaccaatgtcatcttccgctagcccatctggtgcgccatcagccgaatacgctgaggtaagttctcttcggctaaatccccttccttagcagcagatcgattttctcctacctcatattgctttccttctcttggttgcctcggatttgtagcatctttcccaccaagtcgcaattcccagtctgacgcatgaaaaccactactttttcggcccaatcggcaatcctgaccccgccgagttcattattggtaaaaccaacaggatccccttcaaattaaccaacccagatctatgtcactggaagaatactttcaagtcctggccgtctctagagaaagttccaccagaaaagagctggactacatggttcaaacgttgaaagttccaccagaaaagagctggactacatggttcaaacgtgtatcagccagcaagagggtccactgggatgaaatcggaatcggccaagcacttgaccttactatagccaactcggccaaagatgaacccctgatggcagctgcttcttacttctggtcaaacactattaatgcctttttattcaatcaagggccgatgaccccaactcttatagatatcagcatgatcacgggtctagatgtcacctcatcggccaaccctatgagcttgaacacaaagaaccaatatgacttcaagaccaaaagcataggaggttggtcaggctatgtagcggcatatatgggtcagggctcggtcactcctcgggaacatgtggcctttttgttaatgtggctagaaaaatttcttttctatggatcaagttgcggccccacaaccaactggcaatttctagctgaagctctagaaacaaagagacaatttcccttaggcaaaattctcctcggctatctataccagatgttgaacaatgcatcggctaagatagccgtcggttcagtagttggagcaggtggaccctagtggctgctacaaacctggttaaacctgatagttatgaaggttgtcaatcggccatccgtatcagaagctgagttcccaagactagagccgattgtaggggatgatggagaagagcgtactcatcggagatgcacatcatacggagaatacgcttctacaccaactgatgccggggcaaaactatcggttgaactgcttaaagattggttctgcagcttctatgaaggctttcaaaaagatgctcgagtttggttcctttatgaagattctgcagaacttgagcacccactagacttcagattcgaagacatcaaccacgaaatataccaatcgtccagggagattttcttagctgcaatcagcccatgcatccttcctgttggcattcatcaaggaagaaacatccaagcttcttacgaattctatcatccaatgagctcagctagacaacttggaatgggccaactcccaatcggcttattctttgccgacaagatccaatgccgaggagaaatttcatcgaccttgatgatgcatcagctactcaaccttcaaggaccccctctgggcagtattgacaacatagaactttgacagatggtggggtgaatggaagctgcatctattccaccaaccagcttcaatgtatatgacagacctcttctcagatgttgtccctcaagtaagtctttaactccagttgatttaaatagctgtttggccgattaatctcaactaatcctcttgatttgcagacaacagaatcctctcctccccgtcaaagcaacagtggtaaggatatccaatatgccccaggtttaattcctaacggaggtgggctatctcctccggttattggatatgatgcccccaagacctcagctcttcttcaagggcttatcagagaaccagccgatgccgacaaaaagaggaaaaccagatcgtcggctgtaaacatcgtagccccaactaagaagaagaagacaaagaaaaccaagccagccgatgatctgcctaccctagattcatccattgaacaagctctggatgaagagataattgaagacaaagttgatcaggctgcagccgaggtaagcgatactgaaagaacaccatcagcttcgcccaaggaaacccctgcaactccttctgctccggttcacttttcaagggtaaatatatctctttaatccctttcataattattttgtcctatagccgatcattcccaagtcttataattgcagaaaaagaagactacggtgaagaagaaatcggctgcaacaacgtctaaaccagctccaccagtaagatagttttaactttcattagttaatttttagccaattctggctgacacttatttcctttcagccttcccctcctccttctcctcctgtacaacaaacatcaagtgaccagaccccttcagctgtggggagtcatcacgtcgaggaagaagaacaaccagctgctcctgctatcccagtaagtttctttttgtctcaacaagcattcagatcggctatgactgtttctaactgcttctaaattgttgctgcaggtattagccgatcttttctcttttgacatcagagactatcttgatgaaggagaagaagataccacaagcaaaaccttagcccctttatctgatgatgtgaagaaaactctaggaagtatcttggatcggctagaagcatcatcgctagatagcctggtgattgattgtggctcaatcagggctcagctacatgagattcaggctctaatcccagatgagttagtcgatatcctcaccccagccgtttaacttgagcaacaccaattcaaactggaaaaagccaaattaagactggccgaacggcgagagcgcaaggatattgaggccactatccaagctaatcgacaacttgtgcatgaagagaaattcaagcttgatcaactatctgaaggcccaatcaagtctaatattgatcgactcgaggctcacaagattgaacacttagcacaacttgaagaatgcaacgctgagctggacatggaacacaaaaaactagccgatctcccaaagtctattgaaaaacagaaagcaagactcaaatcggctatcaagcatgttgctgatctgaccaagtctctgaaagttatccctggaaccgacgctcaggatgcccaagccatagaagaagtagagcagattaggcagaaggctatatcggccatccagcgatacttatctcaataatttttgtgtaataaaacttagaatttttgtaatcggctaatactttactgtcttaacaatcctttgtgcccattaatatgactttgaaatttttgcactgcattttgatatatatgtgccccccagttttacaatgtcaagagcattgataaaattatataacaactaagggcgatataacaatatcggccattgtacatcggcaaatcacaactgattacaccatgaaaaacaactaagggcgatataaccatatcggccatctcaaggcgatgtaaacacatcggctgtcatgcatcggcaacacgagccgatcatgcgttaacccaaacacttgggtaatatttcttcaaatatttgccattgagcgctcgcccatagacttcgccatcaagcccttgcaacatatatgctcccttagacacaaccttataaatctggaacggtccttctcaattcggcgaccatttgccgaatttactatcacgagtaccaatcggcaaaatcaacttccatacaagttcaccttccgaaaaatctttaggtaccactttcttattataatgccaagcaacacgttccttatccttggtaacctttgtaagggctcgcaattgcgactgaaccagatcctccctctcatcggccataaggttgtaatactcatcggctgttaaatcattttgtaactccgttcgtcgagagccgattctaacctcccatggtaaaacagcctcatgcccataaacaagtttgtaaggaggaacttgaatcgatccatgacaagccatcctataagaccacaatgcttcggccaaccgagtatgccattgccgaggataatcagaaattttccgcttaatcaatttgatcaaacttttattagatgcctcggcttgcccattagcttgtgcataataaggtgaagaattcaacaacttgatgcccacactatcggcaaactgaacaaactcatcggacacaaagattgaatcttgatccgtagtaatagtttgaggaagaccaaatcggtagattatatgctcctgaacaaatggaatagcatacccagaatcaactttcttcaaaggaatcgcctctacccacttggtaaaataatcagttgccaccaatataaatttatgtcctttactcgatggtgggtttgtcataccgatcatatcaattccccaacctctgaacggccatggcttaataataggattcatagccgacgctggtgctcgctgaattgctccgaacttctgacaatcctgacaccccttataatatctgaaacaatcctccagcattgtcagccaaaagtatcctgtacaccgaagcaaccacttcatcttgtgagctgattgatgagtaccacagatcccctcatgaacttcgccgattgcaaccttagcctgatcggcactcaagcacttaagtaatactccatcaatcgtccgataataaagctcgtcatccaacagtgtatactttaatgccttatatcttaatttcctagaagccgactgagatggattactcaaatactggtgcacatcgtacctccaatcatcggctgacatcgctgcaatttcaactttaacatctttgatcattggcttataccacgacgccccttgagctaaatcattagcttcaagattttgttctcgagatacatgctttaaagtaaccagccgaaactctttcattagttccaagcacttctcattataaaccatcaacgtatcgttcttgcattcatattctcatgccaattgactgattaccagcaaagaatcccccatgatttcaatggtatcaacttcaacttccttgagtaattgcaaccccttgagcaccgcttcatactcagcttgattattggtcgcatatggtttaatagtataagcaaactcgaaacatgcccccctaggggaaattataactaagccgatgccacaaccatgagtacataccgatccgtcaaagaataaagtccatggcactacctgaaccgagccgattgaatcatcacgatgctctacaataaaatcggctatagcttgtcccttaatcactttcggtgattcatactgaatatcaaactcagtcaaggaaaatatccacttcccaactcttccctttaatattggagccgatagcatgtacctgactacgtcggctttgcatataacagtacactcattagataatagataatgcctcaaccttgtacacgaaaaatacagacacaagcataacttctccacaggagaataccgagtctcagcatccaagagccgtcgactgagataaaatacaactcgttccttcccttctaattcttgaatcaaaaccgagccaattgacttctcaccagccgataaatataacctaaatggtattcctttctgtggaggaatcaaaacaggaggagagctgagatactccttaatattatccaaagccttttgctgctctaacccccaaataaactgctgatcggcttttaacctcaataagggtgtaaaaggttccaaccttccggacaaattagaaataaaccttctaacaaaatttatcttgccgatcatctcttgtagctctgtcttattttccggggctgaatcttcttgattgcattaacgctcctttgggttacctcgatccccctttcatgaacaagaaatcccaaaaactggccgggcgacacaccaaaagcacattttgtcggattcatcttcaagccatatttcctggttctctcgaaaactttccttaattcggctatgtggtccttcacttctttagatttgacaaccacatcgtcaatataaacttcaaccagccagccgattaaatcatgatatatataattcatggctctttgatatgttgctccagcactctttaaaccaaaagtcatgacgacccattcaaataagccgattgcaccagggcatctaaaagccgtcttatggatatcttcatcagccataaagatctgattatatcctgcgttcccatccataaaactcaaaattttgttccctgatgcggcatcaactagccaatcggccactggcattggatatttgtcctttggtgtagctttattcagatctcgaaaatcaatgcacaccctgaccttgccattctttttaataactggaactatgctagaaacccattcagcatatcggtagggacgaataaaaccggcatcatacagccgtttgatcttagctttaacaggttcaagcatatcagctttacatctcctcggaggttgctggcgtggtctaacccctggcttgataggtagccgatgttcaacaatcgatcggctgagtccgggcatctcataatactcccaaacgaagcaatctctaaactcttttaggagctctatcagcttggttctaaactctggaaacaaatttttgctaataaatgtcggccttggccaatcgcctggacctatgtctatttcttccaactcatcggccgacataaaaccttgatcttgcttgtcatcgagatcatcaactgtatccttagcgtagacatttgaaccctccacgacgccctcaaagtaatagcttgggttctccatcttcgattggctatatatcagaatcggacacttttagaaaatctccatcccagacttttccagataaacaatcaaggccatccatctcctaaagggctaaatcggcactggcaacattaactgacctgtcggctggcacgatctctatcttgttgccttgccattgaatcaagcattgatgcataatcgaaggaatgcaacaattggcgtgaatccaatcccttccaagcaacaagctgtacgaactcttcccatcgatgacaaaaaacgtagtaggaatagtattgctgccgactgtcagctccacatttagaacacctctggtttctgatggattaccaccaaagtctttgagcaccatatttgtcttgatgagatcctcggcgctcctacccaacttcctgaacgtagcgtaaggcatcaaattcaccgcggtcccaccattgaccatcatcttagacatcggcttcccattgacgtagctgtttacatacaatggtttaaggtgccgattctccgtcccctcgggtttctcaaatactgtctgttctggtgatagaaccaacttagccgatccctcttccacttcatcgacatcggcctgatcgatcccgaattcagctggcaatgtaaaaaccatgttaattggtgccgctataacactcttcccttttgccaacctcttcgcctcatcggctgcagcatcattggctacaggaacctaattcttaacacgccactcctgtcttggctttggtttcctcagccgatggttgatttcctcttcaacctcctgaaaacgctccctgtttctcaatctctggacccttcttttctgattcttcatgaaaataccagaaggacaccattgattcttcctgattacctcatcctcttggccacaatcttgattcatcggacccaatctctgatgaacaggaagtcttacctgccttagccgattacctctactatatgaccggctcgagctctcgatgatatcactgcacctagggcagttttcaatggatggcaacctcatcccttcgttccagcagaatctgaagaactcacaaccccaatgaggatcaaaaccatcgtcgtattcttcataatgcttctcctgctgcttgtcatacttcctctgatacttgttgataatcctagccgaattcacttgaaaaccctttgcacggaccctatcggctgcttgaccagctgtgtgcaccatattaacaggaaaaggattaccatcgaccttcatcggctttttggaatcgtcaaacctaatcttgcccccctcaatggcaacctggatttgctgtctaaaaaccttgcaatcgttagtagaatgagatctagaattatgccatttgcaatatctcttcttgcctaattcctcagccgatgggatcgtatgaccagcaggaagctgaatttgcttttctcggagtagtaaatcaaaaatcttgtcaaccttggtgaaaacaaaatcgtacttttcctcttttccaagactttttacccattggcatggtatgacctttttgctcctcacccattcggctgcagctatttcagaatcatcttcctcgtcatccgatccatacatgtatggacaaacatgattaactttcttagagcttctcctgacttccgccgacctatgctcatgcaaggttatcttctgtatcagatgcgataagctatcaaagtcttcggacgagaatttctctctgattggaggaatcataccctgaaaggccaaatcggctaactgagcatcagtcaaactcaagctaaagcatttgttcctcatctccctgaacctctgaatatactcgtgcacgggttcatcatgccgctgcttgatcgctgtcaagtcggacaacttcatctcatgaaccccactgtagaaatagctgtgaaattgcttctccaaatcgacccaactattgatcgacccatatggcaaagaagaaaaccaagtaaaagctgatccagacagagataaccggaataacctaactttcaaagcgtctacagccgatgcttcaccgcattgagcaaggaatcggctgatgtgctcataagtcgacacgccctcttgtcccaaaaacttggagaaatccggaactttaaaccgattagggagagggactctttcaaaccactcaagataaggctgccgatacaagcttccagtctcttttggtttaagcccaaattgttctctcattacatcggcaatcacgtcggcccacggtcgttgctgagctgctccttgtggctgttgttgcctagactcgaactgaccatactgagatgcggactggggctgaccaatccccctagctgatattgggcttgcgaggaaggaggctgatattgatagctcaagttacccccttggtaattatgaagattcggctggatgttgcgcaccaagtgctcaggaaccatctgaggcatcactgtaccgtccggctgtgcatggtgaaccaaatgttctgggatgacctgattcacaaactgatgtacatgctgaccaccaggtactgcgaacccggccgatgcattcaccgaccccgggtgctaaatcggctgaacgacctgctgtcttaacggagtctgttggatcggctgctgaggctgctgtcttggtggcgtctgctgaatcggctgcagaggctgctgccttggtggtgtttgctgagctggttgtacgacctgttgttggatcgattgtacaaccggctggattggtggtgtctgctgaatcggctgctgctgcactggatcaacgataggtggaggtggcagaaacatggcagcgacttgatcttgggttagccgattcgtagcctgcccgccatgctgtggctgatcccttgttaacaaccgagggttcaccggctgtcctggcgtcatagctagtgtagcaggcaaaggagtcgacgctggagccgtcggctgagttgtgggtgcaacggagggaactgcttgaacagatggctgaacatcggtgatcaaagatcgataatttggtaagacgcctccttgcaagtaaattgggcctgcagcctgatgctcagctatcgaaccatcggctattgtcttcatcatgttataccccggactgattgatcaaagcatgatgcacagcgtaatcaacccgatcttggaagttattgaaaaaatcttgtgctagttcattattctggtcaagatttcctccttgtggctcctgggcgccatcaccttgaacgccatgaactccttgagaattgtcgccttgatcgctcggtgagccgtcggtaccacctttagtactcggctgagccgagccgtctggagcttgtttcacttctccatctttagaataaccggtcccaggactatcagcaaccacttttattttatacttctgaacaagtgtccccttacgggtctgcataaatgagttcaggaactgatcccgtgcctgctgcagggttgcttcaaactccgccttctgctcaggcgtgaatttctctggatcgatcggcatgacgttgtcatcaatgatgtcagtcaatccctgcttcaacgccttgcctttaacggaacctgngctagatggtggtggtggctgtttctcggccatgaggaagaactgacgtctgacttcttacacgtcccaccaggcatgccaaaagcgtgttgacagaaaacacgtggcctaggagatctgcttaactccaatgcaggtccaaagctcgccttcggatgttgttagtgtgccagtttatttgatcctataatcaacaagaaatagaagcaaagaaaccgtggttaaatctataaatgatagctgatcggctagatgccgatgacatatcatttatctttgagccgatgtcatatgtgtatcgatcggcagtcatgaataagtaaagaagaactaaatctactcgatcggctgtagatattaaagatatatactccttatatcgatgtatacttaaatcaagtgattgggatagatcggtcaccatgccgagacagtataaatcacttagattgaaatatatatcaataacaggactatatatgtttatagcatagccgatcagatagatctagcatgtatcggctaatactccgatactactctatatcaagatattaaagcaagtataatatatcgagcaaaagcctaacattcttagacacaacaatatcttaatataaagggcagatttaacatatcattgaagcatatagaacaaatatagttaaatcagatacgatcggctgaaactccgatgctattcaaatcggcaactagaaggcaggctagagatcggtattctaag

SEQ ID NO: 28440 - DNA, 35492 bp, Oryza sativa
tcaagatctaacctaatcggctgccctctgcgtacagatattagccgatagtagattaggtggcgatattgctagagattatgtaagatatatgataactcgatgaattatataaataagattagagtatcataaagatggaagcactaatcctaagaacacaatccatcataacgaattttacctattgttgaagatcgaaatcgatgcagctcaatccgacagcaagaacacgttgaaacaaaactaaagcaaaagggtggcgatgcgccgaaattgtattgaacgtgtgtgttgttaattacatagggctcggggtctatttatacccgagaattacaagatatgcccataccggacacgactattatctctaacaaactctaagataccataagtcattgcggcagacttttgcccatatttatctataaggaatttacataagatatcctaattaatagatacaattgccttcccaggactctatccgtgcgtggcaatcatcttgaagtacattaacttgaacccgatgtcgcgtacaagtcatattgtcgggatcggctacatcggcttacccagcccgactcagacccagccgatcttatagtagccgatctggattccagccgattcctgctctgttttcaaactcgatctccgcttccgactttgcttcgatctaatcttctttcctgacacagatgttaccaaatttggtcgttaatagtttgcttttggaaatgaacttgagatgatcaaactcctaattgcagctcatgatttctagatagaaaaatattgtcgacggggtatacccgtagacaggatatcgagggtactggggtacgctggtacgaggatctatgtaatacgacatcaaggaaacaagagacaaagattatactggttcaggccccttagcaggtaatagccctaatccagttgatatgggattatatggaaagaaccacagattacaaagggagtagtagaactcggcggtaccgacgagatcgtagtcaagttgattcgactagatcaccctgcgacttggcccctgtagtctccaacttcgtaggctatggtcgttgtgtaggctctgagattcgatgccttaagttccctcggggggtcccttttatatcgcaggtcaaacggtctccaagtaggactcggagacaccggaccctgcacgatatagtaacgacccagtcctatacgagtagtaacctttccattggcagacttcgtgatggatttccttaacgtgttcagagaatgttcgtatatgcaccgatatactgtattgccgtatagcatgcattcaagggtagagggtataccttatccgtaaccctgacagtagcccccgacttcaacttaaatgaactcatgtaaccaatcgcgacttctaatgtcggaattgttgtcgttctcgactgatcgatctcggtgtgagggccgtagagacaaagagcgttcgacaacaccatgtgaagtccaacggttatgagtgaatttaaattgaagtccaagaaaccgcctcgcgcaacggacccagaaatttccaacggccacctctcttctttccttggaattcgcaccgtcggtagtgcgcctatttaagggagttttgggaatacattttggagtccgtcgtttgtgagaaacttcctgcctccaaaccttcttcatcttctccgctcccacacaaaccctaggttcgcctgccccggcttcttctccggcgatctcccgcggcaatggatctcgacaagtccacctccagccgcgcgtccttgaagaaattgcaagaggaaggcgctctccccggtcgcgggaccatggagagggaaacgggaggtactgaacctgaacccgtcctgggccacatggttgtggttgaggactacattctttgtggttttcttcccccgccttccgagttttttcttctcatcttgaacttctatggtctttctctgcttcatttgaaccccaactccatagccttccttagcattttctctcatctctgcgaggcctacattggggtagagccgtttctcgacctcttccgcttttactatgagttgcgctggacggaacctaaaaaggtgtctggatgtgtcggtttccgacttcgggatggcctgaagtcgcgatacatccccttccagtgcccctcatctcgcagcaaatggcgtgggaggtggttctatcttcagatagaagatttggatccagtcttcattgttcctgaggagcaaccagacaagatttcatcttggaccgccaaacctgccttgaccccatccctccaatctttcatcgatatcattgatgacctctgagtacaggggttgtcgggatatgaagtcgctgccgacttcattgttagacggctccagccgctccaggctcgagcccatccaacctttgactactctgggccggaggacgcgacccgggtttctcctcggggtatttttcttgtattttgggttcctctctttttatgctcattcttcctgacttgtccaaacttggttctcgatctgcaggtctgagcggcgcaaccgtggaacaccgtgttgcctaggtgatgattagcggtcccacgacggcgagcaacgtccccaccacaaaggtgatgtcaagatgaaccccgcacctgctccttggctgttgagcgcgccatcgaacgacattgtacagcactacacccgccgcgccaggcgccatgcccgctgctcctgtgtccgcgtccgcgtctgctcctggctcctcctcatgctcgtcttgctcgtcgtgcgctcacggccttcgcctccgtcgtctacctcgtgttcaagcccaggcagttggactacacgctccagggcgcgaaccttctcatcggcctctcggcgttgcgccaccgctgcgcctccaggtcggccagctgctgcgccgcctcttcgccgcctcctgcctgtccgcgccgttccacgccgaccgcccccgcccaccgtcagccgcaccgccgtgcgcgccgaccgcgccgtcccctgccttccccgcaccgccatgcgccatgccatgctgcgccgcctcggccgcctccatggccgggcggcacttgtcttctccatctcagccatcgccagcgccgcctcctccgcgtgccacgcctcctccagctgccgcccatccccgtcgtccacgcttgtcagcttgtggatgagagagagagaggagaagaggaagagggaagatgacaggtggacccccagcatttttttaataagaaaatgctgactggattgtcactcgtacgccacgtaggcaaaaccgctctggattgggtcgagggggtaatttgtccggtattgaaagttaagggtgaacgatgtctggtttttgggtttaggggggtaattcggacgaccacgatagttcaggggggtaattcgtactttttcctttctctttcgacaacaatgacaatactcacagagtagggcgtagcggcaatatagaggaacaattcttcattaggttggggagcaacaagtacagggggatttgacaagtagcgcttgagtgcgatgaacgccttttcggcttcttgtgcccatacaaatttgtcttgcttttttagcagtgcgaagaaaggttgtcctcgttctcccatcctagagacgaacctacttagcaccgccatacatccggttagcttctgtacgttcttgagccttgtgggcgacttcatgttctcgattgccttgatcttctcgggatttgcttctatttctctgccagagacgaggaatccgagcagtttgcccgacggtaccccgaacgtgcacttctcaggattgtgcatgaggcgatatcgtctgaggttgtcgaaggtttcccgtagatcgtcaatcaatgaatcgcatgtcttggttttgacaacgatgtcattgacgtaggcctcaacatagttacccaactgatcgctaagtgccccttggaccgtgcgctggaaagtgttccctgcggttatgagtccaaacggcattttgacgtagcagaatacaccgaacggtgtgatgaatgctgtcttcttatcacagcctgaatttccgtttcaggatttataaattatttaataaattattaatcgaatttatattaactgttcattaatttacaagtgaagttaaatgtgggaaataaaatttccttaatttaaagcatggatggatttaatttatattaaattctccatgattaattatactctctgaaattttctcggaattttcggagctcaattcctaatgttaataatacaaagaacagtttagcaattatttaaataataaattaatcagtaaatgatctggatattattatattaaatactttgagtgtccatgtatattcaagatttttcttggaattgtttgagcattgaaagtatttttaacaattgaaagatcatctcattggttaatttatttggaaaagtaataaaagtcctcctcctcagcttgggccgaatccagcccattgcctccccttctctctcccttcctctcagcccgcatagaagtctgcttttcgtccctgtcgctacagtgctccttcttctacctccagacagagcccgagctctccagcccgtgcacagtgccgccgcctcctcccaccaatccggccacatcgttgctcctttctccaaattagttgtgggaatggaatcctctcaatctcctcttccttttccccaagaaatccccaaaagtttatatggaaatccttttcaatttcgcggctcaacctttcctttttccggcgaagatctaaactttcccgagtttttcctgtcgttgtgggctcgatcccggccttccatggctataaataggaccccctagtcctcctctttcgtttgcccctctcccgtggtctcccgtgccccgtagcctctccgccgccgcctccgtcgtcgccgccggtcgccgtcaccaccgttaggtgcgcgggagggtggagaagctcggccgctccctccccgctgtcgccggtcaccggagccccgtcgccgccgtcgaccgaagccgcgccgccgctagacctcgtcgccggccgtcgtcgttcgtcgtttggttcgagggtgagtaccgttgggttcgtctcatcgtcctctacgtgttcatgtcctccaaagtcgcagccgaccatccaatctccggcgaggtcgccatcttggtccggccattgatgaggtcatcatgacgtcatcatcatttttctttttcctgtttttctaatagattaaatcttcggaaattcataactaaatcatcgtaactcggttttgagtggttcaagttgctaaattcatctaaaatcatgatctacatgttaaaaatatccacatgtactgtttatgcttgtttttgtactgtttatttggtttctattagtctttttcttcgttttgcgtgttagcttgtcgtttccgtcgttgcgaaggttcgtgagtgcgttgggagtgttcagaagattaattgaagaccgattattgcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagttatgattgcttagccatacttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcacgacgcatggtagacatgatgttgaggctgtgtcttgtgggtacagtggtatacctctggccagagtaaaactattcgaatagccgtgcccgcggttatgggcgggttgagcaatgtttttcgtgattagtctcacgcctctcacaataattattgatgttatacctggtaataatttgcttagctcctggtttggagttagatctgtacagtcgggtatggttgttcaggatggttgggcctgtgcagcatgtgtgtgctgttcagtgttgattaaaatttctgattaattactccactgttttacttctcttaaatgttttgctaaatgctacttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggacgaggattttatgcacaaattagttcggaaattattagtgaatttccgggcgtgacacttctcctcatcctctttcgccatgctgatttggtggtagccagagtaagcaccaaggaagcttaacagctcacaaccagctgttgagtccaccagttggtctattcgagaaagagggaagtgatccttggggcacgccttgttgaggtcggtgaagtcgacgcacatcctccactttccgttggccttccgcaccttgactaggttggctagccactttgatggtgtacctctctgatgaaaccagccttaagaagtttatcgagctcttcccgtatggtctgcttccaatctggtgcaaatctccgcagtttttgctttactggcttggcatcgggtcgcaccataagtttgtgctcaatcacctccctagggaccccggcatgtcggacggctgccaagcgaatacgtccgcattgtcgcggaggaaggtgatgagcgcgagttcctatttctcgttcagtgatgccccgatcttgaccgtcttgtcggggttggcactggagagtgggacgattttgattgcgccgtctggtttcggcgtcttagttgttttgatcactttcttgggtggctcggctgtggcgggtgggctgggagtgtgctcgaccatgttgaggctccacttgtcgtattggactgccagctttgcgttcccttggatagtgattgttcccttcggcatgggcatcttgagtacctgatacgcgtagtgcgatgcggccatgaacttcgtgagtgccgttcttccaatgatggcgttgtatgctgtgtcgaactcagcaacatcaaatgttatctactccgttcggaagttgcttgcttggccgaaagtcaccgggagcgtaatcttgcccaatggcttggacgaggattgaggggtgattccatggaagggttgatcggtaggtgtcaactcgcttcgtggaattcccattgcgtccaaagtgctggcgaagagaagattgatggagctaccgccatcgacgatgactcgcgctactttgatattccgaatagtgggctcgaccacgatcggatatcgtcctggtataacagcagccttggggtggtcttcatctgagaattcgatcttctgttcaaaccacttcatcttgggtgcagccccctgccatatcgaacaaacctcacgctccacttttttgtattctcgctttgaagagtacgctgtggaacctccgaagatgtgtgagacatgaagatcggaatctgagtacacggagtccgagtcctgagtagttgtctcagttgccttctcgactacacgtactcgcttgctcttctccaaagccagctgcctttccaacgattttttgaagatgaggcactcctccagagaatgtctgtccgacttgtgtatggggcaccatattctctttgtatcactgccctgtgggtctgggtgtttgggcgggcgctcgtattcagatgcaaggacttctgcttgagctttcctcttcccactcttgccgcttttcttcttgcttgattcgggtgcgtccttggctggcttcttctctcctcccgcctttggtttgtcgtttttgcgtctcagcgcgtcgtctgcgtgggcacatcgatcgacaacctcgaacagccttcgagtagtagtgattcgccttgttgccaactcctaggtagtatagcaatctctaacacctgttttgaaagcgcggatcacaaaagcatcggtgataccgggatcgtatttctgcactcattaaagcgccggacatagtccctcaaagattcaccctgattctgtgttaacgcgtgtaaatcgtcttcgatcgcgtggcgcttgtaagttccctggaagttcgcgacgaattgttgccacaaatctgcccatgaagagatcgagtaaggtgggaggtgcatcagccacgaacgtgcagaacctttcaacgccgttggcaaatagtttgctaacgcgttgtcgtctgccccaacagcatatactaccgtggagtagacttggaggaattcctcagggtcagtacttccatcgtacttctctattgctccgggtcggaatctttcgggccatcggacatcacgtagagaacggttgaaagctctacacccagcgctgggggcagcgggttgtcggcgatcgtgtgtcctccgtggacgtctatcggatgacgtagacgaagatgatgatgatgatgacgatgatggctcactcggctccggcgtgcgattccgagggcgacgttcaggttctcgagaattctgtcgtcgtccaccattgttgtcctggcgccggtcaccattatcatcttcttcatgtcgatgtccccgaccattatcttctggtgtccgctgttcgcggttatcgcgatcgcggcggttatgacgatcacggtgatgttggtcctcgttcgagcggcctcctcgctcctcgttctcgcgatgtcgtgaggaaacacgatgtcgggaacgattctcattgtctcgcgcgcattgtgcttctcggcggccgttcagatggttgcggagatcgccggtgccacgaggtggaggggtagctcgtgcaggcgacgtccgctgctccggtggttcaccgtcggcaccgccaaccgtcggtcgttccggttgtgctctggtagcagcctcctcgaatgtgttactgagattggccaccgattcccgtagtcattccgttcatcgcgcgaggtcatcgttaagcacggggtcatagggagcttctctcaatattgcattgacggtgccgagatgttgggctggcgtggccgtctggttctccgcctctgcattagcctgtgtagacgtgctagttccatcgatggaaaatacgtcgcgtggtgtactggaagatgatgagccatagtcttcaagcaagtgaaggactgatggttcgcggggatcgatatcgattactccaacgaaactatccgaagtcaacgtcgctccttgttccttgtctgtctcctcgagagaggttcctgactgttggaccttgggaagcgtcgtcttcatggcgcggagaaagaccttgcagcttgagaagtcgtgattcttcgtcttgtgaataggacaatagacatcacaagttggagaagtacgttggattccacgctatttgcaagtatggatttcggcttgtgcgttgagaaaaacccagcaagcttgcaagttgtgcttcctggacttgtgaataggacaccaggacttggtgacctcggaagttgtcctcgtcggctcgcagtccttgtcagaaggacaaggcttggtcgcgctaggaatcttctcggggtcatatgacgtcgatgttccgttctccgccacggcgggaggatccttcgacatgggaccgtccgggtttgtagccatggcgttctcgtttccggttattaatggaccagccgagattggcaccgtggtgtaaaccgggaaaacgatttcgccgacttgagtccacaccagcattgttgaagtagggattctttggatggggccggtgttggctctgttgttgacgaagctcgatgtcatagtagtagaatcttgagcaccaagttcccctacctggcgcgccactgtcgacgggggatacccgtagaccggatatagagggtactggggtacgctggtacgaggatctatgtaatgcgacatcaaggaaacaagagacaaagattatactggttcaggccccttagcaggtaatagccctaatccagttgatatgggattatatggaaagaactcggcggtaccgacgagatcgtagtcaagttgattcgactagatcacccagcgacttggcccctgtaatctccgacttcgtaagctatggtcgttgtgtaggctctgagatttgatgccttaagttcccccggggggtcccttttatatcgcaggtcaaacggtctccaagtaggactcggagacaccggaccctgcacgacatagtaacgacccagtcctatacaggtagtaacctttccattggcagacttcgtgatggatttccttaacgtgttcagagaatgtccgtatatgcaccgatatactgtattgccgtatagcatacatccaagggtagagggtataccttatccgtaaccctgacaaatatatatccaagcgaattcttaaagtgaatttcatctcaactaaactgtatagcaataataaaattaaaatagccttcacccgttgcaacgcacgggcattttttctagtttatttaaaaatatgtagtaaaaggatttcaaaaattgagtaaaaagtttaaatttgaattgaaatatttgaattttgatgtatgaaatttttccatttgagatgaaaattttgaattgtgtgctaaaagtttctttaaatttgagtttgatgttatagaaaatactcctccgtccctaaatataagaaaaatgcatatgttgtagaggaacaaaatttgctaatatacttatttttttaataatttatgtatatatacatatatcaaacggaattacaaaaatatactcgtcccctgtcccgtggagcgcgacgatcccataactccaaaacacgggaccgacggtaccgcggaaaggatatgcaggaccgcgacggtcccgcaggttcaaaatgcaaaggcaaccagcgatttttaacgttgtgtagcactgtttttaaactgttcttactgttttgacactgttcacgcgacggtcccgtaggctcaacgcggtccatgaacagtgtctaaacagtgttgaacagtagcaaacagtcacgaaacaatatcaaacggtgctgatgcagtaaataaatcgttggctgcctcgctccggcgttttgaaaccgtgcgaccgtcgcggtcccacgcgaacgttgcgggaccgttgtgcccctgcgtttccgtcccacggaacggatatatttttttgtaaatctatctcatccaggtatataaacataaattattaaaaatataagtatatttgtaattttttttcgtgttgtagaggttaaaaaaacgcacgccacttaacctcctggcgcgtctgcggtaattaggattctcgaatataagttggctccacacctcttcaaagaagcggcccagtcacgtgtccgatacccagggacctatcgcaatcgtttggattggcctactgtactgggttaaggagtcttctgatctttgtgcacgtccccatactctaattttaccatgaaggaaacctaattacacccaataaataatataccatttaccattattgcaattctctgaatataagagaagtcccgaaacaaatttggtgggaaaagaagaccgaattattccaagctcccaacagtatgttgcgacgaacaccgcagcgcaggcacgcaaaagagactacagcagcaaaacgcgacagctaaaacggcagtaacactaacagcagattgacttcattaacagcaggttgacatcgagctcaagcgtagctttcggcgatgtcggcgaggcaccgcgccagctcgtcgggcctcgagagcatcacgaggtggtccgccgcatcgatctccttcacctcatccaccgggctgttcccgatcatccaccgctggaacccctccggtatggcgaggtcctggtttacgaccacgtacaccttccgcaccgagccgtagcgcccctcggtgaacggctgctgcttttgcaggtcctccacgaacatcgagctcaccctcagcagagatcccgcgagagtgacgtcctgcagccggacaaaacgattgattagttttgtcatccagtatacgctaatacgctatgcaggctcgaaaagtcgaaatgaaataattgcacgtgcttgtttctattataaaaccagtcccaaaaatcgacatcggtagctaaatgcggaaaaaaacgccatagaagatccaaacatgatgacgacaccgagacacaatatttggtaacggagttcagctgtggcctacatctctgggtactgattacgggtgctcctccccgatccagcgtatcagagttacaatgactcacagccggacgccgccggcagccgctctctctccctatgctaagtcgctatacagttacaacaggtacgtccttctatttacgagagatcctaatatagaatccgactaatactttaattctaatacctattacaacttcaagttctaaactgtaaccgactacatacacaaattcgacacaaactctaggagcatatacaacttttttttcctagaggatatataaaacttgtttgtgataagaagcgactagctggtgcttggccgagtccggtagtgaatggacaatgatggatcatagactggtctatcaaatctttatctttacctttatctttacctattataaaaatttaagatgtttttgccgtagatttcgtacgtcgtcgcagtagtgcacgttttatttatccggccgactcctcttttatccgactccgtctccttatagcatacgtacgatttttttatccgactccgtccccgcaccaatcagtgaaaacaaaataaaaataaagatgaggcacacgcaagttgctagcttcaggtaatatctgtcgttccttttttttatatagaatccaagtaaatcaagtattgctttactcggatagaaaaatcagaatcataggctgagtaaatcaagcctattctttacattacatctttatctttacatattataaaaatttaaggtgttttagccaaaaaattttgtatgtcgcccccaaattggaaacagcgcaaaaaagcaaaaaaaatcagatcggagatggaaaaaaaaatcggatcagagatggaaaagaaaaggggagcagccaagcaccccccccccaaccctcgctttgcttctccaaatcccaaatcatcgcatcgcaatccaacacaaaaacaaaatcccaatcggaatcatcacaaaatatcaacgagataaaatatcaacacaaaaagatgaggagaggagagggaaggtcgagccagaggcgccgctgctccttgccgaaccaccacctcgccgcctcgctgttgtggaggtgccgagctcgggaggatcctgagccgccgctgccactagggagccgtcgacgcgtcgttgcgccgtcgttgagccggggatccgccgcaccgccgctgcgccggagatcaaccgcgccgccggaagccgtctacccgccggatcttgagaggagcggggcggcggcggcacccagacgaggaggaaagggagcgccggtggaggtgagggagagcgccgatgggggagaggaagcggcgccactgcgccacacggtggggagaggagagacaaggggagggtgggaggcgcgttggcccgtagtagggggagaagggaggagttagggttagggttttataaatttggaaccgatccgagccgtccatcaaatgaacggcttagattgatcccaagttgggtcgtctcatgggccgcatgcgcgcgatccgcacaggaaggaataagtttactttagatcctttatctttacatcgagtttaaatcacatccctaaaccacaaatattttaagtattttctattttcagaaatagcattagtaccattttagttgcttaaaattgctgaaaaattatgaatgtttttctgacttccatcctcgggccgtagcacagttgggctgcgggcgcttcaccggctgtgtgcgcgaatgaactttctttctttctatctttcgttttataggaatatattttcttcaagggctcataacacggaaaactggaccctaatcagctaatatcttataattgttataattttagtttacccattgcaacgcaccggtattttttctagcaattaataaaaaacaaagaagacgataggtatgtgccaacaaaaataatttcagcttgcagtacacatgctaccaatgaatctgaattgtcgtgtttttttatggctctgcaattttttcttttatagtacagtccatggcacgagtaccattttgctggtgtagacattttgggtgtgtttagatggtagagaatttgggaagttgagagaaatttgatagtttggagaaaaaggtgatagtttatgtgtgtagaaaagtttctgatgtgatgtgatgtgatggaaagttgggaatttgggtgtaactaaacaaggcctttgactagctaagcgatatgcactagccgttcctatcgttctctaagagaaaaatgtggcctgagggctacatgtagctagctgatactatcatgctacatgctgatttgattcaaggatccaccaaacaatcatcaatccctttctggtcccctcttggctaaggctatattcttaggagcttgttcccaacttactattctcgtttttcacgtgcacgctttttaatctgttaaatgatgtttttttacaaaaatttctatacgaaagttgcttaaaataatcatattgatccattttttaaaaaaattagcaattacttaattaatcacgtgctaatggataattccgttttccgtgcatactgtttgggtcgggaaccggctggattgaacacagcctaagagcaagtacaatagcaggctataagccagctataacaatatatcgagaagaaaagggaagagagaggagaaagcgggctacagatttgtagcaagctgcaacacggactcaagacgttgcgtgtgtatgagaggtgggaccggatattaatggtgtagtatatttttgtatgtaactattatatgaatggactattagattagctatgaataatttgaagctaacatttggctatactattaaacttgctctaagaaagttttatactccgtaattcaaaaatataagatataaccacccttaatccaaaaaccaagaaacaattattatcacctcattatttgaatcatcctaataaatacaatgcatgcacccagtagaatatatgcatgcacatctaagaaaaataggtgtgtcttatattttggaataatgggagtagcagagacaaccatgagcttatagttaatataatagttaatatgtcctccctccagttgtaaatattgttgacgtattgggatagaaccaaactatgcaactttttgacattttagtctctgcctattcataaaggacctacttgctcctacatgcatgcatcctattactccatagtgctacatctctcgaacctggcatgcacagaagcttagtgacaggttcataccacctactccaattagcacaccgccacatttaatatgggtaataaatcatttcttggtacgtgggattatgtttaaatcgtcaataaaattagaacaagagggagtatagtagataaactataagattgtctttatatttttatctcttctctctttctctcacttatcctatcttactataaagttatcctccactaactctttaagcttaacatgcaaagatgccacatcatcatccactaacaagatgccacatcatcatccactaattaataagatgccacatcatcatctactaacaatcatcacatttaaacatcatgcaaacatgctatatctttataatttttataatttaagagcttttcaaatacaaatatgttaaattatcatctaacataattcacataatatttcaatgtatatctttattatgttttatgatatcctatatacttatatagttcatcctcactttactttattagtgtttaaatgattaatctatggtccaaattatctttctctttttttcctctaactaagtcatatcacatcaattgtttttagcctttagataattaatctacggtccaaactattttcctacttttcttctttcatataaagtcataccaccttactttttatgtttgaatcaccattctacatactatttaaatttaaataatcataaactacattaatttacttaatctgatgttatctagctatcttacacgttatttttttattattatcatactaaattttcacaacaatgcgcggggtttcacctagtatatttaatgcatttgtcttagagtatgcgaatagctagctcttatatgagaaccaaatacttttattttttttatttatttctcactctttcacataagtttataattagtttatagctacatgcaaaaaaaaataatcctcatccttcccatttccaaagtttctcgaggcattaaaatccacctccatagacgtggtgaaaacaagcgcgtacttacctctggcgagcacagctgcatcagcctttcttgggcgatctgcggcccgaacaacatggaagtggggagcttgccctctgcatcctgcggcttaaactccgtgtccatccagtccagccacttcccctcgatgaactttgagagagcaaagcaagacttgagagtaaaattcatgacaaaacagaagtggatcgatcacagtttgagggtcaattctacatctacaaatgctaggtaaaaagctgtattatttggggagtttctgacaactgaaaattctataagaagctacagctggttgaatctccccaaacaagccctgagctagcatttcgagagcccctcggctgatcagcaaatcttagcaggagaaataaattaagcagctatttgataggcaaaaaaaaaaagaatggactcaccttttcgagcacgtgcgacggccgggacgtgtggtccggcatgaaggcgcagaggaacacggcggcggcgatcttgtccgggaacagctcggcggccagcgcgacgttgatgccgccgaggctgtggccgacgaggaccaccttctcccctggagggagggagccgaggaggcccagcagcggcgcggtgtagtcgcggaacgtcggcacctcgcgcagcggccgcgggtcgacgcccgacgcgccgaggtccggcgcggtgacgcggtacccggccgaccggagccgcgtcgccaccttgaaataggtccagccgccgatgcacgcgccgtggaccaggacgaggtgcttgcaagctaccttgccgtccgccatgggtggtacaggaggtgtatcacgtatggttacgtagtccagcctcccgcgagtcgacggggcgacctctacgatcggcctaggaatatatagaccccccatggggtcatatactgccgaaagttcaaactggtggtatgaaaatgagattttacaacctctcattcaaatttcagattagggaatagggatggtagtgggatgacccatatgcacgggtaataattgactcgctttagttcattcaataattggcgcactttagttcatttaaagtggagtatatatataaaattttacttcctcaaattatttcagctcattaagattaattttaaaaaagcttatgataaagttaaatggtcttttggacaacaaacgttgagaatgaaaggcttttctcctaaatggtgtgagtggatagcttcttttattcaatgtggtcatgttggtataaaagttaatgatcaaattggtaacaattttcaaatttacaaaagtcataggcaaggggatcttttatctccaattttttttaatatagtagctgatatgtttgctttattaattaagagggctaaagaggcgggacttttgaatggggtaattcctcaacttgttgatgatggtttgtctgtcttgcaatatgcagatggtaccatcatctttttggagcatgacttgcaacaggcaaagaatatgaaattgattttatctgtatttgaaaagttgtctggcttaaaaataaattttcacaagagtgaattattttgttttggtcaggcaaaggagtgttaaaatcaatattctaatatctttggttgtaagttaagttcttttcctgttaaatatataggaactccaatacattttaggaagctttcaaatgaagagtggaaagtttctgaagaaagaattgagaaaaagcttagtagttcgaaaggcaatcatctgtcagttggtggtagattggttttgattaattctgtatttttgagtttagccatgtttatggtatctttttttacataccaaaaggggttcttcaaaaagttgattattatagatcgcggttcttttggcaaggggataatcataagaaaagtacaggctcactaggtgggatattatttgccaacccgagcaccaagggggagggggggtctttggatacataatttggaaattcagaataaatattttttaagtaaatggttgtttaagttaattaatgaggaagggggttggcaagacttaataaagagaaagtatctttataataagtctataacccaagttgacaagaaacaagaattggtctggacttatgaaagtcaaaagtactttcttaaatacgggttcttggattgtcaatgatgggaaacaaattagattttggaaaaataaatggctaggcaacttggctttcaaggataaatatctatctttatatgctattgtccgaaggaaatcgtcttctattgccactgtcatggaatctgttccgcttaatgtttctttcaaaagagctttagttggtcagaatcttgttaattggtatgagttgtgtgcttctattgtacatgtccagttgaatatttcttctaatagctttagatgaaattatcatcagaattgtaagttctcggtaaggtcaatgtacctagctttaattaataatggatatatcgagaggaataagtatgtttggaagcttaagatgccacttaagattaagatcttcatgtggtacgtgcttaaaggggttgtgttaactaaggataatttggcgaggcggaattggaatgacagcttgaggtgttgtttttgtatgaagaatgagtctattcaacatctatttatggattgtcattttgcaaagttcatatggagagtaattcagttctcttttggttttaaccttcctactagtatatctcatattttttatgggtggcttttcggggtagataagaaaaagagtaaactaatacttgttggagcttctgccatttattttgcaatatggttgagtagaaatgatatgatatttgataaatcaccatcaatttcctatatacaggtaattttcagggtaactcattggctccggttttgggcacaattacaaaggtgtgatgaagatggagactatctgaaagttgcatgtcgcaagttggagaccacagttatgcaactttttgccaattatggatggagattcataaatagactacaatgaatgtgttatccttattttagattgggtttttctttatcctgtttggtgtgttctatttgtttggaactacactcttttctggagtgctactatgtaataattggttgtagctctttttgagtaaaggccaggatattatattccattatctaaaaaaatttcaccagctcatttagtttgagttattttcagcaactcaaatttatagcttccttgttttctgttagcacgtttcctgaaatgctacaaactgtgtttcatacaaaaagtttctatataaatatttcttttaaaaaaaatcaaataaacctatttttaaagtttataataatttgtcatggttatagatactacatacctaatagtagttgattaaactcgacagagcccaccacataccatgtcttatatggaaacaaacctcgtatatagaaggagttgcggataaggaaggacaagaagagttctacatgaaaacgacacagactactcagatcgtatccatatttatctccctagttttacttggacaagggaacctatgggtataaatacaagctcctagggtataaatacaagccccctagaaggagagatgacacacccaccatagacgccacaaagccaccagccaatacaaaccaacacactaccagatatcgacatcagagattagcatagacaaacccaatccaatgcatgcggaggctgataagagggatctagcactatctctgatctcaacgagttcatgctcaaggaggaagactaccctgtcatcgactacgagttggttatctagccgccaagtcgacgacagctagatagtttatccagatgaataaagagcaacaccggcttcagccaacgggatgcagggctattacctgtcaaataaggggcccgaacatgtataaaaatccctgtctccatctcttttacctcaatctcgcatataccttggtaccaacaatccccataccatccaaacaccctagtcgcaataccaaacgtcgacataattaatattcaattaattatatgctattgacttctctaatttcacgtgctgacaaaaaattccaccaaattggaacatgtctttaaccccttaaactatttatttactcattttacactctgaactattgaaaacaattcatattactcttaattctatttctctattttgttttccctatataagtcgcattttacatcaaaatttggcacgatgatgatagatgtattgcacttacgcttgaatatttttttttatgatttcctttatgactgtttacattggtggaagcgcttaaaattgattgaaacatcataaaagttcaaacaaacattgatgagaaaattttaaagtatttttgaactttgataatggtgtcatgtatgtagaaacatgtagattaaatacatcttatataaataaaaaatataaatgttattacagagtaatatgaatcatttttaataatttaggggtaaaataagacaaataaataatttatgggattttaccagtgttaagtgatcaccgaggaaacaaaataatatttttagaattaaatgaaagagtatttaggctacaacgcctgctgctccaggcttctcacaacggagacctgagccacccgcttgaccattctctccagtgccccatcttgcagtatgccgacgacagtctcatcatcttgccggcagagcaacaacaacttgtggttcttaaagctatccttggtcctttctctgaagccaccgggctaaaaattaacttccacaaaagcaccttcctccccattaacgttcagcatgacgaggcagttcagttggcggggattcttggttgcccctagcttccttcccccaaccttacttaggcctccctctctctggtaccaagttttgtcttgcggactttcaacctctcatcactaggattgacaagcagcttgccggttggcgcggtcaccttctatcttccgatggtcggcttgcactcatcaattcggtgctctcagccctcccatcatacatgatgggggccatccttcttcctaaaagagtgattgccgctattgacaagcgccgaagggccttcttctggatgggggaagaaaactgtcacagcggcaattgcaaaattgcatgggacaaagtttgctctccgaaagaaaaaggtggtgctgggataaaaaatctcgagatagaacagatgtcttctctagaaatttctcctcaaaatgcacaagggtgattctgtgccgtggatcgactgctttcacgatcactatggatggtccgccttgcgtgacctaggcgatctttcgtggcttgacacgatcatctggaaggacatcatcacgggccttacacactttcgcagtgtttcgaaatccatcattggagatggtcggtccacttccttctggtttgataattggattggcggtgacgccctctttcaactattccctgccttgttctcacatgcaactcgccctaacatttctgtcgcggaagccctagccactcctgaattgctccttcatcttcggccccgaatgtcgacgatggccacacacgaattggccaatatccaagccctggtatgccacctagtctagacccagagacgaaaggcagatgcaccttgtccacaaatcgccccctcacagcaaaaacaacctacgacttaagcttcttagggttaccagatgaccctttcgctaagcccatttgggacaaccaagctcaagtcaaatgcaagatcttcctttggactacacacaagaggcgcatcttcaccaatgagagacgagctcaacgtggattagcagcatccgcacgttgtccattttgctcctctgatgaagatgtggagcatctcttcctacgctgtgccgaagtggcaacaatctggcacacctttgacctggacgaacaacagatcgcctccctgccgcagcttgaaggtgtctgggacatccctccacccggacaacccgccactccacgagtctggcgcactatcatgcttgccgtcatgtggaatatttggaaaggacgcaacaacaaggtcttcaattccgttgacgaacccgccacgttagttctccggtgttgtgctagcgacattgatctttggtcccacagatgtaaaaatgccgagagcaaacaacagctccgcaactgggcctcatacctctctgtaattaactcttaatttaattatccccctctcatcccctgtaacccctctcctgcaaatctttcttcatttcaataaaagttcaggctggtgccttaaacacccgctgtagtttccctcaaaaaatgtatttaggctaactattagcgtacatcgtctttgggcccatccctgcttcaaattgatggtatgaaaatgaatttttaaaacgtcttgtatgcgaacttattatctatcctactttcctacataagaaacttatcatccataccacaatggtatggctcacctcattttcgtgggtccgctataaaagacattgttttattactagaagctaaaacaatactttgtgctttaccaacggaaccagagccaacccccaacccaaggatatgagcttcacaagaatcacaaccgaaaaaaacttactaaatggatgaaaatcgtatctacctttaatttgtgctccaacattatcaatattatttaaagagagattaaacataagaatcttccctatcacacatcaagggactcataacgttctgatcctttgcactcaaaagactagctcgattagtgagaaatgtcgctaccattaagtcgtgctccccatcatgaaaatcaaatgtgaagttaaacaaaaatattatgatgtagtacgacaataagtaggtcccactattggtgctttacatcttggatattttttatcttgatattctaggtaggcctcgatatacatatgatgcaagtcaaagagataataaaaagaaagaaaaagtgttgcatagggtaggagaaaagatgtaacgttcatttttccttctttttcatgtgctcaataaatttgccaacggtcttccctggcctggcaaaggataaggaaagaaaaggataatcctggcgaacagaaagggattgctttccagaatcaatctatctatacctaataaaaaaatacgtaaggcttccagttgttattttcgtccgtcgccccgatatggttgccaaaatccgttttaatccgcttaataagtcaggtcggacattttccaatctactcccaaacctcggttgatatagaatatgtatcctctcatgtaaccaccaataacaagtagcaggttgcccacttggttagtggagaaaatcttgaacctacccaccagtgtttgaattccaccatcctctcctttttacacctattattactttgcctctccttgctcggaataagtctactatgcctcccaacatctcaaatccactttgcctctccttgctcggaataagtctactatgcctcccacatctcaaatcctagactagattgcttggataagtctactatgcgtcccaacatctcaaaacctagattgctcggaataagtctacttgcctcccatttgaaaattaaacatatatttttttttattttgtcatccatctcaaatcctactcggaataagtctactttgcctctcactgtttaatttgaaaattaaacataattattttttttctttttgtcatctaaaaaacacgacatattagagtctacaccatctatttgcacctctttcttcaacagatatttagtgatttactttgcctctactagctagattgctcggaaataagtctacttgcctcccacatctcaaatactacttagaataagtctactttgcctcccacttttaaatttgaaaattaaacataattattttttcttttcatcatccgcaaaacacgacatattagagttcgcgccatctatttgcacctctttcttcaacagatatttagtgattctgaaaacttataatgaaccagttttaaatttgaaaattaaacataattatttttttcttttcatcatctgcaaaacacgacatattagagtccgcaccatctatcgtccacgcatgagccgtgaaaatgattcgtctccacgcaagtccatgttcaattttagaaattatatcaagcacttgccatgcatccgatggctgaaaaatcaaaagttttgcatttctttcttcaatagatatttagtgattctgaaatcttataatgaaccattttttaatttgaaaattaaacatattttttcttttcgtcatctgcaaaacacgacatattagagtcctcaccatctatcgtccacgcatgagccgtgaaaacgattcatctccacgcaagtccatgtttgattttagaaattatatcaggcgcttgccatgcaagagttgagagaaagcgcgtgttataaaaatatgagtatatcaatatgcagtagtgtttcttatcagtcttgattatcattaacccaatgaataatttatctattttggaacattattatatatatgttaactgtgtatttatagcatttaacctttcattatacctgtagcgaagcacgggcattttgctagttaacttattaaaggaatagaaaaagaagcctccacgttcgctctcatggcctagaaattctcacattaatcgaagaaaaagaaaaaacagagtctatataggaatctacctatactacttaaaagttcaaaatatttccatcgtcgtaaaaaagaaaaaaaataagtcggactcaacaagcgagaaaaaagattctctcgtcagtaaaaataggaaaaaaatatttcgtagtaaaaacaacgtccgactcattaaaacagaaaaaaaaatctcgcccataaaatacatccgattccttaaaaaaggaaaaaaatatcgccagtaatgtaaacgaaaaaaaagtccaactcccgtagaaaggaaaaaaaacttctggcatccgactcccgtaaataaagggaaaaaacatgtcctactcaaaatcgagaaaaaaacacatatattataaaaaaaatcccgtttataaaagaaaccgatttgaaaaaactaaccgactagataaaaaactgaaaaaacacagattataaaaaaaacccgtttataaaataaaccggttcgaaaaaaaccacccgactagataaaaaaccgctccgaaataaaccatcagaaaaaacattgctaaaaaaaagatcgaaaaaaccatctgaattcacacgagaaaaaaccgccatatataaaaaatactaccccgaaaaaactgtctgacccaacgtgagaaaaatcccgcgtttataaaaaaattccgattcagtactgtgcaatgcgaaaaaaactgtctaatttcagaaaaaaaaaatccgatttcatgaaataagattcgtattgtttgtattgtccatcgtctaccatgtcgttttggtttttccatagcgtcgtcgaatgttcggacgtgcggatctaaaacaagtcttgcttaggcttggttttctcggaacaagatcaaattgatcgaggctttgggtcggataggattctcgatttttccatcatctacatggtttgtgttccacgattatattctcctgtattggagactctacatgtctctgtatgcaattaattgcatacatactactggtaagtatagctaatattcttgatagcttatcatataaaaataaaaataataaataaacatatttttaatttttattaagaagagtgcactgaggctctatttgtccgaaataaaccatcagaaaaaacattgctaaaaaaagatagaaaaaaccatccgaattcacacgagaaaaaaccgccatatataaaaaatactaccccgaaaaaactgacccaacgtgagaaaaatcccgcgtttataaaaaaattctgattcagtactgcgcaatgcgaaaaaaactgtctaatttcagaaaaaatccgatttcatgaaataagatttgtattgtttgtattgtccatcgtctaccatgtcgttttggtttttccatagcgttgtcgaatgttcggacgtgcggatctaaaacaagtcttgcttaggcttggttttcttggaacaagatcaaattgatcgaggctttgggtcggataggattctcgatttttccatcatctacatggtttgtgttccacaattatattctcctgtatttgagactctacatgtctctgtatgcaattatcagactactggtaagtatagctaatattcttgatagcttatcatataaaaataaaaataataaataaacatatttttaattgttattaagagaagagtgcactgaggctctatttgtttagacttgacaatacgagacaatgcaggatttgattgatcctactattattgcaagaatgagattgaaagattattttagattatatgtgtacaaccacgtaaataatccaatttgtttgggtaaaacatgcattgttaagtttgtcatagtcaagattggatcattatattaaagatgtttcaatttttcttataatatgacttagcaacaatgatcgatacgattattataattgacataattatggaatatagctgaaattcggaattaaaaataaggaatataggaagaaaagactagagtccatactggcataccatagaactaatggaaactcggaactagaaaaataagaaaactaaaaagtagaggttagagtccatatagtaatacaatttagctggaattcggaattagaaaaataacaaaactaaaagtagaggttagagaccatataaaaatacaatttaactgaaattcgaaattaaagataaggaatataggaagataagactatagtccataccggtatacaatataactaatggaaatttgggattagaaaaataagaaaattaaaagtagaggttagagtccatataaaaatacactttagaaataacgaaaattcaaaattttaaaaaataaggaatatggaatgaagtatatagagtccatataaaaatataatttaaaaataattaaattcgcaattagaaaaaataaatactgaaagataagtttagagtccaaatacaatttagacataatagaaactaggaattaaaataaggaatattggaagaagagtatagagtcatataggaatttataattaactaaaatttgaaataaaattaataaaattaaaagtagagtttagagcacatgtagaaacacattttacaaataaataaataaataaattataataaaaaggaatattggaacaatagtccataaagaaataatattgaaacatgagtccatataggaatacaatctataaataatattaacataagtttagagtccataaagaaataaaattagaaataataaaaattcagaattaaaataataagaaatattagaaaaagagtctagagtccatataaaaatacaatttataaagaacggaaattcggaattaaaaataagaaatattggaagatgagtataggaatataatttagaaataactaaaattttgaattttgaataagaaatataggaataaaatttataaataatagaaattcatgattaaaaaaataaagaatgttggaagaggattttagagtacatatagaaatataatttagaaataactaaaattcgctattaaaaataattaataactgtcatttatatacaatacattacgaatattacacattggttagtttgatcaagttagtacaaaatttaaaattatgttgtcattttaatatatttgataataaaatatgaaatatgctattatatgagagaaaatataagaatgctagccgcgcaatttacgcgggccaccatgctagttgaatattagagagtcacccacaaggccacaagaggtacacctgctactggttccgtggcgtcgtggcactacaatcgtataataccatccacaaagtcgctcgcccaaccgtttatcagtagtagtgtctctgggggacataggacaagaataaaatttgcgaataacttattttttcaataatttacgtttatatacttgcatggaaaggttttgcaaaaatatacccgttccacgacggtcccgcatttccaaaacgctggaccgacggtcccgcgggatggccatgcagtaccgcaattgtcccatagctccaaaacgcggaaccgttgcggtcccagctccaaaacacaccaccgtgctaatcagcgattttgacattgttttgcactgttcatgagtcagtcccgcggatccaacgtgcggaaccggcccatcaacagtgccaaacagtgtccaaaaaagtaaataaatttgcttgctacacagtggcgcgttttggagccgcgagctacgggaccgtcacggtggcgcgcggctatcccgcaggaccgtcacggtcccacgtttctatcccacgggacgggtatatttttgcaactctttcccatgcatttatataaatgtaaataattggtaaaatagatatattcgtaaatttttttcggacaggatagtgcaatatatctgacaagtaatctgaatgggaaaaatcacaatttaaaagtgtcctcctaagatcctgcgggttgctgggcgaaagcccaaaaatcgtgagaatcatttgattacaataagttcctcatcttgaggccgagtatgaatttcgtttttgaactgcaacaccaaatataacatgtctctctctgaacttgcataatatttatattcggtttcggcaaacgtgacgctaagtcagcgtggaactcatgtggacctcacgtgtcagcgaccagcttgctccttctatctcctcatcttccaccttgccctcgcatcaccagctctccctaggcgggcaagcggcagggacaagggcggtgcgcatcaccgagctggactagctgctacactgaaagggacgacaggcggcagactagaaggaggcgggcttgtgtagtagaccaccttacgccccccccccccccacacacacacacatctctagcgtcgtggtcgatgggtgggatgggtgacgggattctgctgcgatgcccgacaatcgcgcgggagcaccaccgtgccaactgcgacaacaccggattgagatcaaatgcagtagctactaggactgcacggtaactactgcacacaatctgagccctctatgtcaaaatctaacggccaaaacggatttggcacagtaaaatcagaacagtacctttccacagtaaatcactacagtgttttgctacagtgctcggatatatctggaacgtccattttaaatcatgcgatgctagtttgactgcttattttgcagtcccactggctactgcacctgaatcggatccgacaacacccggttaggaggagtccacgccaccgtccgagctccaccgctagctatacaggggtactcggctccaagctccactttccaatcgctgccgtcggcttcttggctctgagcaacaccctccggctgccgctcccatctgtagttctttttcctttctttgatcttgatttttcattagggctaaatttgattgatataaaaatttgccttgccagtagtttcaataatttggtaacttcagtagcactcggagcttatttagagtggagccaatattttgagaatttttacggtataatataccggtagtacatactatatattgtcattataaacaattcaagggtgtaaattgatttatctactcacttaaatcaaatgttgtaaaaaatttaagggggtaaaatggtctttctatgtgctagataatctctcctactctagttatctagcatgggttaatatgtttatgtgcttgatggattggtctgaacaagagatttaattgtgtcatctattcaaccatatctagtcagtaatacgatgacacacagacaattaatattactatagcaatggagatataacacgaaatagctaaagatcattttctattttgtggcaaattcccaacgtatccttatttatactgacaacatatactagcagtattgtacctaaaagttctcatattttggtaacactaccttaccaaatttcaccaaattttggtagtatcaaaacaaacttatattttgatactaccaacatttaatagtagaggacaaaaacattccatctacccttaaagctgaaaattttcagaaaaacttatccgagtaacatatttgaagacgagcatgtagtaaactttgcttttgtcacgaggggcacccggcaacttaggatctggattatctgcacttatctccgtagctacagtaatatgagcacagcatggtgtaaacagtacatggtcactgtagcagaagtggcagcatgctcggcagcaaaccagcagttcaccttgcgcgttgatcagcggaagtactgtagcagttcgtctcaagctttgatctgaaatatgcatggcagagaatcccattccggcaagttaacatctcaagactaaattaggaggagcggttcaatggtccgcaaaagaatatttatctcttcatgtgtaaaacctcatttgtacagtcaaaatcccaaagctacaataggtaacttcgttgttgcagcgacaatgcttttatccaattttccctgccattttgttccaccgccgtcgtccatccaattgctgttcatgtgtttatttacacttcaagtattcaccaatcacctcatgccacttaaaaactctctaacatacggcctacatatttttgtacaaacatctaaatcatggtgatataattaagcagtgatgtaacactgctagtatagaaaccaaccgtccatttcttgatctttacaaacatcagaaacactatgaaaagtgataaactgtgcggtcagatggcatcactggccatcagcctgacctcctgtcatcctccccattgagagtgtgaagtagagcaagatcaacgtgcccacactagacctgcgaatcaaacaagatatgttaagggcttgaggtcatgtagtggatcacatcttataagcaagaagcccagaaccaaggtgaggtcttggatatgtttacaaagcaatcatttaatcttctttttaaagacagtatgcataataagatatctatcccataagagctctatttctcaagtcaattcaagatcacgccataagttgagaaaagaaaataatatgacaacattgattaattgtggttcaacattgatgcattgcatcatttgggttgtcaccgtgtactacggattgcagattttcgtgtacatagtctgtttataagaataactggcccgcacaacactgtcatttaaaaacaaacagataacaaattgagagcttaaaggcttaagaaatatagagtttagtctattacagctagaaatgttgacaaaatatgttaaacctgacaaataacagaaccctgacaaattaattctacgggctaggaaaattgttcatctgaagacaagctgaggtcgattggtacacaaagctagactgaaacagacacatcttaccaaactgcaagctattaagaacttttcaccaaatggaaaactaggcaggtacacagctcctaaccgctggccatgacactgacaaggcaacaaaataaagcgcacacggttggtctggaagggacccctattggtgttttaatcatatcttggcagcttcaagaatagctacaaagggcctatctagatgaaaggggaaaatgaccatattatgaaaaatatctctacatagggcacctagttcaaatgaaagacccaaggaattaattcctcggaaactcttataggatgatgcacttaaattcgttagaattttagatgataagaaacatccaatcaaatttatggaaaattttctttggacctatgatattgatgccgatcatagcatgcaatacccatgattttctctgtatatagtcaatcatctttgttacgtattattgtgtttctactttctaattcacataagatgcaatgtatccctgtaattttctattaacaacacagctgatgaaggctactgccttttatccttaatggaaaatcaaactcacagtgctgcgaaggcaaaaaggatcttcctcgggtcacgccaccctgggacccgtctgcctgttcgtcggcgctttgccccaccagctgttggtgttgaagggtggaactgctcctttgggctaccatcaacgtgcacaggcaccacctgcttctcatacacggccaacacacctgtgcatatacaatattgagttgtgcatacgtatctgagtacattgaggagataggacaagatgatatgtgttgcattactacgttttcaacacaataaacttatgatgatttctagcacatgcagtgctactatatttcagaagaactgcaactggaggcttctacagtaacagagctctgagctctgcagtagtgctgcacagatatggtgggttaattttttctctatgaatttttagcttttttttttgggagactgttgggccagtgtggttcatcaggtcatttatgtttgtatttctgacctatatccaagtattttgccctatggataacaatgtcaaactcataattaaacctggtttccactccttaatttattgcatagagatgttgtcgtcatgaatcatctagatgcaaggattgatccctctgacctttaaatttttatgctagccaattggtcgcaccctcttaagcaaattcacatgaaatggtagatgggaagcaggatttggggatcatttgcatcgggttgcaaaccctatgcaattggcaacgtgaccccttataaagttgtaccaagtattagcaatggtacagccagagatttggtgtactagttaatagtagtacagtgtggtgcctggcccatggcccatggggatagccaagtttcatgatagtcaagttggtggcaggtaacgttgggagtttgttcccaaggattgatgagaatgcagctatctcacgcaaagcatctgacacgacacacgattttaaggtatgcattcgaggatcccacgcaagctgacgcatgcgtggagcagtggacaaactgaatccagcacagggccatccgggcgataaattcagaacaccaaactaattattatgaacggaaattagagattacgagtataatttctaactgatactaccccggtagtggtaaaagggggaagaaattggactctgagatgttcctggaatcagaatttcagaatgagcgcagcatggtgatgaactgacctgtggtagaaggattggcgtctccgctcctctcccgctcgaggcccttcccagcgaaggaggactccatcttcttctacgatcgcacaaacaaggtcagaagaactaagattaccacacgcgaacaaaccgaattccagtcaagcgaggacgcttacgggctccgcttctgccccggccgtctccgcctcgcccccgatgtcgaccgccacgaactccggcgcggcgccccggtccgcttcccggcggacgaggtccatggccatacgcgtgccgaccgacgacgctacctcctcctccacgagactcagctgctgctgccgccacccaagggaaaaggcacgaactcacatatatcaggcacacacgggtggcagagtacggcaccgctgagtccgcgacccgcgtggaggagtcgagtcgtcccccgagacttgaaccggtcgctgctcttgactccaagcggctcccccgcagacgacggggcgaagcggcgtgggagacggggcgccgcggcggcggcgtggagctcggcgaggtgggggaagaggaagtgcgagggcggcttgggcttgggatttaagaacgcggcggggagacgaaacgaaacggccggacgatggaggatggggagggggggaccgctgccgctcaccaaaatcgggcgggcgaggcggcacgggaggtgtgagcgtgacacgtacacgtggcggctacgtgtgtgggtgtcgcgcgcgcggaaccggacaagaaaattac

SEQ ID NO: 28441 - DNA, 20997 bp, Oryza sativa
tcacccccccccccccccccttccttctgtccattcgaagcaagaggattgattatacggctcaccgctcacgcccgcacgcacgtacagcggacggagtacaggagaaaggagataaatgccgtgggtttatcgctttttgtttaagcaaagctcgatcattaaacttctcaagagctcaattagtactatattagcttatcttgaagctaacattatagatatataatagattagctataaaatttggctataatttttttcttctctctatctctcacttatatatttaatgtatttatcttgaagcttgtgttaagctagttcttacataagaaccaatactcttatttttttttgttgcctctcttcttcgtataagtttatagtagacttataacttactattatatttgctctgaaaagtgtgggttggatggtgggtgggccccgtgaggtgggttgggatgttttccgcacaattgttaatgtcgtgtttctagttcgaaagaagctcagaagctgtttcctcgtagtcatagggtgatgtggcaattgttccttttctttttctgtttcgcgcatcgagcagggtgagcattttagttgtgacgggaggtaatcaactcatgactacacaaacgttaaccagaaatgagatgggcgctcttccaacacccaccagcccattctcgggtgtcacgttcacttatggaaaaagtacaccgaaggtccctcaatttgtcatcgagttacaaaatcgtcccctaaacgcaaaaccagatatatgacatccctcaactcacaaaactgttcactttatgttcctcggtggttttatctccggttatatccaacgtgacggctgagtcaacgtgagacccacatgggccccacatgggccccatatgtaagggagaccatgtcaccgccctctctctttttttcccctcttctcccctcgtctatcctttttcctctgggcgtggatggcggctgacagggaaggagcgcggcggagaggagggccgtgcggcgccattgtcgtggctgcgcgttgttgtcggggtgaggcggcgacgcatggtggcgcgggcggcgtggcggagggcaaggccggttcggccggcggttggcgagggaagagcgcggtggataggagggccgagggccgatgacttggacacggtgagctccgccggctgcggtggagacggctacgaccatggcctctcgctcgctttcgccggtaggtggagccggctactagcgtggcgatggcggtgggcacattgaagaggatgagcggctcgatctaactgatggggatgccggtctcaatgttgagctgccccagggcgcccttgccggtgaagaagaacaggagcaccagcatccacacctaggtggtgcagcgcctgcggatctagggtgtcgacgacctcggccggatccccatccctcctttgccgccgccacttacgccgacaccctcctccacatcgccgctggtcgtcgctgctccgcgtgccggtcggggtgggtgggggagacgggatgggcgatctagcttctccccgccggctttcatcgtctatcctcctcaccggccagtgcccatcgtcggctttctcctcaccgtccgaacgggctcaccggcccctcccttgaccgagcccaatgagcggtggcggcggcaaagctcggtggccacatcggacacgcggaacatcttcttcacaaggaccggcattgcgagggcgtggccccgcgcgctcgcgcggccttcctccgaggtgagcattgcgtcgaacaccgccagggccttctcggacacgctcttgtcagcgtctacgagggcctcgattagtgttgggatgagccccgtggacgctaccctcgtcgcgacgcgcttgtcggagctcaccaggtgggtggtggcgaccatggcggccttggtgacctgcgggtagatcagagccttgatgatcacaaccagtacaacgttcagccttctgggcaagctcccgtgcttggcaattgcgacgagatcgagaacccatcgagctagacgaggccaagaccctggccgcttccttgtccaatggcatcatgcaaaccaatgccgcggcggcgagagactcgaacgccgcggccagcatgcgccccgtgccgacagacacgaagcatcgccggttccgctcgctgtccctcgcaagcgcccggaccctggcgaccgccccggtggcgcgctccgccgcgccgactcgtcgacgtcgaacaacagctcggaggcctggactgggatgcgctccacgccacctctccccatctgccgccggctgcatcgagaagagaggagaaaagaagaaataaaagaaaagagaaaaagaagagaagaaataagacaggatgatgtcagaaccatcgagggatctaaagtgaatggttttgtaagttaaaggatgtcatatatctggtattgcggttgagggacgattttgtaacctgatgacaagttgagggaccttcggtgtactttttccaagaaacagctcaatagtcaccaaaagtcttgagcctttgttactgggccaactttgtgttgtgctaatcactgggcctcaaattgtaggtctatccggagacagcttcctcactcgtcgtgtttggatgaattttttttattaaaatatttacaaaactaattttgtgtttcaaagggcaactagttttgtaaatttacaaaaataatttttaaattttacaaaatttacaaaactaatttttaaaaatcactctcaaatcaccctcccaaagagtggcgggcgactagttatgtaaatttttgaaacacaaattagttttgtaaatattttaataaaaaattagaaataaaaaaaattgtgtttggaccgggattataccattaattgcaggtgtaagccttttaacgatatacttgctccgtttctaaattaaatcaacttagtacattcaaattcgtaggactttacgtataaggttgctttattttaggattgatggtgtagtggtccctaacaatttgcctgtgtcatgaaccgtcaaaaactagacaaaactcaatgctcaaaaattgaatttaaacttttgatttcaaaataccgaaattccggttgaaaataatcgaggctgagaggctcgttcccctcacatgaggcagcgttatatttccagcgtaagagcaactccaacggaatcggtatccggctggccaagccaaattttggccatcgatgggaaaaaacagggtccaacggactggctatcacgctagctatcgcagtcggctggccaaatgactgggatcgctggccaaatttggtcagtcgggagcgctcgccatcctctccctcgcattgtctctctcttcacgtgctctctcctctgcgcgcggacacggcgcaggcggagtggttgaagccgaggcgccagtggttcggtagcggcgccggcaccgggcggccgagcagggcaacgccgacgccgcctcgcgtgcacggatttgccgccgccggtttctccaactagcaggagagcgtggggcacctgggagagcaactggaggacggaggcgagatgggaacggagcgagacggcatcatcgcggaggcggagcgcgtcgcggcaggcgagcgggatgcggtggagcgcgtcggcgctgtcctgctcgagcgcggccgcggcgtcgtcggcggccgagcggaggcgctcctcggcgtcggcgaggaagcggtcgagcagctccgacgggtggcgcgcgtccaccacttcgggtcgaacccctcctccccgaactccgacgcgtccaccaccaccattttcagcccccactcgctatgcctcctccgccgccgccaccgccgcggctcgtcgtggacttggacgagggagacaaggtggagtggctctgagtttgctggattgctactactcctttgctaggtgggaaaaagagaaagaagagggagaggaggaagaaaagcaacgactgacatgtggggaaccagtgtcatagacttaaaacagagtgggtagatggagaggctgttggagcgagtaactagtttaagtggccaaatcagatggagagttggctatatgggtatttggagagtccaatttagagagactattggagatgctctaacataggcttgtttggccaaaatgatgccttttggccaattacagcctttttccttttttcttaaacatttttccaatctttccaagtgtccaattccaaaggtatggaaatacgatatttcaaaaataaaaaactattcccaataaatatcattgtatttataggaatatttagattcttttagttacatatttgataacgaaaggacgtcaaccaaaatattatgattgggatagaatgttacattttacaattttacatgaatggaaaagcacggccacagccatccactatggtgcaaagtgctatgttcttccttcgtctagaaaaataatttctagggataaatatggagaagcaactgtttagattcatctccattagttagttttttttctaagataaagggtgtactacactacactctacagtctacacagaatagagcaaaaaacacagctgcatagctggtctgctcaaagcagagcagccaccgagctcttcatccgggtacagcaccatgcaatgcaccttcaagccctccgatgcattatgttcaccattcctcagtgatactccaaaccaccttattgggcgaacacaacacccgtcaaaaaactaggtgttctattctttccaaatcatccatatgattaggatgaccaccgcatcaaacacatatcatcgacctttggtaagaggacttgcatgctgccgcccaccagattactaggtcaaagtacccatctagttgcagcatgatctaccatcgtgtactgaagggatatgaggtgccaacaagtatcaaactttagaacagagtagacatcccgacagacttggccatcctctccgatccaaattgtctaaagttaaacacctccccctaacttctaaaaacatgaagagtttgcaacgccccgaagatttcatcttccaaaggaatttcttgagtttcccacgtatctattcctctataccctcccctgcaatgatccaatttgatcttgcaagacagcgattcaatcgccaccgtcctaatcctatcgtggttatggatagttggatttcgaaattatcttttgcatttgtagcttgccgcagtaactatatgaagctccgtgttcggattgagcgtaggccgcctaaacgacgcttgtcaacaggattgcagtcagtactcctcagagttgacacgggaattcacagtcaacctttgttaagtccgatgaaacttacgcaaaatctatgactcaacaacaaatctcgaagagcgtcattccctgtggaggtaggcaaagagggcggcggtctgtcaagtgatgtgcacgttaatagcagaggcttgtggatgagtcattgcggtaatgtcgtagcatcctatcgatctattccattactgttgtatggttgcggttattttcccaatttagcagcccctacctttagaaagtacggtcttggcctatgatgttctatctcagatgatgtaccaaggattttatttcacatgaactttgtctttaatgtttaacaaatttgctttgttttcttttaaaaaaagttatgcatcagttcagatacaatgcaacctcatctatatatcctatatagttggcatcaaaaactaaatatgcattgggccacatcacccacaaacaagagccattggatcattgcaccaaaaactaaacatacattgagccatatcttgaatcagaattaatgcgtaggttcaaatgaaaatatatgtattctctaacataattaatgcgtaggtgagttagtaaaggagagcacgtgtgaatgaaatatcttggattcaaatcctagctatgaaaaattatcaaaaataaatagttaggatgatagattaatatttaaagttttaatttggtatgtagaactaatgtaacacatggagtaatgacaataattatttatgactatgtgaagtgttgcaatatgatttttttgccacatccattttgtggcaatatcaaaatttattaccactaaataaaaactattgcaataacctattaccacgctatttattaccatggctagcaacaattttaaaatggtggcaacatgtatctattgccataattttagtattcatgccacgatttttttcgtggcgacaacttatttttctattagtgaaatttatagttgcattgcacatatgaatagttcgccgcgacttgtggggagtatcatctagtatcatatataccccaggccccatttcaacttgttgaagatgaaaattaagtagcgcatgcaaaacgagaaaactattagcacatgattaattgagttttaattattttaaacttgaaaaatataattatctaatattttaaagaaactttagagtgaatttcagaaaccccaggttttggggcacctataacacaaaaccccaggcattacgatttgttttgaagaaccctaagttttggggcaaaatgtttcaagaaaccccatgtttaagcttatatcatcgtttttgctaatatatttatggataataattgaaaaaaataatacgagatatttctgagtatatataaatgctagcctcattttaatgagcaaaggtcattggtagtataattgtttatatgtataaataataggttagtgtgtcattattaatgatgttctattgcgtttttatcaattgtgcaactaaagagtaaggaaaaagatatattacataggatcgggtgtgtatttggagcttactaatgtaaaaatatactaaaaatcatatataatatttaaattatgagtatttgagtaaatatggggtttcttgaaacatttaccctaaaacatggggtttctctaaacaaatattataacgtgggttttatgaaattcactcaaacttttatgtataaagttttagtgcaaaatacgtcgtttaaaaaacgtgctagcattaactgagataaaatctataacttcggcagtgtttagttcccttcaaacttttaaaaattctgtcacatcaaatatttggacacatgtatggagcattaaatatggaaaaaaacaattgcacagtttatatgtaaattgcgagacgaatcttttgagcctaattacgctataatttgacaatatgacgatacaataaatatttactaatgatagattaattaggcttaataaattcgtcgcagtttacaggtggaatttataatttgtttgttattagtgtgtctgtatacgtaaaacaaaattagcacacgaaccaaacacggccttcatcagaaaagaacatgtcccactcctgcagatgaactgacgaagtcaatggcactacgaggtagagttgcagacacgtctatagtagccggactctagcgtaggaaaaacacgcgttgacaggtgcaaaaacgcccatggccgtcgtcctgtgtgaacgtactatagaggaattgtctcataccggatgttttttgccctttccgcgtagccccgttcccgattcccattcccagctatagtactggtggctagcttttgagttgacagccaccgtttttaaccaacgcgcgagttctgaactttctgaaggcgatacctcacccacctacctatccgcggcctttgtcattgtttctttattctcgagtcgtccggagagtttgtattcgcgggaggccggtgcctggaatgcagccaatttttaagtccagttcccattccagctccgtctttctttcttctcctcctggatttctgccggctcgagatcttttcaacgctcttgagctagcggcggctttgtttaattcgtggtgagcaacgtcgtcgtcgacgacgaattcgatccggaggaagggttcgttgtccggcccagttcggccggccggatggcattgttgggcgtcctcgtcggggcggtgatcatcgtcgtcgccaccgcggccgccgtttcgggcagcgggctgccggtgcctggatacgacgggctcgccatcgggttctaccacgagacgtgcccacaggcggaggacctggtgctcgccgagatgagggagatcgtccaggaggacaggaccctcgcgccggcgctcctgcggttcatgctccacgactgcttcgtcagggtgcgtgcctcgcgtgctcgatcccttcctcagtttctcatcatgtcgcgtggcgtcgcggggacgaaccctcgtgcgtcgatgtcgcgtcgccgtggtgcgtgctgctgatcaatggacgatgggtttttgatgatatgtttgtgcttgcttggcttcgcgtggcgtgcaggggtgtgacgcgtccatcatgctgaaatcgcgggaaaaaatcggggagagggacgccaactcgagctacagcctccgcggctacgaacagatcgaaaggatcaaggccaagctggaagatgagtgcccgatgaccgtgtcgtgtgcggacatcatcgtcatggccgcgcgggacgccgtgttcctggtaatgacgccaactccctggctactttaattcgagatcagtagtataatccgatcgccgtgatctttattatcgttcatcccgacgtacgttgacgagcggcttcgttttaccagagcaacggcccacggtaccaggtggagaccggacgccgggacggcaaggtgtcctgtaccattgacgccgacaacgatctcccaccgcccggctccaacattgtcgacctcaagatctactttagtgtcaagaacctgggatggaaggacctcgtcgtcctatcaggtacgcaataccgcaaataccagcgtccagtagtacttttggtcagtgcgagcaaaagcacacacaatatccattcaccagcttcaatttctgctcgattttgcgcgtgattttgtgcgtgattttccgcagggagccacacgatagggagggcgcagtgcggctcgttcgcgcgcgacaggctgtacaactacagcggggaagggaggcaggacccgtcgctgaacacggcgtacgcgccggagctgaggaaggcgtgcgtggccggcgaccctttcgacaagacgtacgtggacatggacccggggagcccgtacacgttcgacctgagctactaccgggacgtgtacagaaacaggggcctcttcgtctccgaccaggccctcctcaatgacaagtggaccaagcagtacgtggagaggatggcgtccgcggattcgacggacgagtacttcagggactacgcggaggccatgaccaacatggggaggatcgaggtgctcaccggcgacaacggcgagatcaggaaggtgtgcggcgcgtacgttgactaggcaagggggagtagacggagccagcgcgcggttcgttgggtgcgagttggcgcaatcgcttcgatcgatcaatcgtcatgtggccgtggcaaacgtgggggctagccaaccacagtggagttgcgttattattctatatatcggtcgaggtggttggggcgttgacgctcaccgcccgctgaaattttctcacaactggaaagaaaaactgtaggtatatcaacacatagaatagtccttctctcttttttttcttcgttcaccctgttcttcacggtatggcatggtgcaaatatatatatacggcatcttttaaaagttctacgacaaatcatgtatgtgtatatgcgtgaacatggatgtatatagtacaacgtgaacatgtatgtgtcctgccttgtcatgatggcagctggcagtttagcacatgaccgcgctctgcgtgcaagaggaggacgaggattattcgccgtgacgaacgaacgggcacaggcgaattgtcccggtagacaaaaggggatccgtgatgaaacggcgggccagatgcattcaccggccggcccgaagtgcaccgtccttgggcattttttttaaaaaaaatggggcaaaaattttgtatatctctactattataaaaactagctgggtggcccacgcaattacacggctagcacccaaacaaaatcatatatcttttactatggttttactaaaaatttattaaatagctatctcattgtcttaagactttaaaagaccaaaccttatcattctcgtgtttctaactatatagttttaaaaattcacaccagttgctactccttacgtcatcttcttttttatttgcttactcgatctatcactatttctattcattcttcttggaacctttaaaaattggattttatagtttttagagtttattgtcacgatgggtttcgtttttataatttctagatgtcccgtcaaatgttgccattatactcctctacggcccgtccactgtttcttctctttattgtcattgagattttaaaaatcgaacataattatcgtttaggttcaattttttactttctagaagtccggctaaaccatcagcggctttgccattatactcctctacggctcgtccgctaccacccttctttattgtcattgaaattttaaaatcgaacataattatcattggtttttttttactttttggaagttccaaacctttaaaaattggacttgcagttttattttttataatttttagaagtctcatcaaacgatgccactatacccctctacaacccgtccgtcgcataatctttattgtcattgtgattctaaaaatctaacataactatcgttggaattcattttttattttctagaagtcccgtcaaccgtcggcggctctgtttctcctttttattgtcattgagattttaaaaatcgaatatgattatcaatggggtttattttttttttttactttctagaagtcccagcaactgccttacttgtttgcttcacagcctgcctgacgtccctccttttaatcgtcattaggattctatttggtgttttattaataatttttatatgtcgtatcaaccaccaccactctactcctttataaacctgttacttaatttatctcgtcatgtgttttagatggtattttctttcaatagtctttatttttatcacaaattttagttatttataaattttattccaaattgaagtattatttttctttttctaatttcagaatttattttttgagtaaatttcacataaatacaggtattttgaccaaattatcacaaaactacagatttaaggagttatatcacaaaactatatatttagcactaaatttatcacaaaaactatagattttagattaagtatcataaaaatgcatatttagtattgattatcacaaaactacaacttttggagtttaaatccctagcaacattgttatggtggagctataaacatcaatactttgtgattaaattgattctaaacctgtagttttgtgataatttagttactaaatatgtagttttctaacacttcatcttaaatgtgtagttttgtgataaatttggtgttaaatacgtagttttataatacaccgagttaaatctgtagttttgtgataatttggtcatagtatctgtagttttgtgaaatttactcttttaaaaaaatagttaataccatattgtgttcttttaatatttgtattttttattttcattttcagttatttcaaaattgtattcctacttgaactcacttttaatttctctaattttggatattattttatttttcattcgaaattttaattaatctcgtattaggttcttctttaaatattgcttatttttaattaaattgtattcctacttaactcttcttttattttcttttgctaatttcggatttatttttattttatttcaaattttaattaatctcgtattgggttcttatatggactcttcttttaatattctttatttttaattccaaatttcggctatttttaaattgtattcctacttggactctcctttccttttctaattttggattttactttatttttatttcaaattttgattaatctcgttttggattcttatatggaaacttctttcaatattgcttatttttaattccgaatttcagctatttttaaattgtattcctacttggactctccttttcttttctaattttggattttttttatttttatttcgaattttgattaatttcgtattgggttcttatatgaaaacttctttcaatattgttatttttaattccgaatttcagctatttttaaattgtattcctaattggactcttctttccttttctaattttggattttattttatttttatttcgaattttgattaatctcgtattgggttcttatatggaaacttctttcaatattacttatttttaattccgaatttcagctatttttagattgtattcctacttggactctccttttcttttttttttctttttctccgattaatgtgagaatttctagcctccacagcgaacgtggtgcctccttttcgagctgtcttaataatataatagatagatagattaaagatgtttttgtctgtgctttggtacgtcattcatgtatgagtaggtttttaagttcgtttgattttgaaaatgtatatccgtatttgagtcagtttttatgtttgttcgctttgggaaatacaaaaggagtcgtataaaaatctctttaaaaaacttgtatgctaactcaagacaatcgaactcctggctgcaactcataattttctaaacaaatataaatatccacgcgaatttccacagtgaatttcaccttaactaaactgtataacaataataagattaaaatagacttcacctgttgcaacgcacggacacttttctagtatattgataaagtacaaaggacactaatagttttgtacatgacttttgcaacgcccacaaaagaaagcatatcacaagacttctcccaaaatggtaaacactcatagactaaaagtccctgcctgtagtggcggaggacgaggaaaaaaaaggtgtggtagcaacaacacgacaaaaacaacataatactatgctttgatgcaacaaaaaatgtattgatctgttttaggattcaaattcccaaacgaaattttcaagatttttttttgaatttagctaaatatatccaaatttgatcaaaatttgttcaaaattcaaattattttttgaagatagaaattgccaaaccgatagattaaacctttatcttttggttgcgtcgtataactaactaacaactagcgcttatatagatagctaattacaagagtaaaaacaagataataagtataggttggttgcattgctttgtgtaactaactagcaacaaagtgaaaacaagaccatcaatgaagaagttaatcacgcattcatgcactttaccactggctaacggaattgaggtatggctaatgccatatctcgccataccggaagcttcaccactgcctgcctggacccaagtgatcaccttttcttttatttttgcagtcattgttgttaggccataccgctgttttgatagattcttgcattgcgctcacaccatagctccgaggagatgaggattaccaaagattttagagcctttgtcggttttgcaggctcggaaggttcatctatcccaattttgcagattgaggtgcaaccctatccatctctagaggtctgaccagattcgtcgtgagaacctgcagtggacaaggaggtggactgtcgtttcatgcgtcgtgtggcatagtgggcagatttgttggtttgcccagtctcttctctagagtctatcaacaatccatgctctgttctgcaatactatccatgcaaagaatttgtattttggcgacacccaacggtttccgctcttgggtatggccaagtaggccattaacagccggtttcttcagaggtttaagttcactttgactcccttaagaggggccggatttgattcgtatccctaaaccacaataccggatatctcgaccctcaaatattaaaaccggtacaatttgactccctgcgtagttttgaagggcagtttcgcttacgtggtggtattgacatggtcttccttccacgtggcgttgacatggcgcttatgtggcattataatttaaaaaatatgtgtaggacccatttgtcattcacacaaaaagaaatgtgggacatctctcttcccttcttcctcatccctctctctctctcccttctctctctttctctttctctcccttactcttctccttcggccagcaactagcggcggtggtgggcgagagggcaggcgaggcgcagcggtgatggtgcgggcatgggcacgggagcttgatcacaccaatgatgacacatgcattgggcgcggcagatggcacagcagcagagacgcctctccttcctcaagcatggcgtgagcacgtgccttcacacgccgtcctcaccgccgctgctccccgttgttgtcccgctgccgccgctccggagcgcgggggacaatgagggagtgcgaggtggtgaccagtggtggacggtggcagcgactggacggagctcagcggggagctctagggcggcggcgccgatggtgatgaggatggctctcactcgccccttctccccagtctccttttcttcttcgtggggacagcgagggagtgcggggcagcaacctatggtggacgacggtagcaacaggatggagctcgcccagggagctctagggcagcggcgccggtgatgacggggacggctctctctccctccttctccccagtcttcttttcttcttcggcgtcctttgccatcgccgctgtgggctcaccttcgagcctccttgcccaccgctgcaatggcgacgcgccactatccgccgaaaaagagaaagaaagagagaagggagagagagggggaggaagaagaaagagataaaggatgacacgtgtgcctcatattttttttgtgaataacaaatgattcacatatatatgtttttaactttaatgccacctaagcgccacatcaacgccacagaccaggtcaacactatcatgtggacgccacgtcagcgaaaccgtcctctaaaaccactgagggagttaaattgcaccagttttaatagttttttttggggggggtcgagatatccggtattacggttccaggatacgaatcggatttggtcactaattaagggagtcaaagtgaacttatttcttcttgggacgtggacgccttgtcttccagggcttgcaatgcgctacggccctagtgtattccattcctatatgtaagtagctttttgtgtaggggcccatatctcctaccggtcatgaacttcggcccattatgcttggaaatgattcatccgcaaaaacggggtgtttttctaacggaagcacaatagcgaccggcttgatttggcgctgtcatatgattctttgctatctacacacgatagcgtgtggcaccgagcttaatgcattgttatacgtcatagtccagttgtatgggtatcatggagagtttgggaaatcaggcggtactcaatcggctaatccatcgtacaagtttgctactgtgtatttgccgttctcgcacagtacgcatacctattttattctgctctcaaagtgtcttggaaaccaagaaatacgctagagttgtttacgcctggctatcctcgcactcccagcgatcttattacaattgatcacctttatacaatgaagtcaatcaacatcctctctgcttggtcatgttggttaatctagactagatgccctagtcctcaagttttagaagaagtcaacaatagtaattttggctaaaaactaactaataatatacttaattagtagtatcaaacaaacgataacattacatttgtatttgaaaataattttatatgcggttaaatttatagttattcgattttatcaaagtataacaatggatatcataccaaaaacattgcacacatttttttagtgacccgtacaagaaaaatgtgcaaagcttcatattgatataacaggggaaagtaggaagctataatcaagaaaaaaactaaaaccatgcttcacacctacaccaagctagattgcccattgcaaaaatattgcacaccttatatcgaaagaaagtactatcctcgtcccaatataaatgtaattatgggttttcgtatccaacgtttgaccgtccgtcttagttaagaaatttatgtaaaaattagaaaaaaaatagtcaccataagtattattcatgttttattatctaataacaataaaaatactaatcataattttttcaaataagataagacggacaatcaaatgttgaacatgaaaacccacaaatacacttatattgggatggaggtactactacctaacatacaaatggatagagatcactagccatgtgtcctattggaaaatttataggatacctatatgtattgttgcatgcattagtacaattggtactttatcatgattcttttggaatacagtttttggcaatattttcaaaagacctagtttaattccgacaaatattcttcaaaatcatctattgcgaaagagagaaaagcttttgtttcctattcatagtataacctactccatccgttccaaaataaaccaatctcgtgttattacatcatagtacgatgaatctaaagataaagtatgtccaaattcgttgtactaacataacgttagtttattttaggataaatgaactataataaaatctgaaaaaaattaggaatcaaagcagtagtttctacaactgctaactactacaagggaaaataaaaacaacagcatatctcagtgcccaattatgaaatttgtgtcaatgctagaatttagcaaccgttttacagaagttttgcgagatcaatttgatccccacagtaataacagagataaatctccaaacctccaaggaaacatttgaaacggagaacttatctccccatcagatccaggaaaaatctcgcagttcaaaacggtgccttctgttgctgacccgatctggcgacgcaactacagccagatacgcgcacgagcctgcgggaaggagagccacaagagccacaaggagagtccgtccgagggggagagagagaagcaaacgtagacggcgaggcaacgatccgaacccgaggtgaaagagattatcccctcaaacaagccaacggccccaccaccacacccctttaacattctccgcttccttcccttgcctcgccgcttcgttctcctctcgccgaatcaattcaccaaatcgaagagaaaaaaccgcaaaccagcaaccgattgcttcgttctcctctcgccgaatcaattcaccaaatcgaagagaaaaaaccgcaaaccagcaaccgattgcttggactaagcgcatcattattttcttttttttttctctcagagagagaagtagtagtaataaacgtaaccttttcctcctattttatttcacctaatcccaatctcctccccccttccttcctcggccagagaaaaaaaaaagagaaaaaagaggagaggcctcgcaactgcaaaccctcgctttctccgatcgaattgctcgcccgagcaccaccagttcgccgcccttcccaccaccagtcgcctccctcccccgcgcagggtatctcctccggccgccccagtggcgattccccccgagctcccccgcgcggcgccgtggccatgtcgctcacctgaggatacggtcggtgggctgtttcttgcaagagtctctcccccgagccccccaagagaaacagcccgggggacgccgagttgttgattcgatcgccggagttgcgccgaggtgaacctgttttttgtttttggtggtggttccgtctcggttaatctgctttaacttggaggcaaaggctcggtcttcgtctgaggaacgcgggggagcggtggtagcgtcgcgtgcacgggtcctcctcgaggtcggcttgatgcggagcggcgcgcaggctcctcgaggcggcggaggcggcggggccttctcgaagcggacgctgtccggctacatgaggatcatgtcgtcgggggcgtccacggccgcgtccagcctgctgtcggtgggcgcgtcgctggtgaactcgatcgccagccacgacgaggatgggagccgtgaccaggttatttcgcttgattttaaacaattcactgtgctcgttggtttttttgggctgtgttttactagcatagcaactgctagcttggcaataattgtagtacaacggaaaagcctttagatgtctcaccgtctcacgtgtgcattagtggtaactggtgcaaaatgagcaaagattaattatggctggagggcgcaatcagtttctgctcctgccaccaaggtgctcaccatatgtggcagtattagtatttattgttagtgttgatgcatttattttgagcaccatataacaatctgcctatgtttgaaatagatagtgcttttggtagttactagcaattgtccagcggaaagaaaaagtggtgagatgattagtgtgttaacattaacaatgctagctgcagatgttaatccattgagttatcatgaatatgaaaagcttcttttgagcttcggctataattctcctggccaaataattcctatttggacagcacattatgatacgacgctgcatattatatgccattcctagttcatccaaatggacaaatgttgtggcaggagtagggtcagtcaaatcgtccggatgtacataaaccggttggatctaagtaaaagatcccctttttagtagaagtaataattccttgcaaaggatccatgtctacaaaaactagcaaatacatgcagaagggtaacttttccttttgtttgcatcctcgggaaatattttcatataaaaatgtatttacacctgtcttacatgtaaaatgtggttgcaggtacaatgggctggatttgataaacttgaatgtgggggtgacatgctgcgacaggttttacttctagcttacagatctggtttccaagtatgggatgttgaacatgctaatgatgtaagacagctagaatccagacatgatggtacagtttctttcatgcaactcctaaagaaaccaattgcctctacaaacagtgaagacaaatttgcagatgaacggccactgttagctcttgcttgtgacggaactagcacaggaagtctaatcagcaatgatggcaatggccctgttcccaatggagccaatggtactctccataatattggccatgagaatcatcctactgtacttcggttttattcattaagggtccatgattacgtgcatacaataaagttcagatcaactgtttattccatacggtgcagttctagagttgtagctgtatctcaggctaatcaggtatgccatactccacgcttttaacttggtgtttggatcatgaataatcctttatggaaaacaaaaatgcttcttgcagatacattgttttgatgctgcaacactggagagagaatacacaatccttaccagtcatatagttccaccaatttcaagttatggaccacttgcactgggtcctagatggattgcatattctgggaatccagtcccagttccggatacaggccgtgttacccctcagcttcttaatctatctcccctagttccacaacctggttcaaatggcagtgttgtggcatactatgcaaaagaatcaagcaagcaactggcttctggcattataacacttggtgatgttggatataagaagttgtccaagtattgttcagacttaattccaagtagtaacaatgttataaaccaaaggaattctggcttcaaagcaaatggggcaacaataaacgggcatacagacagcgaatatgctggaatggtacagatttcatctcagtatatgttggttaccagctttggatactctattgtgatgtttctatatgctaaccatattaacaaccaaccaattgaaggccattgagaaacccatctgactagttgagtaatcatctgatggtgcagttggtgttgttcctgtctgattgcaccattcagccctaactcgctgtctcgctgtgcataaaaatgaaattgtttgtcattttattttgcaaacaacgaactttgagttagtcttgatgattccaccaaaaagattctgttttgttaaaggcataatgagaattactgttaacaacttatccctcaatgcaacatgaatttaagttttccccttctgcttaaacctagcaaaagcaggtgttgtcgtaggataaatgaaaagttaattcatcctgtggtcgtacttttgtcttggtggaattcagatatagagtaaactgacgatggtggatgtcaaaacttatcctgattaagttggttagtgatagcgcttatttgtgaccaaaggagttgttttatatattaaaaagttgccaggagtattatttcaagatagttttgtgcatatgccactgatatgccatatctcactgacaattggtacttataggatggagtgaactttcagtgaggattttatccgtactcatatttgtcttgccagcttcatggaaccgtgacatttacaatgttccctttccaatgacaggttattgttcgagatattgtctctaaatcaatggtggttcagttcagggcacatactagccccatttcagcactctgttttgatcccagtggaactttgttggtgacagcttcaattcacggtcgaaatatcaatgttttccgcattctgccttcttcgcatgggagttcatcagaagctggtcca

SEQ ID NO: 28442 - DNA, 1130 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcc

SEQ ID NO: 28443 - DNA, 4359 bp, Oryza sativa
  unsure (1)..(4359): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacatcagtcagtttatgaatgaagctttatgacgtagtgtagcagtgaggtaactttctttcttgcttagaaacagaactagcaatgcatgataatctaaattctaaagggacagtaactagcatggaaaatggcatggggaaaacatgataactcatacctcaagccaaagagggaagccaaacgatgcccttggaagaatctctgattttgttgcatcctcctttttgcttgactggccttcacacgtgatttcgaaagctgctttgcttgtctcacatatattggtaatccgaaagacaatattttcttgattttccagtataatctcgcttgtgctaactgtggtgtctgggacaaaagaagactcctcaagcatagaacgtactttttcattcgtttcgattatttctccatactcttgtcttcttattaactcatccactcttgcaatgtcaacgctaaatgtgcatctcacaggtttgtggtcactctctgtgacatccatgcaagctacatacctatcaaaagagggcaaaaatgatcaatatcaaagaaagggagtcaaaagaagagaaaaggaagtgttatagcatctgacgatgtaattgaagcaactacagggcactccagtgaacagtcagctactgatataggacggctgtcgcggtatagtactctatcacaccaagcaggtatcctcttcttctcacccgaatcataccctgcaagacaagtgatgtaaaggcctcagggacaatgactgaatcttttagccaaatacagtcaaataattactctaaatgaaacattgacagaaaatttaatctattacacaatgaataacaatctaaattttaagtgtcaagctagacttacctcctagacctggagcgtgcttttggaatttgtaggttggagggaatttgatgagaccttcacgcattccttgaaacacctttccagctttcatttctgctcgaagctgatccttctctcttagccaatcaaaacttctttgtgagaccatgtcccttgcttcatcatatgtgataccataaagccggtagttgaaatcaccaaggaagacaatcatatcagcttcagccaagtctggcctgacctcatcgacctggttcccatttacctgtcatctccacaaatctgaacatcagtacaattcattatgatagataatttgaatgttgtataaaacacatacatttactcctctgtgcaattggacggatgtcgcagaagctgcatgaagagaaaccgagagggtcaaggaaacaccttttcaggattatattaatgtagaaggcatgtaacactttttatttagataatgagaaggcatgtaacacttaagacgaattgagagaaaagaacctgtggatccatgaggtttgttgaaagacattgtccggtaaatatgatcaaagtcagcattgcgtctgcttacagcttccaaatgtgcagcaaaatgattgctgacgaaacacattttacgatcatagactcttattcttaatcctacaccaccctgcagaagtatctattgtcatcacacagacaactgaagattataacttagacgcatgcaccatgatataaaaactgactaacgactgcaatgtgcggcatcatccaacgaggaaattaatgcctacacatatatgaaacgacttcaggatgtaccttattgccgatagcacgtccaaaaccacatggcactgcagcagcttccacatcaccaacatatggcttaaggctctttcttgcccttgaaaagttaatgtttacatgtaaaataaattacacgagaatggtaattcatctaattataaattaaacaagttatcattatgtgacaagaaatttatagtgtaaaccaaatcagctaagtcatgacaagacacaataccatgcggcaataagcaatgcggccaactgcctagaaccaactcgatggaatgatgttccctcatcaagtgctttaccaatattgtctatccaccattgcccattagcactgccttcaagtcctacctagaaccatgaacaagggaagctgaataaaatgagtgatatagagttatctacacacacaaaaagtaatagtggaaagttattacgacaattaaagtttgtgatatacacagcacaggtaaaagtataaaaatatagaattcgttaacccctaagaaattctgtatacttccaagtcagtattgatattgaccccattaaccatatgctccaaaagtaacattcctaaagcaccggtattctttctgtgctacctgcttgtttatgcttatctagaatctagatgcattcttcctaacacttaattgcattgaacaaaagcaaggagaaataaatgattgaaggcaagatcaagtatcttacagtttcttttgctgcagaaatggctaggaaacccgcacccatctcgacctcttgtaagccaacgacaaccaacccaacatcagatgatacactacccaaccatgatttaagtgactcagcagatgccttcccctgtgctacattccaacttccaaccattatatttatcttctccattctagtgtatgaaagctctttgttagtcaattcagtgcgcaaaatgtcatcaagaggtcctggtgatgtcagtggccatccccgaataccaccatggtgcgccaacgtgtaaatgtaagaacctccaattgccattcttatgactggacaactatgtccagtccatcctgcaagaaggttaccttcaacatccatgacttgaacaatgccactggcatagcccgcccacaccctttctccaagtgcctttatgcactgcacagaagaagtatgatgctggaattcttgcactctgtttccatttccatcccacagtataatggaaccatttgtgcatcctgaccaaattgttccatccattgcttgagccactgctcccgttctacggttatcttcgacaaatgttccttttgttgcaaccctgcgcaccgcatcagctgctccgatcaaggcattcctagatttctggaagaagttcaaagaaccctgggatttatctttctttgaaggttttactttgacctcctcctcgataggttgctctggcatgaccggtgtctcaagccgagctgactcaacttgcccgtccatcccaaatactttcagcaactcccttgtacgagcatccctgtagcaatatttcaatacaatgtggaggttagaagcaactaatgggcaaaggaacagcaatctgtaacacatggtaacatatatatctttctggaatcataccagatagcaaatgtcatgcttgtaaccgtccacacttttgcgcgagaataatcggcaagcatgtgcttcacatcagaagcaggcaaagagcacacatttccaactgtgcaatggttcctgagatcaatgtatgctctttccaccaacaatgcagccatgtgtctctcctccggtgacaatgagagcgacttggcaatggcatcgtaaggccatgcctttatgacaccaccctcggatcccgaccatatctcgcctgttggattcaaatggaacatgaagtttttttgtcacaatgatttgcgtttgcaattcacatgcaaatatgcaacgatcaaattcttaatactatgagaatctaacaacataaaaatacattggcattacaagatcatgggcaacatatgctcaccatacgaagtgacgaccatggagagcacgggagtccggccgtacgcctgccacgtgagggcttccttgaacaccggcgcattgcttggcccgccatggttgcttcccccaacgctcccaccgccgtcgcctgcgccaccaggcggaggcgcgggcgcggtggcggccgcgtcgaggtccatgcgccacgaccggatcctcccgtccttgtgccccgtccacagcagccggttagccctgtccacggcgacgcagagcgcgggcggcgcgggcatgccctcgcggaacggcgcgctctcctcgtcgccgcgcctcgcgcctgcgccccacccggcgaacacctcgtcgagcgcccacaccctgatcccggactcggccccggcccagagataccgcccccccggctccgccgccagcgtgcggaggaacgaccccgcctgcgtctcccggagcgggtgcggccgcacctcgagcgggg

SEQ ID NO: 28444 - DNA, 15086 bp, Oryza sativa
agatcccgcggcgctgcggcggctgggcgcgcgccaccgccgcggccacctccctcagcgcctcgtcgtcgggctccatggcgatcggtggttggggttgggggcgtgggggggaatgggaatggggagagataagatggaaatggtcaaggagaagggcgcggcgagggaggggggtcggacgaatggacgaccatcggagcgcgccacccgtggccggcggagtcggggccgcacgaggtgatgagagaaagaggagaaagaggagagagagcgggtgagccgggcttactgccaagtgccaacggtttcaaagatggagtatgaattaaccctcttctccgtttcaaatcacttttaaaactgggaaatgccaggctgaaaatggtgacaggaatttctgatcgatcgagtgtgttttcgaccgtcatttttagctatatataatttttgttttctttatttaatttcttcctgcgtcatattaatatcgatactgagaaatttaagtaatttaagtgatatatatagtcgactaccagctgatcaagcgtcgtttccgaatatattgctaccaatcccaaccattttcacccccaccccaccaggtatagtattttttaaaaatttaccaactacttcatcctatttttctatgaacgtccatatatgatcttatcttatttcatttgtacaatatttaacatctatacatatgaaattgtcccagaaaacctcactattaatttattttcatcagaagtaaagcatgcgtatatttagctagattgttttatcgttttaacatttaaataattatgtcaaaacacttattaaaatgcacgtgcttattttccgcgcttattagaagcattcaaacaattatccaaaaagctcactattaatcgagagattctttttctcactgccctcgtcaatacagtcataataatatactactctcacaggaaaatgcaatgcttttctttgggaatgatagtttgaatataaaattaacaagcaaaacacatgtgcattgcaatgagtgaaaaccaaatatattatcacttatggcacgtaaggctacatatagttatcaagtttcacaaaaccctatatatatttgaatattgattaattgcagcatatttaaagctattttttaagcagggaaaaaagtaaactatcaaccttagttaagaacttaataaataatttttcttcatatacattttatgttttaaaattttaagtaaaattgtgctcaaaatatagaagagtgggttttttttgaaatatttagaccataaaatctatggttatgtgccacacttgtaatacctatctttttctacaactttcatcgtataacacgaggttttttcgacagtgtcgacgtggtgggaagctatcacaaattcaaaagatgctccaaagaaagctttgcgcacgcttacactcctagtagcctgggaaatatggaatgaaaggaaccgtagaacatttcagcaaaaggagctctcgacaggaagccttttggctaaaaccaaggaggaggccaagtcgtggtcattggtaggcgcgagagatctcggtagctggctttctttttaattgctcggaccgaaggtcttgagccttggtttttcttttgcacttgtaaaatttattcctcctttattcaatgaaattggcagcttgccgattcgttcaaaaaaaaataacacgaggtttttttttgaaatttaaattgaaaaaaggagaagacgaaacccaaaggccattctcagcggtggtgactggcgagcgacaaacacagcgatggtcgctgctcccaccctttaatgctaaatcgattccatgggaaaagtaaacccatttggcctcgtttaatatcacacggcgtatctctcatttggtcaccagtagcggcggtggcggagccacgaaggggtgtctcttgcccggggaaggattgcaccaccgcagtccgccattgagtcgccgtgtgcgtttgtggggaaggagaggaagaataaagaggagaattctttgagtcccactgttgagttagccggttggatcgggtcaaaacgccacgtcagcaaaaacgtcctctgaaaccactgagaaagttattttgcaccggtttcaatagttgtggggttaaaatatccggtattgaggtttaagatacggattagattaaagctatactatgagggtgtcaaagtggacttatccattccgaggcgtgcacgatacggcttgggcctagaaggcccatgtaaggagggccttctttgagatggatccgaatctcgagaggctgcatgtggggccagacggccagttagtatggtgggcccacttgtcaggacggaagcctccctctccgactccctttctccccgtcccccaaattcgcatctctaccctcgccgccggcggccaagcgccaccgccgaccaccgccgtcccccgcgacctcgccgtcgtcgaccacgacgagcggtggccgccgccgccgccgccctcctcgagttcgaccccgttcatctcatccgtcgtcctccgcgagataaccctccatcgctgtctcgggcgatgtcgaagcagctggtgtcgcggctgctggggatgttccgctcgcgggcgcaggtgggcgccgacaagttcggcaaccgctacttcacccgcgtcgaggaggtcgacggcgtcagtacgtctcccacatctccttcaattcaaattcagtctcgtaggctacatcaatggcggcggctcatttcttggatggctttgaccagtgaaggagaaacggtgggtggagttcaaggggagcgaccaggatccgaccactgttccaggttacctcttcttctctttcggttgatcaacttcaatttctggcctgtgtagagaacctgatatgattactgacttggcactttgtttctgcaggcatgtatggtttgtgaacttttgattctgatttctgaagtatgaatcgacgtgcttggattttgctgatagttgtgtcacacttgtagttgagtggatttgctggttgaatggacaaaggaagaaagctccgacaccagaggtgagagtatggccatgctccacacatgattttctgcaaatgttttgagcaggctattgatgtacagcatgtttccattatactgtgtaggtgacattttgatttcatctgattgtgatgtatcactgcactattgtaggagttggctgagctggaagcaaggcgtgaacgtgtcaagcaaaatattgaatgtatgcataagatgattacagcttatatcctctcttattattttctctttagccctatattattaataagaaggtgttctttacttttcttgttaagcctacattaagcatcgcacaagttttcttttgctgatgttgcggtggtggagatggtggttactggttagcgtgttttacatatattgctgatttatgttgtgggataattgtaaatgtttgggctcaagaataattcataacattcgtgtaatgcgtattgtttgtttggtgactatacatcaattactgttacttaccgtgttttagtaaaaccaacttaaatgcatccagccatacatcttgggattgatggcaaaattctttattgtcttaattttcagtttatctttaaaaaagttactacagtatgtttactcatgtatattataggatgcctattggttctgttaagcttatgttcggaaatgactatgctacatgcaacttccattaaaaaaacaatgaaactacatgatggacttttgtcctacttcccagttcccactgatctcacttgtagaattattgctggttagtgggaaaatgttaattacatacatatgtgccatagtcattctgttctttttttcttgaatgttcatggattttgctccactaatatatttaatctgtttcaatccagtgctcaaaaagaaagaagaagaggaaaagaagaccggtgtccgaccagtcaagacggttggtatgttctttctggatctgcttaagagttgggaaaactgacaatttgcaactccttatagtggcacttgatcatttgtgggattggcaacaatcaaacccctgttcttacttcccctcattgtttatcagcatttttagctttcttaggactttatgcatttcaagttctttgtgttcatggcttaactgatgttacatatctatcatgtcccatcaacaccaatcaatgtgtttctgtttgcaattccttctttctaacttcaccaacagttaaaacttttgaaaaagaaaaacaatattgtcatcattcttttgtctctgctccttagcaactccagattcttaactgttacttctgtcacttgataatatgtatgtattttcatttatttttcctgggggttctcccttttctcttgatggtttgaataacgatattcctccaaatatagggaagtttgaatctccaaatctcaaaagttttattcagcagtttcctgatacttcgctagatcagagaaaaggtatataatcttatactcttgttccatttctgcttgtggttccatttctgcatgtgatacaacccctttaacatccatgataacatttcaatctcactgtttaggacatgatgaggtatctagatcaaaggatggaactgatacagaggatgccaccatagatactgacaggtgctttccaattctccgaaatatataaattgtgattcgatgttattattttgtatctatttcatctagcatacagtgccactggatagctactgtttgctcttgaactaaattctttttggagggcattgctacttccccatttagcattgctttgtgatcttcttatgcggacataataattgttcttgcaagtaaaatataacgaatccaccaaagtagcattactgtatgccatcatggatgatggatctgccaatgtcttacagatacctagttcaaattgtcccagtaccatttcattgttgcagaatatagaaggcatgctccttttgacaacagcaactgtagttaatctggagctaagagtgaaggaacaatttgactattattaaggttattctcgtgtttgtgttctttcaggtcttctgaaccgacaggaactggtgctaccttcaaaccagggacatggcagccaccaacttgaattacaacaaacatataattgtagcaggtgaaatggtgctgcagtcagcatcagcattttcctttgagagtgtactatcttccagttatttgatgaagaaatggagatttatttttactgtgattaccactgtacactccgggagttacatcaacaaatgcagtatccggatgacaacagatatatacttaccaatcttatcaaatacatgatcattcatgtgcctgactaattagttttgttattgagaattatggaacaccacgagtgagctggttctggaggaggcatgcaaatatttttgtgctacatctaaaaatctgatatgttgggctgaatttgttaactgtgcgtgcctttggtccgttagttgaatgggctaaactaactggtatgggccttttcggccattgttgcgtgtgctaaatttcttgataaagcagatgtatcctaatcctatatgtctctagtatgggctgtttgtagagtggctttacttggctcattagtatatttttctctttttttaaaaaaaagaaaaagaaaagatgacgccatatttgtgctcgactcgggttacattttttgccattgcaaatcttcctttgtctaagctctgagtatagtcggaaaggcacactatcctttcagaagcagctgtatcagaaaaggagtgaaccgggtctgcagaagatgtgcaattttctttgtaacatctaaaagttgatcgatccagttttccaacgcagaatccactacatttcatttcatggcaaaaacagaattacatagcttcaaatggcagaaacaaaatcttcaggaacacacttttgacaggtgggaaaaacaggcacaaatcaaacagaaaatagaatcttcaggaacacacatttgacaggcacaaatcaagcagaaacaaaatcttcaggaacacacatttgacaggcacaaatcaagcagaaacaaaatcttcaggaacgcacatttgacaggcacaaattaattagaaacaaaatcttcaggaacgcacaattaacaagcacaaattaattagaaacaaaatcttcagaacgcacatttgacaggcacaatcaaaatagtgctgtctagaagtgtactcagtaaattctagtaatattgttcatctcatagatcacagaggaaccccgaatcctatcaatgtacagaggaatcccgattcccgaatactaatatttccgatcgactatagcgtaaactagagacaacatgatcaaaactcgtgcaccctagtcatgtagacttcctgaaagtgactaatgagcacgaaaaccatctactcacatatgacgctaaaatcttcggccgggattcgaagcttccaaacctcaaggagcctgcgcttcgcctggcggacgaagtcgaggatggtcgtctccgccggtggaggcgagggcggagcagcgcggcgatccggcggcgaggtcgcaggcgcggggtcgggctcgggggcgtggtcgaagagctcggcgggaacagggcgatccatcagaatcgcctcggccaagccctcgaacaggaggccgacatgccgcacggcgccgccgccgagtcgctggtggcggatcgcggcgccggcgtcggaggagcctggaggcgtggcggcgaagcgtggcgtcggggaggtcgtggaggcgcggcctggcgctggcgccgttgcggatgacgaccgggcggttgcggaccaccacctgggcgggcgcgagcgggaggacggcgactcaccggcgcggggggcgagggcgcgcgcgtgctccacgccatggagagagctttgacccgcatcacgtagcccctccttcctccgtgcatctcaacgagcttctgggcgtccgtcccggtgagagctaaccgactgcgtcttcctcttctccgcgccgctcttcctcctccgtctcgccattgccgcaccttgcgcttgcgcttcaatcgatcgctcacgacgccgacacacgcgcgcgctctcaagtgcaaatctaagaaggacatttgaacaattgccaaacttaatagtgtcaaatactagttaaatttcgctttctcttgtatacaggaaaaagaaaagaagaacaaattgaaacatatctcccactctcgtcagtgtcagacggcgccgacgcgatctcctactcccaccctcgcgccaaaaggagatcccccactccgcccggcttaattcctgtcgggttgccgacttgcaaccccgatttgatcgaggtcgaggatcgtcgctgctgctaccatgggtttgctggcgctgacgcgtctcatggctacgcagccgcctcgtcgccgccgccgccgccgcaacgatgcccaagcccaagcccgaagtaagccccccctcgatcacctccgcaacctaaaccgattcatgtatctaggttgagaattgagattgatctaagtcggctaggtccttaagatcttcaatttagtgagattgatctgcaagcatcctggctccttttttttccctgattgatttgagcagggtagtgtagtgctcaagtattccttcctgttccaatgtggatttgtttgcaaaaaaaaaagtagtactagtttcatcgttcagggaaaaaacaatagtttgatctgtaaaaaaaaaaagagtaggtatatttgtggcgccatattttccaatagtcgacttgtatttacattgtaagtcctagattacatatgcaattttagtgcatttataatgtaggtcccaaaattacatatgtaaatcaaaaaattacatagtaattatatatgtaagtggtgtgtaactactatgtaaatttataaatttaaatcttacattggaaaagttaaaaagcaaaagcatatgcagtccttactttctaggagatgatcaggagaagaaatcgaacggtccgaacaggcacaaccgaagacgtgtagcgatcagacggatagcaaagccgactgagatcagccccaaaaaatgtcgacatctttttagcaagtctgaagaaaaagtggttcgggagaagattttaagagatacttgaacaacggatggttccagaggaggcatccagtatcaataaaaccacgagtgtaacagtgcttatgtgcagttccaggaaaaaatagaacattttttttctgtttgtgcttatgtgctttgactttgttgtttccttctgttagtatctttattaattaggagtaaccattaccatacataatattgttgcagatggagtgattacttccatggctaaacggaagggcacactcctccaagggggtggtagttctcagggtggtaaaagattgagatattcagggccagacctcccagaggtatgccataagagtttaggctttgtttaatcctctatgtgaaataatactccgtacacaataatgataatgccttcatcacgaaagaaagaaagaaaacgttaataaggagcctaccaaaatctactgagatccttcttcagttaaaggcagcaatatgtaaagattgcagccatctttgaggcattgtgaccgtaaatacaaagtgatacgagaacactccctaatatacaggcaaccttgtatagaatacttcctattccagtgcactaactttttctttgatgcatgtcctagtaggcaacatgccactacactgcgaaagagtcccaagtgcaccagctttttctttgatgcagaacatttcatgctgacattcacagatcatctgtggtagaatgttattctgcgtggttctgttttccttagttgaatatttgcctttatagtctcaatgttcaattgttctttccatgcttgtgcaggacatttggcgccatatacatttcctaatgccactgcgagatgctgcccgtgctgcttgtatttctcaagcttttctacgttcatggagacaccatcctaaccttatcttaagaaagaaaacaatgggcttggaacataaagcatataggagggttggtatggcaagggatttcactagcacagttcacagcattctgaaaaatcactcgggcattggtgtgaagagactgaagcttgacatcatctatgatcaccgcaatctcaacatatgttatctcaataattggcttcagattgctattacaccaggaattgaagaaatcactctcttgctgccttcaaaatacactttcccatgctcacttttatctggtggcattggaaggtcccttcagtatcttaagcttgtcagatgcgccttccgtcccacagctagccttggtttcttgagtagtctgacaaagctgcatttatgtgaagtgcgtattaaggatgacgagttaacttgtcttatttccaagtctttggctctgaagcagttggaactcctaaactgcagacaaataatctgtctgaagataccgtgtttgctggagcaactcagctgcctgaatgtatccttgtgcgagaatctgcaaatgatagagagcaaagctccaaacctctccacttttagctatataagtaacctagtagtagaactctcacttaaacaatcatcgcaagtgaagaccctagatatcgactgttatgacgagtccaactttctctgtcatgttattaccaagtttccaaatattgtcccaaatcttgaaactcttaccttacattcaattgatgaggtatactcgggcactttatatttgtagttatatgtgtgatggcataatctgtaggcatgcattcattccctaggatatataattaatgtgatatatctttatgcagaggattaatacgccaatggtagcttccaaattcctccacgtgaagcacctggagatttattttgaaagtcttgatcccgacaaggcctttcccccataatatgattatttgtctttggtttctattcttgatgcttctcctgttttggattctttcatcttttgtgtaagttcccatcccttcctacaattatactccctccgtcccctaatataagggattttgatattttgcttgcactatttgactgttcgtcttattaaaagaaaatcagaattattatttatttttttgacttactttattatccaaagtactttaaacacaacttttcgttttttatatttgtattttttttgaataagatgagtggtcaaacagtgcaagcaaaatgtcaaaatctcttatattaagggacggagggagtatgtagtatctatggtgaagcaatatttaggtgccattatttttttattgtatatgcaggtacaacagggagaaatgaagcatgattcagtttttggcgacgcctcaaatttgaggacgatgcctggacacaagcacgaaagcctcaaggatgtggaaatcattggattttgctctgcgacgagtatggttgagctaacatgttatttactcaagaatgcgatatcactggaatatattacattggcactaagaagggagatgatcttggaagcccatagaggggtcatggcaatcgaaagatacatcagggggaaagttccatccaaggttgagttaaccgttctcgagctttgcatctggtgccatgatcttgaacgtttagatgccttagacaaaggaaaattgatcacattccccacttcttgagttaggcgacatttaattattgtttacacgtgtacaatcagatgtttagttacctatgtaatttatccagtatttaacttcgtaatttttacatggatgagcattggaatggttggtcatggtgtctctctccatcttgctttaatgcttccgatgtctcccgatggtacttaaccagtgtacaatctgatgtccagtcaccttgtgattaaatccaatatttaaatttgttattaagagtgtgttggcagtgctctagctttgactccacctctcttagagctagagcacagccaaataattttagtagtgggctagagtgatatgaaaaaaataaagagtgattttaggaggtatcatatttttagtgtaccatgtttgatgaggtagtaggaggtacgaaatttgcactaaaaattttgatacgtttatctctgcaataaaatttctcaaaaataaactagagagaagcactgtaaaatttctcaaaaataaactagagacgtgaagtagggtgtttttacaactccaatctagagttagctcctagagttagattgaggagttggagctccacaaaacatgcgctaattttacatggatgagtgttggaatggttcgctcatgttgtctcccggggtcttgctttagccgatcagtaagaattaaaagattgtccggatcatcaatgctagagcatgaaaaattcgaagttgtgaaatggcatgtagcctagtggttgcagtgacctaagtagcaccccaaggtcctaaattcaaatcatcatagaagcgaatttcagattgaattatttaagggctaagttccctgtcttagtttaaaaaggttacatatatccagtaaaaaaaaaccttctctagaaaacaatgaaaaattcggagtttaattttggtgaaacatttagagtttttctagcttttgcagtctttcattggctgaaattaaagtcccactcaaaccgatcgagtcaggactcatcatcatcaggagaggcatgctgatttcctaatctcttcagaagacagtagattgataaatcgaaaccccccgatttttcaacccgatccggagcgaggagagtcgtcgtcgtcggcgtcggtgtcggccttctcgccgctgctacgatggggatgttggcgctgaggcgtctcatggcggcgcagcgagatcgtcgccgtcgtcgcaaggcccaagcccgtagtaagccctccctcccctcctcgatcggcctctcttttttttaaagggtattttttattggcctctacatccaactggatatatacggcaattgaaatagggaacttagctctgcaaataacccaatctctgaaattcgctcctatagagatttgaactcagaaccttagggtactacttaagtactcaggtcactgtaaccactaggctacatgccctttcgtccggtgaggtcttgtgcgagcgacaagctagctaggctcgtttgcatctatgttgagattgatctatatttatttgaccgtaacgtcttccccatagcagagtgaatagcaagcatcctttctagctccattcttttttttcttttctgtttgatttgatttgagcagggtattgtagtgctccttcctcttccaatgtggatttgttttgtttactatatatgaaaaaaaaagtagcttaagagaagataaatgatgcagtgatcaaacaatggatggcagattaagatgcaaattctaccttgactttctaattaagaattaccctgttcttttttattaagatataaattatatctcgattttcattagaacgttttttttaaactgccaaatgatatgtttcattctaaaaccttttatatagaagttgttttaaaatatcaaataaatccaaattttaagattgtaataataactaaaacttaactaatcatatgctgctaatgacttatcctgcggtgaaaaatcttcatcttcgtataagtcaaacggcaactaagacgcatttacgtacccatttatgtttagagaaacaaaactccccttaggaaacgttgcatgcaaaaaaaaaaaaatcttcactttgttgttttcttctgttagtgtctgtattattcattattatacattatttgttgcagatggagtaattacttccatggctaaacgaaagggcgccttcctccaaggggatgatacttctcagggtggtaaaagattgagatattcagagccatacctcacggaggtaggacataatattgattgtgaaatatttattatacgtagcaagtaaaaatatatcattgctctaacttgagtctgcatacattgagtggacctatgctaagccaactaaaaataagcgacgtattttttttatagtattttagtactttgttataatgtgggcttagcaaccgtaaagtcataaaccgaaagagtttatttttctttttaaaaaaactagcatatgaatatttgatttttatatttttcttgttcgaggtcttacctgtggggggagctcccacttttcgtgggtctcatatgatagttggggacggtaaccaccatcaccaccactatcttcttaactagtcatatccccgttttttaatacatgacgtcgttaactttttgatattcgtttgaccattcgttttattaaaaaaaatgtaattattatttattttgttatgaattgatttgtcattataggtttttaagcatgacttgtattttttttatgtttgcacaaaatttttaaataagataaatgatcaaacatatgtttaaaagtcaacgttgtcatatattaaaaaaatagaggtactatatgaaaaaaactgcatgtttcaaaaaaaggggaattcctctttttttttctcagttaataacaaagaagcacaaaaagccaaatcaacttgatttattgctaatatttgcagatcacatgtggtacaatcttatctgtatggccggtcctatttttcttagttggagcaaactatttgcctttataatcccaatcttcaactgttctttccccccacgcttgtgcaggacatttggcgccatatacattccctaatgccgctgcgagatgctgcccgtgctgcctgtatatctcaagcatttcttcgttcctggagacgctatcctaacctcatcttaacagcgggcacattgggcttggaactgagaaaaaattggaaggttcatatggcaaggtatttcgatagagttgatcacattctgaagaatcactcgggcattggtgtgaagagatttagtgtggtcgccgcaagctcatatgtcatctgaacaattggcttcagattggtatcgcatcaggaattgaagagatcactctctcgctgcctccggaatacagcttcccatgctcacttttgtctggaaggtcgcttcagcatcttgagcttgtcaattgcgccttccgtcctgtggctgggcttggttgctcgagaaacctgacgaagctgcatctgcattctgttcttatcacggatgatgagctagcttgctttctttcagagtcttttgctctgaagcatttggatctcagcgattgcagagagatggtgtatctgaagataccatgttcgctggagcaactcagctacctggatgtgtcctcgtgccgtctgcaaatgatagagagcaaagctccgaacctgtccagtcttagttattctggtaacctagtagaactctcacttggacaatcatcgcaagtgaaaaccctagatatagaattctatgataaggccaacttcctctgttatgttattaccaagcttcaaaatattgtcccaaatcttgaaagtcttaccatacattctgatgttgaggtatactcgggaactttatatttttagttatttgtgtgatggtataatctgtagccattcagtcagtccctagaatataaccaatagagaaattttacagtctttgagaagtatctcgagatatctaaattttatactaaaaattttggtatctcgaaataccttatctggagatatcaagttttatactagaaaatatgatacatctcagtgcattctttcttgaggaattttttttatttataattttttttattaaaagttttacaaaaataattttccattttgaaaattgacggaaatagtcgcctaccgccctctgggagggcga

SEQ ID NO: 28445 - DNA, 7073 bp, Oryza sativa
ggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcattcgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggtgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgctgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgatgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctcaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggccccc

SEQ ID NO: 28446 - DNA, 6740 bp, Oryza sativa
ttcaaaatggaaaattatttttgtaaaacttttaataagaaaaattataaataaaaaaaattcctttcttgagcatatggtaaaattaccctaactaatatgatgtatatttatgcagaggattaatacacctatggttgatgccaaattcctccacctgaactacttggagatttattttgatggtcttgatggcgatgatgaggccttcccctagaatacgattatttgtctttggtttcagttcttgatgcatctcctgttttggatactttcatcttgtccgtaagttcctaattatatcggtatctattgtgaaccaaagcactttttaggtgccatcatttgttatactatggaggtgcagcagggaggaatgaagcatgattcagtttccggtgacacaaccacaattttgagaacaatgcctggacacaagcatgagagactcaaggaggtgatgatcattggattctgctccgctacgagcatatggttaagctaacatgtcatatactcgagaacgcgacatcgctggaaactattacattggatactgtatgtgatgtggatgatcttgaagatgttgggagatgttgcacgactactcttcgcaaaactggctcatgctacccgctaagaagggagatgatcttggaagtccatagaggggtcatggcaattgaaagatacatcaggaggaaagttccatccaatgttgagttaattgttcacgagccttgtacctggtgccatgatcttgaacgcttagatgccttagaaaaggaaaacggccacatcattccccacctcatcttaagcttgagaacatttcattattgttaaaacgtgtataatcgcatgtaaggttattatggtttcagtcatgtgttcggcactgctcgtgtgatgtctaggattgggagtatataaaaaactatcgtatgcccgatatgtgtggaatttttttaatttctagcaatttgtttttcttcgtacataaatcttgagacgatccaatggtcagttggtcataaatctgagttttgagggcaaaaaacttagaagtttttgaggaaatctatttttaatatggtatagatatcctggattccaataaaagatctttcacatttcctctgttccaaaggggcccgagcatctttcaaatacatggattttagaggatttttatgtaaattgaattatctcgtcgtagaaaaattctgtaaaaattttgttaggtcttctcctcctccgccgtctcgtgcgccgatgcaagcggcaaccggcgaaatccccgcggcaaccgccggattccatggaaatctcgccggcgtccgccggtagccgccgcggtcacccaccctagtcctcccccacagctcgctcgcgccgctgtgaatcagtgaatgacttccggtttctcgcccgactccgcccagtctcctcccggttttcccctctctgagctcgccgagcagatctgccggctggagagcggcgagcacaaggaggaggaagccgccgacgccgacgccgacgcggtcggcctctaccatctgatggtcgacgagaggtggatttctgctgctctgcacttgtactcttatccgattctttttttttcagtctcttagatcgaatttggattgtattctactgaaatcacacggttttcgatctcagtgtagttgaaatcgccggttaccgctatcagtgttagcagattcagaacttctatgctcggtgctgtggttgcttaatagttactgcttaatttcatttcatttgagcatgtatgctttagcaatagaattactgtccagtaataccatattaagagttattgctaagtgtttgagcatgtatgcttagcaatagaattactgtccagtaataccatatcaatagttactgttaaatgttttctgagagattttctgttattctgtctatggtagaactgaggcagttggtggttcagacaccataatggcatcacctccagcttctgcctcaaggccactggatcctgcatgggttcatgcaaaagtaattggcaattcaaagaatgccttagcatgtcttcattgtgggaagaagattggtggcggtggcatcacccgctttaagtaccatcttgctggaattaccggccaagttcaagcctgcaagaaggtgcccaatgatgtcaggcgtcagatgaagcaacttgtcaatgagcataggtcacggcatgacactcgagatggccactattcaggctttgaagaggattcttctgatgctgttttgtcgaatggaagctcaggggttcaacttaggccgtctaggaagcgaagaacagggtgtgtttctccgcaagctgctgcaggctttgaaagaacaggatacgtctctccacaagctgctgcaggttttgaaagaataggatacatctctccactagctgctgcaggttgcgaaagaacagcatacgtttctccacaagctgctgcaggttttgaaccaagcaatgatgcattgttggtatcacgagacttggttcaacatagcatggatggtgtggaagttccaaatgatctgttacacaatgctagagttgctatggcaagatggtggtatgatgcaaatataccctttagtgcagcaaaatctcctttctatcagccaatgttagacgccatagcatccgctggagcaggtctcaagggaccgttgtatcatgacctacgcgggccattgttgaaacatcttactgatgacattcgcgaatatcttcatgatatgaagaaagaatggaatgcatgcggttgctcacttattgctgataggaagaagaatcatggagagagttcaataataaatttttttgtatactgccgacgaggtactatgtttttgaaatctgtcgatacttcagcagagaaagcaaatttgcttgagatctttgatcaggttgttagagaagttgggccggaaaacattgttcagtttatcactgatttagatccgagatataagactactgttaaggttctggaagaaaggtataaaacttttgtttggtctccatgtgcagcacgttgcattgacttgatgttggagaatctcgcagatcctagatattttcctatgattgatgaaactctaaataaggcaaagaagataacccagttcatatataatcatgcatgggttttgtcattgatgaggaaagaattcacaggtggtagagatctgtgccgtccagccatctcaagatttgccacacatttccttagtctccaatgtattcttaaatttgagaaagagctctgccaaatggttactagtaacaaatgggtaaaatcaacttatgctaagggtggtgtcggcaaagaggttgcagctatgattttgaatgcccacttttgggcccagtgtaagcatgtagtcaaggtcactgagccactgttgtgtgtgcttcgactggtggatagtaatgaaaaaccttcaatgggttacttgtacgaagcaatggaaaaggcaaaggaattgatcagggcacggatgatgcataaggtgtctctttatgggccgtatgttagagtaattgatgctaggatggagaaacaacttaacagtccattgcaggcagcagggttgtttttcaatcccggaatattctttagtcccactttcaagatgcaaagctatgcacatagaggacttgttaagacaatttcttgtctggtccctgatgatgatattcaagataagatatttctccaacttgaggagtataagaaaggaactggtgactttggcctaccaattgcaattcgtcaacgtgaaaaacttgatccaggtaacaatttattcctccatgtatacttattacattgattatctgaggtattttaccggtgtttatggaaaataaacctgaattcctcgaactgttttttgaatatatggatttattttcattctcacaatgttacatgtttgtttattagttgcatggtgggataactttggcaatggaactctcaagctccaaggtcttgcaaagcgagtccttggccaatgctgcagcgcaacaggctgcgaaaggaattgggacattttccatcatatccactcaagaaagattagcaggcttgaacgctcaaggctaagtgatgttgtcttccttcaatacaaccagaagcttcgggaacggtataatagtctggaatttactgattaactaactatttgctaatatgatactctcatcatgtgattgtctacttactaatattggtaacaatcttgtaggaaccttcacaaacacagagatgccatcgacccaatcagcattgacaatattgatgttttagatgaatgggtcagtgaagagcctagccttctttgcagagatgacctgaactgggagagaatagacgcaccatttgccgagccgacttctgaagacgaagaatttgtcgctattgatgacgaggaggctccaacagcgtcactgtcctggccggcagcagcagcagaagactcatattgcccaccacctgatcaagatccctatcagtatgtcacccaggaggatggaattctacctttctgaaaccgggaacttctgctctgtagcgaactgaaaactgtcattaggacacacatctagctaatgtcttggaaaacttcctgggcatggatttgtatcggtttaactgaatctgtccagttaggaaatgagaagtttcaatctactgctgaaatcatttacagtctgaggcatgtgcaaagcttattttccatccccccccccccaccccccaatcccctcctgttggttttggatgcttcagagttcagacttaagctgtgatgccaaaacctggaaggctggaatttctgttccatagtgaactgagctgtcattgggacacatatattaggttctgaaactttccctgtgcatgaattggtggcattttaactgaattctagacagttcggaaattagtagtataatctgttctaaaataatgttctgttccaagtctgtgtcatgttcagagtttcttttccttccctgtatttttggtcttggattgcagtgcttcaagaaaaaaaaacacaagaaagttaccttcacccaacttgtacattttttagatctttcaatctgtgaattatgtatgataatatgatatcaatacctgtggttaaaaaaccaatacatgtgtgatcacagcaactacttaacgaacaactccataatataatgcacgaacaactccataatataacgcgattgataatataatgcacgaacaactccataatataatgcgattgtgggtgctttttgttgttatataatgcacttggtgctttttgttggagggatgtttgagcgtatcaaatcaagtaatcagaaggagctgacgccacgcaaaatttagaccagctctaccaaattcatttctcttactggttccaatgtggggatcaaactcaattcgattatagctagattttaacagaggagatagcagatagctagagtaaaattcggaaagaggagaaaaacaacattcgctactctaatcaaacaccacgagcttctggtactcctccccggcgatggcggcggccatgaccgcctccgggttcaccacgccatcgttctgcaagaagatcttgaggaggttcttggagaagccgctcaccatggccaccccgggctgcgtcgacgtcaccggcgtcgacgtggagtcgcgaaggttccagaacacgatctgcggcaccgcgtcgccgtagccggcgctcccgaacttcctgcagatggtctcgtagtcggtctcccagtggttggtcgacgcctcgtcgaactccatgtcgctgaacacgaacacggtcctgatcatcttctccggcggcagcctgccgtcgacggccgtgcggaggatctggtcgaacaccgcctggaagttggtgttcatgcaccagtccatcctctgcacgaaccgcagcttctcggcgagggtcttgcccttgatcatgtggagctggggcctcgcgctgaaggtgatcaccctccccgcccacggctcctcgctgagctccgacgtgagcacgccgagcgccacgcacacgtccatcggcgtgccggacatgctcccggacacgtcgcacacggagatgcagttgcgcagggagcccttggcgcggaggtcgtccaccatgcggcgccactgcagctcggacacgtcgtcctcctcgccgcgcatggcggcggacgcgatctcgtgcggcaggagcgcgcccgccgcgatcttggccttgccctcctcgacggcggcgaggtactgggcgaagcggtcctcgtcgtgcttcttgaacagggccttgtagcgcctcatggccacggaggcgacgcgggtgtagggcagctcggaccatcgccgggcgctcatgtacacctcggggagctggagaacgtcgcgcagcggcaccagcgcttcccggcggaggcggcggaggacgctgtaggcgtagtgctcgtccgagagctgggcgtagtctgggctggagtcgcgcgggaagaggcggcgggcgatggcctcgcagagcagcgtcgtcctgtcaaacgacgatcccggcgtggggcaccacttggcggcgagtccgatcttcctccgcttgccgccgggggccagctgctcgaggtcggaggcgaggagttcggc

SEQ ID NO: 28447 - DNA, 1531 bp, Oryza sativa
tgctcgtgcatccacagcgcggcggcgtagaacccctccttgttggacttgccggtgccgcgcacgccgcggaggttgcagacgagcttgagcgcggtgagcgggtcgtgcgcccacgcggcggcgacgaggccgcggacgcggtcggcgggcgtgtcggggacgacctggaagaagaggtcgaggcaggggttgccagagttggcgtaggtggcggagtcgttctcggtgcgggccttccgcggcgtcgccttcgtcttcgatccgaaggcagcgggaggaccaggaggaggggggttgaagttggcgtcgagtagctggaggaaggggtgggaggcggcgtcggcggcatcgtgcggcggccgcgcggctcggatcaccggagggccgaggaggcgggcggcggcgacggtggcggcggaatccatggaggcgatcgttaaaacttcaggagctaggcgagactgcgagaagggatcgctctggatttccgatctatataggccatggccttcttatttgggccgcaacgggaggcccatgaagatttccttccttatcctgtgccgttgattcgtaccgacatagtggttggacggatgagatggatttgaaccgacattagtgatttgaattgaaccgacctgattatgcatctagtctgggtttcatgcgagtcgtgctcgccacgcacgcatcgcgcatctgcaggcgggcgaggcggccataataatatccacataggaaaacttggggtagtttaagattaaacttaattttgcaataaatgttacattaatgtgcgattaactctttcttacactatatatatgcaacgtgtacattaattttgcaataaaacaaggagaactaaattattggtagtgttaaaccttagataagttttagcactaccaatgttctggtaatgtagtatcaattgtaatagcttggtaaaaattggtaacaatgtaaatgcatagtagcatgtattattcaaagttaccaaatatttggcaagacaagttttggtatgcaaccaaaaaaatagccctatataattcatacattcatacacacattttttttgcagaagaaaaaaaaagagcagataaaaacaaggacacaaccgtataactgtacaaaacacgttgtgcgcaagatatgatgcacaaagtctacaatgcgtgtaaggctaaaggctagatatttgggccgggctcaatgcaaggcccatagaaaaaaatgccttccttaattgtaggctcggctatggcaattagggcggcgtaaatccagatcttactccgttgatttgaaccgacatagtgattggacggacgagatggctcgaaagtcgtgcatgcgagccgtacgtgcttgccacgccatcgcatccggaggcggcgccgcggcggccataaatctcaactaatcgatctctctccttcgcctaatctgctcccttcctccgattcaaaaaaaaaaaaaatccaccgaaacctcgccaccctccgccggcgccgccatg

SEQ ID NO: 28448 - DNA, 44636 bp, Oryza sativa
cgtctaccgcgtcctccacgggccccgcgacgaacacaaggaggaggaggaggagggcgatgaccagaccgagtccgaggatggccgccgccgccgcccccgcctccgcttcaagcgccgctgcatcgaccatgccgaggcggcgaaggccaggctgcagaaggaggcgcagctcgcgcagtccgtgctctcgcggtacggctcggacgtcagcttccgcttcctctacgacggcgtcgccgacacgttcgccgagctgctcaagtccgacgtcgagcacatgcgcgccggcgagaacgccaagatcgggctcgcggccaagtggtgcccgtctctccgctcgtcgtacgaccgggcgaccctgctctgcgaggccatcgcccgccgcatgttcccgcgcgagtcgagccaggagtacctcttcctctccgacgagcactacgcctaccgcgtccgcaaccggctccggcgcgaggtgctcgtgcccctgcgcaaggtcctcgagctcccggaggtgtacatgaccgcgggcaagtgggaacagatgccctacgcgcgcgtgccgtccgtggcgatgcggcagtacaagggggcgttcgagaagcacgacaagtcgggcgtcgcaggcttcctggacgaggtgcgcaccgggcacgcgcggctgcatgtcggcgccgcaatgccgcacgagctggtggccgctgcactcaagggcgagcacgacgaggccgccgagctccagtggcgccgcatggtgtccgcgctggcggcgggcgggcggctgagcaactgcatcgcggtgtgcgggctgtcgtcgggaggcgacgtggcgaagccaccgggcgcggcggccgtcgcgctggggctgctgatctcggagctgagccaggatccatggaaggggcgggtgatcaccttcgacgcgacgcagcagctgcacaaggtgtgcggcgcgacgctggtggagaagctccggtcgctggcggcgcccgtgcgcgccgcccccaagggcagcagcctgaacctgcagggcgtgttcgaccgcatcctgaccgtcgcgacctacggcgggctggccaaggacatgatggtgaggagggtgttcgtgctgagcgacatggagctgaacgccagcgcgtggcgggtgcaggacgagctgaaaaccatcaggtccaagttcacggcggaggggttcacggcgccggaggtggtgttctggaacgtgggcgcgccggcgtcggcgccggtggtggctaccgaggcgaacgcggcggtggtgagcggctactccaagaacctggtgaggctcttcctggagtgggacggccaactcacgccggccgccgtcatggctgatgccatctccggcccggagtacgactcgctcgaggtggtggactgaccgaatccatcctctgcttccgtatgataagagacgatcagtagtagcttgtgtgagtgagatctagtgagtgttttctgcactttgaatggaatgagtttgctggatgcttaatttggttgatctaatgaatgaaatctagtgagatatcacgccttggctgatttctcccactcttttctttgattttcgaactgattaaattagtagaatcatccctggcgtaatgtgattgcacgtttcttgattttctgtttcgattaggagttgcatgggcagcttaattcccagctcacactaatcaacatacattggcgcaacatgttatgttatcataagctcatacgccttcgatctaagcagtaattttttaagatgctcaaaatgatcaatagaaaactaattggttcaagatgccccaaagaaaacgaattgtaaatttgtaattggcaatccactccagaaaaatacatgttaaagtgccatatgcgttgaattcgagcaggctagccgaatatgcgttgaattcgagcaggctagccgagcaataaaaatgtaaagcgaaattaaagtaaaagacaacaacataaactgataaacatggatacttagggtattctcaacccaatgattaggatagacataaatgaatatgtcttgtatgagacatggtttctacacaacatccaagatattatgtgagataagtagcattaaaacattatgtgagataaatagcattaaatttaagtatgaaatagtagtgtttgcattagaagagtagtgtctagtattagtttcttgatgatatagagtttatggaaactatatctagtgtcttgggttgggaatgcccttagaactatttcagtttgagcacatcccctgttccattggaaggatccatgatgatgcaccaacaggatttaatttgtgtgtactagttatagaatactagtgattgtgcagtaattagcactacaaatatttgtgtataaatatttgggatacagttagctctactttcttttctcaagcttaattcattcagtccagatccgcgcagcatgttagaccgcaaacctctactctcttttctcaagcttaacgcatgttaaaccgcgaggtcgagctattggagtttcactattggggatctcaatctgactgcgaaacagggaaatcttttatagtagtagctagcaaaagaactaggtgaaacggtatctatatacagtactaatacgaacatctctgaatattctcacgctagctttacacttgaactgggaagccaaaattctggaacgcccaatccgcaagctgaccggagctgaacatccaaagctccgatgcaaaagtcggatgagcacttgagcagtgacccggactgctcttggcagacgattgtttctcgtcaattttcgaatttcaaagcctctaattcccctgttttgcagaatctcttcaaatttcaatcaataaaacagaattcaatcaatggtattcctgccgcagatcggcagatggtggcctttcgagcacggctcataagttgggccggtaacgggttccccggtatccgattagggcccacctcgaacaaacagacacggctgaatgtggcccaaccacacagctccaaagtggtagcatcatcgctacaacaaagcccaggcaaataaagccagttccaaagtgataatctctcatgtgatgcggcatacccaagaattattatatggaccaaagctcttagtgctgccataactaattatggttgtgtttgagagaagaggattggagaagattgagatgcaaaagagataaatcattatagcataattaattgagtattaattattttaaatttaaaaaataaattaatatgatttttaagcaactttaaaattttgttaaaaatataccattagtagtttgggagacatgtgcaccctctctttgctcacttgaatgttgcctaatctcaatgtactactccctccatctaaaagtttaagccatatttattttatcagcaagactaaaaagtaattaattcatccgtcatgtgataaaaccaaacaactatacaaatgcatgcatgtaactaatgagtactaagatgacagatgacttcttggattccggtcaaacaatttaatttagcatatagtgactacaaatgtaccttagacttttataaaaatcagaaaataaaatatgccttacatttttaaatggatggagtattagggcccctgaagaaaaaacataggaattttagaggttttcaatcctatagaaataattcctatggaaggataatcctatagagattttggagaaaacttagcaagagctcagagctcttggaaaattcctttgaatctctctctcatccgattcatgtatttttcctagggccaatcaaatggtcattcctatgttttgcaattctccattttatgcttccatttctattagaatcatgtgttttcatatttctttgttttttctcattccagtgattctaacggtccttaagctttgcttaattaatttgttctaactgtttcagctttaacactcttaggtcccttttgattcataggaaagttagatgatttttggaggattttattcttatggattttttcctagatgatcctttgagtcaaatgaatagataaaattgaatcctatgaaattcatataaaataactaataccatgtaagttttggaaaaaaaaaatctaacatgaggtttaactttcctttgagtctttatctcttatctaatttctgtgtttcacaatcttattaaaatcttacgttttctcggtcctacggattcaaagtgtcccttacgcgtatgccttaccgtaatcagccagctctttactgtactacgtgtataccagcgacaccggccttaattttgtcctgtagctgcccatccaccacccagatcagatgtccctgcacgtacggacggacggccggattgtcccttaaggcgacgctgcggcggatctcggccgtccgtgcgtccgtccgcttcgcctcgcaccaaaccaattttctcctccaccaccgtcagctgcgggccgtacgtgcggccgctgcgcctcactccatccgtaccgcctctgctttgtttttcatggaggaggctgataattaactactaatcaacaaatcaactaaaagtactttatatgtaaattttatatcaattggtttaaaagctaaggcagaagaagaaaaaaagctaaaatcaacaatgaaattaacttttacaaattaaattttggctgcagctaatataaaatggttgagtacagactgaccgttgagtacttcttggcccatctaattcaatggaacgaaatttcaaaattgaatctactttatttagttgaattaggtgggtaaaatatatgtcatgtttaaagtatatttagtgataaaacaaatcacaataaaataaataatacatgcgtagttttccttaataaaagaaaaggtcaaataacatatctaaaagctaacagggtcatatatttagaaaatagaggtagtatatgggaactgaggatcttgttagataatgcatatgcatggaatggacaattggtatcccaagataactgtcttaaattctccttgtggccaaaagaggctcaccggcggccattggtcaaaagcctaaaggatcagtcgcttgagcatcaaggttcagggttgtgatcattccttgctaatactcatctcttacataaaacaaatcaaacgccggtccatcatgatgatgatgatttgatcctcaattcttttaatcttactggtctaacaacctgtcaacctgttaccgattcttatcataccatgtctgaatgtccgatgcctgttctcaatttctcattatgaactttgcaggaacaatatgtactgtcctgtttccttttgagattagggaaaaattgagattactaaacatcggttgtttcagctccactgcaacctgtccttaactccttattgagagttcagatcatgaactcagatagacagacatctttgctgaatcttctcaagttctgaagaaaatggaaggcttggctaccaaatggatcctggtctcctggaaagaactgcagcaaactcactctcacgaaaggaccttcttccttgtccccttctacatctgctactgcaccttctctctctcacaaaatcaccagtgctgctggatcttgctcatgtccatttttactgctgcctaaaagaaaaataaaaggacatggttgcagctgctactgccatttggagctctgctgctattcattttgcagtagatggatgcatcgattaacagacaggcacaaagtacagaacttgggagttttgatttatttatttattttagttttgaaatgggaaagaacacagataagggattcgaaattcaaatcctctagtataacatattattctgtcactctcaatgatatatagacaatcatagaaatttcaccttaataaaccaaaccacccacctgataattaaatattattgttcaaaaaactttggaagtttttgtttgcatggatgtgctatactttgtgccatacaattttggtttcaagaaaatgatctccctacaataacgagcaaattgtgagtgttttttatttcttaaataatggatagaaatccgacatctacattcatacgcggatatacacagccagcgtctttagggagaaagatataccttggccaactatattggtttatccaggaaggagaaggtggttgcagaagctaaaagcagctagtagtactatagagagagagagagagagagggctggtgttagtttggttgagtaaagtggccacacatctagatctaaagcagtagcttctaattaacacaatgtttattgggtggaatcatgtggagttactgttgcaattgcttgctttctagtgctcctatagctgtacaaagcaggcccgaaggcaaagcctcatagcttctctatgatctaacttgtgcctcttcttccaacactctcttaacaaaaagggggtgcaaatgcatatctaaattaaaactaccaacaaattgtccagaattcggtttatataccaccaaaaggtgcactaatactaccactattgccattcacttttttgtccatgatatttagaatgaattcttttagtaaatttggcaaatataaacttgcagtatcaccattggctgtttttgtccataattactcctatttaggaagagttttctaatatataaaggggacaattataaactacttgggcacacagctattgacaggctgcacatatatacttggcgcatattgggtccaaatttgattgattttgacaaaaatggctatacacagacacacactcactacatatggacaaaatcaacttatgtcactaaacccatttgaaataaataatgttgaagttagttctgaagattgtccaagaacgatatacataattttctttctccatcctacactacaaaaaaaaaggattccatacattacagccttgctgcacctgacacagcacgaaaagaaaataaaaacccttacagataattggcatgacaatggcacagtaaatgcaagtaaatgggtgtagaaaaatggagtgaaatgtcctttgcagctgtatcttctgatatttacctctccatgcagtaagtacccagctggcttttattacctgaagaaatgtgggtatatatatagccagccgttgggggaaagaatttactcctgcaacgtttccattcttgtggaggaattcattaagaaacatttaccacaagcccagagagaatccgaggttaaattactcacttgcaggtgtacgttctctggccctttgacttcactgctgctgctgccatttcatcttagtccctttgcatcattcattctgaaatccaagtatgcgtcccagaattctgtccctggcgatgttcagatatcatatcacacagcatattaataaacattataattcttttatcacatatatagtataggttgtgcagtgtagattaagaacatagattggcatgttagattctactactgcattcaggtgaaaaagtttgagactgaagaatgagaaagaaagttcagtaatcagtaataactactaccattgttgtcttatcagctgcagccaaagttttacataccattttagagttgattttgagggattcatttttcaagattagcttttaaacggcgaataataaagatataaaagttttacctataaattatttccgttgcttcgtttatttttctacggcttatatagatgaaccaaccagacaaaaatgagcaattctacggttcttgagaatgtatcatgaggtatcaaaaatttagtataaaatttggtacctagttaccatgaggtaccaaatttagagcattgctaccgtccagcagatggtactgaggggtaccagtaactcccggtactgaagtaaatcggtccatccatcgcgatggggtaggatcggaaataagcgaaagatcacgagcccatcacgtgaccccaattttataatagaaaaagtggtaccttatggtaactcctcaaggaccgtaaaattgcaagacaaaaataagtgaggaaactgaagttgcagacagatcgacataacagaacacgtcttcagaatcctcaactctcgcatcgcatcacctctttctctcctaggataaagcggcatattgctgacctgttcctgaggcaacggcacagaccttaacaacccatgtgacctatgcgaggtgagcttttcaggtattcattctctctcattcactctgtctctctacctatctctgtcttgatcaaggcccttctctttctgctctttcagagacaaggccatgtttgctgaactgaatcctgaaaataactgcatgagcttttgatgctatggaattccaagtagctaccacctgtcagtcatttggcaagttttgcccaagtgtgactaaaatggtctgtaaaactgtttcaaatttggattttagttaaacaagttggtgagaaacatctgcttaattagcttcagtctgaagagtgccataatgcaggagcacagtgtttcatcagaaaaagaaaggactgcactttgatggtgttaactgtagactgacaggcaatgtgtatgtatggcactgtttgtgacttgtaaaccagaagatgtggactgaccaatgtaacagaagacaaaaggccctgagaaagcaatacttggagcctaaccctgccatgatccatgaactgcatgttcttgtaactgcaaacttggatttttgcccggttttttcgtcatgatacgacgtttcgttgtatagataaaacctggaggagtgacaattcttttaagtagtttgtatggatgaacatgaacaaatgaacagttaaaatttggacccaaggtattaaaatcctgaaaagttaatatggtaaaaaggaggttaaaaccatgtcatgtcctgatcaacagaagattctccctgtctgttctctccccaacactggggcagcacggccaaaattacactcacgatcagagctattttctttgaataattgtggattaacagacaggtgtccagtccagcccagagttgatatagtttaattagtaaatcacgtacggaaaaaatttcaaacttgttaggatttcatatgccagaattaacaattatggggttacctgaattgtaagaatgctgctagatctaccaaaattgtccatgttaatttcacggtgttcatgcacgagctagttagactcaccaagccattaagaacaattttcttacaaaaattcttaaggacaattaggacaaggatccggcctaaattgccctgatcatttttaaatacgtaaaaatctacaagatcatgcgaagaggccatgagcacagaagaactgaagatgataataaatggttttggtagctatcataattaccaagatttctgtgaatttttcttacaaccattatttggcttttcacttccatccagtaacagcctcctcaattctacaactacaaattctccttcacacaaaggcataaaaaataagataaaaaacacacataaaaataacaccttatttatacgaagaactataatttatacgatggccgtggacaccagtaaataaattaagaagaaaagaaaaggagaaaaaaagaagaagaaggggaagaactccaagaattctccaagaaatcaaccaaaccaagaagccgggcggccatgggaaattatactggccagatcgcggcggcatcaccacgcccggatccgcttcttcggcggcagtgaccggaacacggcggcgaggtctcgcgggacgtcgacgaacaccaccggcgacgacttcctcttccccgccgccgcagccgccagccgccgcggcggcagcggctttcgcggcgccggcgggcacaccgccggcggcctcagcctgctctcctccgacgtcggcgtcgacggctcttcctcctccgcatccgcctccgccaccacctcctccttcggcggcgaaggcgaagctgagacctccgcctccacggtcgtcggcggcggcgacggggtcgacaaagcggtcctgatcggcggcagcgccgggagggcatcgtcggcgggggactccattgctgcctgctcgaattggcggcgaattcgcgcgagaaattgggcggagtgggatcgaattctcgttcttgcacgcgtgcaagaagtgggtagaagaagaagaagagagagagagaggagtaaggtcggggcggtagcgcgaaggcgttaaatagcggcctcttcaatggaggagagagaaagaagggtaaaagtaaaaaaaaaagaagaagaagaaatgaaaagaaaagaaaaggaattagttatgagggtgtaatggtaacttctggggtttacaatgacaaattgttataataggacacagacagtaatgcattcttactcgaggtgaattttccatgattattggagatttggaggtaatttttcaagttttgggcaggatatatatgtactacatccctatatgcattgcacaagttcatatattgtatgttttctgaaaatgtatttattttagcaaaatatatacatgggcctaacttaaattactaatgcaacttaggtgaacactcatgtaaaccgtgataaaaaaaggtcatctaaaatcacacaataaaatctaatatgttgatgagatgatgatgtgcaaccttttcttttttctaaaaaaaaatcatgtccaagttcgacttcgtttgtggatcatggaaatggcaaacttcaaaccacaacacaaccatgtcgatttgggatttttttaatgtgattctagatgatctttttttttaccccaatatatatagtattgccttctttccatgccatgatcaattgaccattacattgtgtacaaatcacttctccaattccttaccatcacactgtgcccacggtgcaattgtagtgagcctaacaataatcacagagagagagagagagagagagaaaagagataaatatacaggagtatacagagagaaaccatgcatgtatgcatggcaccaagggaagaggacatagaggctgagttgaaaagggagatgatacagtacaataaagccatatgctgtaaagttgaggcttggaaggtagaagagagcattatgatggatggatggatgcaaatgcagctgatcatgcagaataaggagcagcagagtctcttcttcttgttgttgttgttgttacagcagcaagcagcagatggggtagaagagggcaaaaggaggaagctagagaacaagaaggaaacaaacaacaacagggaggggaggggccttttctctgccattctagttctgcagtttttttttttcagctcaggcctgcacattgatgaagctgtaaacagttgcagtgaggactgagctgaggccgccaccaccaccttccctggtctgctatgccctgacaaatcggtcattttagtttcggtatgactcaaatttctaataagatcgagtctatgggaaaatataccatctgtaatatattaaaatagagtcaacataaaatatgtgtttattgtgttttttaggtggatttagatgttggtgtatttttttctctataaactcatttagagccgaagaaatttaactaacaaaagaattataatatggaatagagagagtagtagccaattaggcattgtattgccagccgaggtggacctctgcataatatttctcgtggaaaaaatggttaatgcactttaatttatttttttagtgatcaacaacagtgaaaagttagctaggtgcaggcttgtcttttttctaacaatgtttttcttcaaactattattgttttttgggtgcgggtgggggaggggggaggcggaattgtggagacgactatgtcagtggggttgatgagttggcgggtatgtatcgtcgaatgaatagaaagatcaatataatcacaacatgactataatagagtcttgctatctatataaatattaatgtgtgttggcgcgaagtgtacttcaaactcatgaaatttacttaatatgtgcgcaggcaattttcgttagttctatcctcgcttatccatccgagaaaagaaaaccaagtaactaataaaattccaccaattttacagcttggacaattaccacaaatttacagctaacaaatctaagatatctcatcatagcaatgaaaatatgaatggcaatggcatgcaagaataggatgcttctcatccgctaaaaatggtggttatgacttcatgagtaagaccagatcaccatgttatactccctccgtcacgtttttgactttttatttataacgtttgaccattcgttttatttgaaaaattagtgtaaatataaaaaaaagataagtcatatgtaaagtacttttgataataaagcaattgacaaacaaaataaataataatttcaaatttttttgaataagacgaatgatcaaatattaacaaacaaaaactcaaaaagacaagtaatatgggacggaggtagtaacatacatgtagggacggtgaaaaggacagtaccctccaattatggtggaatttacggccaaatgtcactggcttgcagtggaagaggaggggaaaggaagaccagatctgggctccagccccaccggatccaagggtggttggcagctacaaaagctggtgatgccacatgggaagtgttgggttggaagggcttaatccttctcctctccctttgctttctctaacttcttgtttattttactcctaatctttgattagttaacctctccctgtacttttggtttgcaacattgcatccatcacttttgtcctctccaaggaaatttaactgtactattgtggacagccatgcctacagcccacatattctcaatttgcactagtgctgccgttcacatttcgatatcaacatcattagaaatgatatttggcgagttggaacaaacataaccaattatgtattttgacagaggtcggagatttagacgaaagtaggccaattaggacttcagccctaaacttaccttcaaaattatggttaaatcctcttaaatcacaatataaattttgggagaaaaaaacgaacaactcattagttaagccctattttagccttacttttggataatttctgaccttaccactggcaggacaatttcgtacatacataaaggaagtggtgtggcattactatactgaattaagtatgtgagatgagatgagcatgttcaagattggaagaagaggatatatactctctccgtcccataatataagggattttgagtttttgcttgcactgtttgaccactcgtcttattaaaaaaattgtgcaaatataaaaaacgaaaagttatgcttaaaatactttggataataaagtaagttacaaaaataaataataatttcaaaactttttgaataagacgagtacaaataaaaactcaaaatctcttatattatgggagggagggagtatatatatgtatgggacttgcaatggaagcatgcagatactaatcatgtggggccatgtgagtacgtgatcgccatgcatgtgagtgcccattgccttttcatgcaaggatccgatgtatatggatacgtaaactaagcatcattcccatcattagatagcgaataaactacttccctaattggagtacggagaacttgcatggtttggtctacttttgtgtatgctccctccggtcaaacatgttcattttggatatgtgatcttgatcgttaattttctacttaatacaaaacacattgacaaattaaatccaaaaaagatcatgcatagaattacctatatgaaattagttcttctcttagaacaatctctacacatggtttttgaagcattatccaacttaaatataaaaaggtattggtgtttaaagtttttaaaagtttgatacgaaacttgtccagaacgacatattattgtgacagagtactatggagtactactactctgtgtagtacttcctccgtcccaaaatgaagtcatttttgaggttggcacgggtattaagaaagtaggtgagaatgattggagaaagtgtgtgattggttgaaaagagaaagtaggtgaagaagaatggttgtgattggttgagaggaggaggtaggtgaagaaatagcttcattttgggacaagacactgtgctagaaatagctatattttgggacggagagagtagcagctactaatggcttgtcagtagaacttgtggtataagttttgttaaacctttttcccacattgagtagaggagtacatgggccagtccagtcctcacttgactaaggttgtactatgataaggggacattaactgaaaaaaaaaacaagagtatttgactttgtatgagcgttaacaaccaaatttggtaatatcgacatcgggaaagaagattagatcgaagtaaagtcgaaggcggagatctatttcggaaacagagcaggaatcggctggagtccagatcggctatgattaggatcagctgggtctgagtcgggctaggtaagccgatgtagccgattccgacaatgcaacttgatgtatgataccgggttgaattgaggcgctttaaggtgattgctgcacatgggtagagtcctgagaaggcaattgtatctagtaattaggatgttttatgtaatttccttagagatatgtttgggcaaaagtctgccgcaaagacttatggtatcttagagtttgttagagatagtagtcatgtccgttatggacatatcttgtaattctcgggtataaatagacccgagccctatgtaacttttaacacacacgttcaatacaatctcggcgcatcgccgcctttttgctttagttttatttcgacgagttcttgctttcgggttgagctgcatcggtttcgatcttcaacaagaggtaaaacttgttatgatgaattatgttctcgggattagtgcttccatctttatgatactctaatcttgtctatgtaattcgtcaagttatcatatatcttacataatcttcgacaatatcgtcatctaacctacaatcggctaacatctgttaacagaaggcagccgatttggttaaataacaacgttgacctagattatataagatatctaccactctataaaacttccagcaacttgattgtatagatattgttcttcttttcatacttaatgctgcatcagttgagtttgatttattaagtcgtgcttagaatatcaatctttagcctgccctctggtcgccgattagagtaccgtcggagtttcagccgatcttacctgatttaatcgtatttgctctatatgcttcaatgatacattaaatatgccctttatgtcaagatcttattgcatttaagtatattaggctcttgtttgatatattttacttgttttagtatcctgatatagagtagtatcggagtattagccgatacatgctagatctatctgatcggctatgctattaagatatataaggctgttatcaataaatattttgatctaagtgattcatactgtctcggcatggcgaccgatctatcccagtcacttgatttaagtatatatcgatataggagctatatattgttaatatttacaaccgatcgaacagatttagttctttattgcctatttacaaccgtcgatcgattcacatatgacatcggctgccagatagataaatgatgtgtcatcggcacctagccgatcggctatcatttatagatttaactgcggtttctttgcttctatttcttgttaattacaggatcaaatcaactggtacgctcatacattcgaaggcgagctttggacctgcactgaagttaaacagatctcccaagcctcgtgttttctgtcaacaatgaggtaaaaaaataatttacaagaggcaacatgtttgaaacaggtaaaatgacggatgatgtattgtttatagggtttaatttaactaaatatattcgttcaaaaaaactaactaaatattatagcactatcatacgaagctacctgatactatatactccctccgttctaaaaaaatccattcctagcatctcaaggtagaattagtggagagtgagaatgactaagactatgttcggtactggaggataggaacctatcttctccgcacggaaaacggagcggtcattagcgcgtgattaattaagtattagctttttttcaaaaatggataagtatgatttttaagcaacttttatatataaactttttgcaaaaaaaaaatcaccgtttagcagtttgaaaaacgtgcacatagaaaacgatatgggggatttggaaactcccggtatcgaacacagcctaaaatgttccggtactcgtaaaggaagtcgtttaggacaatatttaagtcaaaccttgggaatataaatcatgataactctcaagttgttaagtttgaaaacgtaaaaagtatatgaatagatttgtcttgaaaaatactttcataaaagtatacatatatcactttttaataaatatttttatagaaacaagaagttaaatttgtgttttggagaccgtatcgctgttaaaaacgacttccttttaagtatagtgttgaagttagttttctccttccaggcgagttatgaaattaattttttttattcgtgtctgaaaaacccttccaacattcggtcaaacgtccaatgtaacacctaaaaattttcttttcgggaactaaacaaggccacagtgagctacatactcctatatgctcaagtgaaatcagccggaatacatgccaacaaaaaatggccggaataaaggccaattattagcgagctgctttggtaaacccgtaaaatgtgtggatattgtcatcaccaattggaaatttaggtgttttttactcgtgtaattaatcatttgtgacgacggcatttgaattcagaatgaagtgcacatgattaaaaaatcgattggggtttgttggttagcgtcaggcaaaacaagacaaacatgctacatttatctatcttgcttacgacatgtgtacaaatgcatagtgctactattagcttgcactgatcagttaatcaagatcacctcagatcaacaaagtaaaaaaaaatgaaaatctccagccacaagcactgtaaatcacaagctttcatcaaactgttcatcggcagggcatcttcttctttccctttgcctgtttactttgctattcgtcagaaaggttaaaaaaacacacacactaaaaagtgcccaattaggcagcaggacaggtttactgttccccatttaatttttattggagcccattgcataataattcacctctagctacctggtactcctgtactcctagctatagctggagtagcttagtggctgtttagattccaccctaaaactttatatcctatcacatcgaatgtttagttatatacatggtgtattgaatataggctaaaaaaatattgcatagattacgactacttcgcgagacgaatcttttaagcctaattgctccatgatttgataatgtggtgctacagtaaacatttgctaatgatggattaattaggcttaataaatttgtcccgcggtttattgacgaatattgtaattagtttttgtatcagtgcccgaacacactatactacaccatatataatacccgatatgatacgttaaaactttataccctgaatctatacgcacaaccttatcaagagttcccccctcccccgaaatgatatgatatgatatgatatgaagacgatgtgctacgtttgtcgtcgtggtcgtcgtcaaatcacaatgatccattccgacgtgtgcatgcatgcaatgcacgcacgcacaattattgacgacgactcgatcgatcgccggcggggaccggccggccatctctgagaacgcccaccagccggagacgggaaagaagactcatggtcccgttcttttcggattatcattcacacgtttttcaagtttctaaacggtgcgttttatgtaaaaattttgatataaagtttattaaaaacatgtttctgttccctaaaaaaaaacatgtttccaaagtaattttataattttacagtggcatatttatttatttatattttcaaatagctaccataaaaattggataatccatcgaatagctatctgagaccgtgcctgtgaggacgaaggctcgttcgaatctgcttaggatgaagattaagtacgtgtgtacgtaaaacgagaaaaccatcaatacaggatcaattgcattttatttatttcaaacttaaaaaatgaatttgtttgatatcttaaagcaacttctatatacaaaacgtttgcacgaaacgtatcgtctagcagtttagaaatggagttagctaaaatctaggttaaatcgaggtggccgccaaggagagagagccaaagaggaccacctgaagaaaaggcgatgttttgcagctagtcacctccctcccttttttcctgcacgcatgattcacactgcaatcctgcgtgcactgtgcagtggccgccggcagtgcttgcttgtcgtcgccggccggccatggccggggcccctcctcctcctcatcatcggccggccatggccagccagccatcactagctctcatcctctgcatgtgcacagtgtgacgcctgatgcagtagcctgaataatctggcaatgtgctgcatgaagaattcagcacattcagattttcagggtttgaatttttgatggatttctcagcctgtccatggctccatgcgctgcgtgtctcccaaagaagatggcggcagacagggacaccgtaccttctgcaccttctgctgcattttgcctgcaaggctgcatctctctgcaggctgctgctgatgctcttttcctctcccctttcctgcaacactgaattttggttaaccctgatctgtaattcttttcagaaatttaccccccccccctgcctctttgcaggttgatcggcagtagatcgccgagattgattggttggttttgcttttgcaatggatgaatgatctattttgccttttcgttttactgttgaggagtaaattcaccggtgccagccagtgacagtgtgagtgagtggccgccttttggtgatccgatcaagctgagcttaggttcggtagccgcagagtattgcagtaagctgagctaagcctctcgtttgcagtagtgcagtttatcccttgcaggttgcagctgaatttacagtttgggagctcattttgtcgatctctctctccactgtcaattccctgacacgatggttgtgtgcaatgatcgatcgccctaattgtaggagtagtgagttaaatcaccacagtttttttcttgttttttactcttgtcagacaaatagcctcattggttacccatatttcctaataaatcaaaacgacttattgagaaatataaattaatttgtaggcaaaatttttatatatttgttcataacaacttaaaaaccaatgaaaaaagaaatcacgttaaaaatattttaaaatcaacttcatattcaagtttaaaattcaaatttggctttttctttggcttgttagaccaaccgatgggctcatagactaatcaaagcactgttcatatgttctcattgaataaaaaaagaaagaaagacatctgatgagtaaaacagtaactctgtggcccatcgaaaggctgctagctcgggccatgtgggccagcctgattggacatcggcccaataatgacacggtgaggtcttttcatggccggcccatacaaagtgaatttcacccaagtcaccaaacccgagtcttcaaagttcaaactgaacaaattagctgactactagtaattcaaatctgaatatttgactaaacatcatgaccatagaacgagtcaaggcaaggaaaccacctcgttgttccacgactaaccacgagtttaacatctggtttaccaacgttcttggccatgaaatccagtagatattttctgaagaataaatttactagtaccactgatggcccatccattattgtcagctgcgacctagcaatactttttcagtcctaactataattaccaggggttaattcaagtaattactttcgagttaataatctcggcaggtaattctggttaaattgagagaattaaacagctagatagcacaaggagaacaggaaaaacaccaataatctcggtcaagatttccggttgatgctgtactacaaagttcatgcgtctcgacgaagaattaatgctaagggaaatattctaatcctagagagcatctcccaaacatgatagttaatcaccaccaaacctagacttagtaccttgtctaatccaagaaatgccctcttgcttgcacaattatcttctcttgtaggcctaatatgccatgtacggatcgttcaggtttaactcaggcatatatgccttggagggctggctcatggcaactaggcaaagacttgagaggaggaacaagtcttgtgtgagattaattgcacatgccaacctctgctagtcctcgtcaggtagcgcgtaacaaggattagcttaattagccaggtctcatcttacctctaatcttattccatattaatgcagcccatcgctagctatggtgcctggtcagcatgcaacccaattcttcagtagtagtacagtacaacacataggagtacattgatatgtactagtgcatataggctatgacatcaaaattagaagttaggttgaaattggaacgatgtgacggaaaagttaaaagtttatatgtgtatgaaaattttgatgtgatggaaacgctagaagtttcaagaattattttggaataaacacgtccatactagtaatgggtacacatactcctacattgctaggtgtacttgcctatttatttttattttcaaattacaatacatacgtcaccattaagggctggtttggtttgtggcctaaataggccttatcaaattttattagtgccaaattttggcatgactaattttggtaaggtaaagttgtgtttggattgaagccaaaatagtctaagttcactattgaaatggcctattttcttaggcatgccaaaatttgacttcaaaccaaatagacactgaacactattgaaattgccaaatattggtaagcctaatttaggcctcaaaccaaaccagccctaaatacacacgcagatcatattgtgggtgcgttactttaaagagaggaaagaagtggattaagaagatatataccgcccccatcgtttggtttattggggaataagcgaaacgatatatttgcaaatgaaaaataatttatgaataaaacttttatatacgtgtttttagcgatctaaaagcaaatgttgaaaaataaacttcgataaaaaaaccctaaaatcaactcaaaattgaatgttgaaaatttaaatttttgttgataagcctaagcataagcgaaaaattgaggttgcgagtcattagtgtgtgattaataatgtattaattattttaaacttaaaagataaaagatagtttaatatgataatttaaagcaactttcatataaaaactttttacataaaacggtctatttagtaatttgtaaagcgtgagcgtggagaatgagaaattttcttctctgatctgctgcaaacaaacgcaacctaagcatcaacacgtgcgcacttcgctagcacatgctaaagagacgaaaattagcatcatatcagtaaccttcctaaattcatattgaaatttacttgggtatatgtaatatttgtagaaaccatgatttaatctctagtggatatcagtaaccttcctaataacccttttcgccgcatattctcatggagcagctactactactatactagtactagtactccctccatactcataaataaagtcatttacgaccatgtttaagtcaaacattgggaatataaatcatgaataactctcaagttgttgaatttgaaaatataaaaattctatgaatatatttgtcttgaaaaatattttcataaaagtatacatatatcactttttaataaatatttttataaaaataagaaattaaagttgtgttttagagaccgtgtcgctgtccaaaacgactttctctatgagtacggagggattacgtagtttagctcctcctcctcgtcgtatgtctgtacagtataaatacgaaaagtgcatacgtgtagtagtcgacactttgtcaggtagcgcatacgcgtagcgttcggtgatgatgagattgagagagagcaatcgaatcgaattgaatcgtgccaagccagcagcagcagccagcaacctcgtccaaaggtcactgtcgccatgtcaaggaacgtgtcaaaacgcctcacactcaccaccggtcggtcaggttcaccaccacctcatcggccttagccactcccaccccgctgcgtggtggggcccacctgtcagtgggggaggggtgtaaacttcctgtaacggatagggacggcctactgcctgctcatcagctttgatcagcagctcagcccggctgcgactgcgtcttgtacgcccacagaacggagggaagccgtcgtctttgggtggacacggtccacgcaccgggcgtggggggcacatccgttgtgtgtctgccccgggatcctctgcggagggtggtcgtttagcccttcagagctaagggggtaaatattagcatttatatgctttttatggcttgccactaatgtccactgaaaaatgggtaatacataaatgaataatatgctttttttgacttgccactaatatcaaatgaaaaatgtgtaatacataaatcaattaatttatgtacaaaacatttacataaatcaattaatttttgtacaaaacatataaccaccaacctaatttagcattatcttagacaattataagggagtaagtgatcttagacaattataagggagtaagtggggtcataaatttaaattctaaatttgaaaattttgtatggtaactggtcaattactgtatttcagtgggaatcggaaattcttgacaaaccactattctggacctaggtcgagatctcatagctataactcttgatttcattggcacttcttgtttttatccactcaaaccaacataactcactagtgtcaaactagacatttattacactcgatcaaaagacatttcagtagtctcttcctttaacatattaaacaaccatcaatacatgaagcaaccgtgctagccataccagcatatactctccttattagatgtgtcgtattatattactacccaagacaacaatgaaattcaaatttagatttttttttctagtaactgactatggattatcttgaggggccgaaaattctagagaaaccgatattctggtcccctagtcaagatgcttaaaagcctgaattagctgacacgtttttgtttttttttttgctcaaaccaatgtaactctctccggcaccaacctaaacgtttattacactcgatccaaagatattacatcaattatctttcttcaacatattaaataattatcaatacacgaaacaacggtaccaaccacaaatactctcttcatgagatgtgttatattatatttgtgtcctagacatttattacactcgactgaaacagatttcgtcaaatatctctttcttcaacatgttaaacaatcatggatacacaaaacaactataatagccatgctagcacacacgacctttattcaacacgtcatattatattactacccaagacgccaataaaattcaaaatttgaaaatgttctttttttgtctagtaactggtcattggaattcatagccttggtcaagatgtcatagctgtagcgcttgaatttgctagcactttttgtttttgattttttgctcaaaaccatcgtaattcgttagtgccaaactagatattcactacactaaatcaaaagagttttcatccattatctttcttcaacatattaaacaatcttcaaaacacgaaaacaacccgtgaaaaccatgccaacatatactctttattacacacgtcgtattatattacttcacaagtcatcaataaaatacaaatttagaaatgggaaatttttttagtaatcggttattagatttcactgagggactagaaattctagagaaaccaatattctagtcccctcattagctataaggcttaatgcttgaatttgttggcacttctatttttttgttcaaaccaacataactctccagcaccaacctgaacatttattacactcgatcaaaagagatttcgccagttatcttccttcaacacattaaacaatcatcaatacacgaatcaaccatgccaaccataccaacacacaatctctttattagacacattgtattacattagtacccaagacatcaataaaattcaaaattgattttttttcttcttcttgtaacctaccattggatttcactaagggaacggaaattttggagaaaccgatattctagcccaccggccaatatgtcatagctataacgcttggattagctagcacattttgtttttttcactcaagctagcgtagttcttccgctcaagccagcgtagctcttccgcaccaatctagatgttacactcaatgaaaagagatctcgtcaactctcttccttcaacatattaaacaaacatcaatacatgaaacaaccgtgccaaccataccaacacatactatctttattagacacgtcgtattatattactattcaagacatcaacagaatttgaaatttgaaattgatttttcttttctagtaacctgccgttggacatcagaaattccagagaaactgatattctgccttctcggccaagatgtcatagccataacgtttagattagctagcacattttgcccttttcgctcaaactagcgtaactcttccgcaccaacctaaatattcattacactcgatcaaaaagataagatatttcgtcagttctcttccttcaatatattaaataatcattaaacgcacgaaacaactgtgccagccatacagcacacacaccctttacgagacgtgtcgtattatatattactctactcccacgcaaacacacgagtcggagtaggtagcacccgatattctggcccacccggtaatatgtcatagctataacgcttggattagctagcacgctttggttttctcgctcaagctagcgtagttcttccgctcaagccagcgtagttcttccacaccaatctagatgtctattacactcagttaaaagagatttcgtcagctatcttcctcgaacatattaaacaaacatcaatacacgaaacaaccgctagccataccaacccatactctctttattagacacgtcgtattatattactattcaagacatcaataaaatttgaaattgaattttcttttccagtaaccgtccgttggagatcggaaattacggaggagctaatattctgcccccctggccaagtagttgaatatgacttgtgaagtaatttagaaatgtgccaagcgttatagcacgttttggttttttcgttcaagcgagcgtaattcttccgctcaagccaacgtagttcttccacaccaatctagacctttattacactcaattaaaagagatttcgtcagctcttttccttcaacatattaaacaaacatcaatacatgaaacaaccgtgccagccataccaacccatactctttttattagacacgtcgtattatattactacccaagacatcaatagaatttgaaattagaaagtgattttttctctagtaacccgctgttggagatcggaaattccggagaaactgatattctgccctctcggccaagatgacgtagccataacgcttggattagctagagcattttgtcttttttgctcaatctagcgtaactcttccgcaccaacctggatgtttattacgctccatcaaaagagataagatatttcgtcggttctcctcctttaatatattataaataatcattaaatgcacgaaacaaccgcgccagccacaccagcacacacgtcttttaataaaacgtgtcgtattatattactccgctcccacacaaacacgcagagtcggagtaggtagcacacagaaagagtagtctatcgtacagaggttgcagaggatcctggccattgcggccccgtcctgcctacaaagaccccgctcacccaaagctttccctgctgtcgttgctcttatcctatcctacgtttgttgctcggttgcttctcttctttcctctctgtcttctgtcttctcttcttcttcctcaccaaagttgttgagttggtgtcctgttcttggacggacaagggtgtttatccaaaagaaatccatcccgagatttgcttctcttgcgcgcacactggcaccgtccggatcgctgaatcttgctggtggtggtggtggtggtggtggtggtggtgcacggccatgtcgaggcggtggcggacgtgccaccggcggcggcctacgggttccccggatcggccaagagagggaagcctgaggaggtggtggtgctgatggggaagaggaggaacgaagggttcttcatcgaggaggaggaggaggaggaggaggtgctgacggagagctcgtcgatcggcgcgccgtcgccggcgagctcgtcgatcggggagaactccggcgaggaggagggaggggacgacgaggaggaggtggagagcaagctcaaggcggaggatgagcaggtcggcctcggctgcttggacgccttggaggaatccttacccatcaagtgagtcaaagatttcttttctttcatctttcttatcagatctttttttaaaaaaaattatgtaggtagatgtaggctttcacacacacaaaaatggcgaaatttgtgcaaaacacatgatagttttggtgcttttgcttttcttgcatctcttcatgtgtactagtagttgctagttggtcaagagtattttgatgatttgagtccatagctacctaaaatggcgcggcaaacatggattcctttccagtaatcgttaaattgcagagccaaacatgatgtactagttagcaccagattagcattagcagcagacatcctattatctttagtactatcctagccatgtcggatgcaagaacatgtactacatgcttattatcatctcttcctgaacaaacatgacagtgacggttccaatgtcaccactgatcacatcctcaaaactgcagttgacaaaacaagatgctgcagaattagctctaaaattgcttatatttttttcttttttttcgcgacgctcagaaagattgtcatgtcaatacgttagaagtaaaatagtttttgttacccaaaacaatcagccagacgcttattccagggaagggagaaaaagcaaaacaagaactgaagctaggaaaagactactaaaattgcttttatatatatatatatatatatatatatatatatatatatatatatatatatatatatatatatatattctgaataagaagctctaaaattgtttgatttgttcaggagggggctctccaacttctacgccggcaagtccaagtcgttcaccagcctcgccgaggcgacggcgtcgccggcggcggcggccaacgagctggccaagccggagaaccccttcaacaagcgccgccgcatcctcgccacctggtcgcggcgagcctcctgcagctccctcgccaccgccacctacctcccacctctcctcgcgcccgaccacgccgtcgccgagggcgacgagggtgaggaggaagacgacgattcagacgacgatgagcggcagcaccgtggcaagaacggcggccggcgagagtcggcggcgccgccattgccattgccgccgccgaggctcaccttgcacacccagatgggaggaatggtgaggaggaatggaacattcaggtcgccgaggtcgctctcactgtctgatcttcagaacagtggcggttcatgttagtttgctgctattagtacaaaaaaaataataatttttacagttagagcaaaaagccattgatctccttttggctggtagagttgttactgctacaactgcttactattagtaactatataattataattataattgcaatgcataaggtccaagtttgttgtgatctactatgattctagtaactctctggtttttctgagtcctgacctgattaagaagacatgtatcaactatgtatatctatgaactgacctaacttgaggctatcattaactaatgatggtttatgattagtcaattgctttgcttttgatgatctctctttctaatttgtttctgtaaatttgatttgctggatgaggaatcccatgattgtagtagcatcaagttaattgctccatggccagtgctttgcttgctttgtgagttgtggggagaactggtgagattggaatggccaatgagggagaatccaagtccaaaatgcctaatcccaagaaggaggagggaaaaaaaagaggcacttttgcatgtagctttgttttgatttgacacaggcggcaaatacatacatcattttctctctctttttccctgagcaatctgcgtggtgtgtagatctaccacaacagaatactttaaaatggagcaaaaattcgccctctgttttcaccaaaaacaagaagcaaacaagagaagaacagcaacgggttgccacataaacaaacttgaaatgcacagcaagatgatgccatccttttattttagtaattttttttgtgttttttgggtaagtgggtgagaggttagtagtaattagcatctttattgacggcacattgttttcacaacaaagtgtcaatgaccttgatgattgctcattctactctatttatatgattaatgatcttggtgatgatagctgaagatcctgagagaacagacaaagtgtgtgtatctgacagtctgaaacttgggtgaaacaggatcctatatcactattctactaattgatgccctaatcttgatggttttgttcttaaatgtaagcagatgtgcttagaaatttggagttaatcaagtttggtaggaactagagagagaaagaggggggctgactgtacatgtgcaatgtgatcttatcctgttgcacaatgggtactgtaaaatattctatgtggtactatgcattagcttttcttaatgctttgcttgtaatttttaatgcttggtagttgggactgcctgtctttccagccaggggattggaaaggtaggttagcttaaatgagttatctaaaaccaaaagctcaaatgagattagctgtaggagctagattttttgtttcaataataagaaaatactatcagtaacaaaagcaaacatggctagcatgataatatgaaaaaaaaaagggccttccttgtaaggtagagacatgctttatcacctacttgaatcttgtcatttatatgatttttgtgtgcacatgttgaaaaaagaattacttgagtatagctagaacattactttcataagcgaccactctatagcatagataaccaaatgcttggttgagaatggaacaagagaatgcatgtcttctagatgagagtgacctttggtgtgtgcatcatctgcagaggcaacggacgatgaaaatgaaaggcaaacaacatgctactagaaatgtggtgatcttttcttttttttttaaaaaaaatgtgattatcatttccctggaattaagcatgataatattaaaaacagaccatacatgccagccaatcagccacattgtccttgtgattgtgggtcagtacttgcaagcttagtaagcagattaactggatttaaaattagaaaagtatgaaactgaaaagaatggagatagaccactcaatgtttggcacaggcctggtttagttcctaactttttcttcaaacttctaactttttcatcacatcaaaactttcctacatacacaaacttccaacttttccatcacatcgttctaatttcaatcaaattttcaattttagtgtgaactaaacacacccatatttgtacatctctcgtcatgaaagagttcaacaaatgaaagagtccaacaaagggtccacaatttcgggggaaaaaggaaatctgaaattccagggtctgctggtgggtccctatagcatgtttggatgtgcctttggccaaaattattaattttgttagaagttagcaacaatctgttcatattcagcaaaaatctggttggattctaactctcccattcaaaatccccaaatttcagaatttggtcccaaaaattggacacatgaaacatcttcctgcatgcttctcaatgctgtacgtatgggcaaaaatgactccatttcatcatcttataaaatctatttatttatatatataatgcgagatgacaaatatgttatttatgattatgtttgtgcacgccaggtacaaaacgtggatccgctagctctctcgttcacattttgtttgtggattgtggtcaagagttgagaaacgaggacaaaagatattgtacgtatcggatcagatcgacgtcctacgtaatgtacgatatccatcggcatctcagctttaagtttttttttccggcctaatttattgagacagcttttgtcaatatggatcgatgccactactgtaccaaccacgaattactgtgtggatgatctggcaccagctccacgaattactatcagttgtaacctaacaccagctctacgagggtttcgttatctagtaaccaggcttaccgcagggtgttataatgcaaaaaaaaaaatcgaaaacctcactatttttttaaataaacaaaaagtaaatttttagtaagtaaatattcgtctggtttaactagtgtttatcgcggctatcgggcttatcatcagggtaatgggtaatacattccctcttatgttggtaaatcttggttctactgctccaggcatatgtactccataaaaaaagcaagtggcaattttaaaaaacggtgtcaaataagtaaacctgaaaaagtagaatcaaatcggtatttaggtttcaaaatagggtcaactgagcaattagggcataatataacccttacctacccacctatcaagtgatgcatcaatcttcatccaattcattctcccaattctataggggtattctaattctctggtcccgttcttttctctaacaagaattggatgaagattaagattttcgtgacacgtttttcaaaccgttaaccggtacgtttcgtgcgaaaattttctatatgaaagttcctctaaaatatcatattaatattttttttctaagtttgtaataattaaaactcaatcaatcatacgttaataccatctcgttttgcgtaaaaaaaacttaatcttcagaaaagaacaccaccggagagtagtaagctgaaagtactcgaggcccaacacatttatcaggacgcaggtgtagtggaattgagctgttttggcatgcaaaagatgggaggaggggagtgcttgcgtccacgactcggcggcagatgggaagcagaagctgctgcaacttgcaaggcgagatcagctgcaagtactagtagtagtggaggtgtagtggatagagatgcactttgtggtagcagtagtcggcactgcacggcggcgtcatccccagatgaggagacaaaacaccttggtcgttgccgccgagctgtcacactgatctcacctgtagtaagcaagcgacgtcgccgtgtgggccgtgcattgtgtcggccagcctatgttgagattgggccggtcaaaaagcccactagctctgtccttcaatgcatcgcatcttagtgggccaaggccagcccctagttccatcggaatatgttcactttagatccagtttattgatgacaagtttacattagatccttaaaccgctataacagatataaggtgtaccttacaaaagtagagcaccctaaactgttttgtgctctatttcgactgacgtgacgagttgactgaggttaacccgaccgagttggtataggatccacatgggccccacatatgaatgcgccagtcttcttcctactttctctcccttttatttcctcatttctcaccagatcgagaggcgggagggcactaatcttgttttagacccaacatttaaatttataaactaactagaaaattgcccgtgcattgcaacgggctacttttaattttgttattgttatacggtttgattaaggtaaaattcactgtgagaattagcttgaatatatatttttttataaaatcatgagctacaataaggagtccgatcatctcaagttaacatgcaagttttttaaaaagagatttcttatattacttcttttgtatttctgtaagcgaacgaacttaaaacccgactcaaatatgtatctgtattttcaaaagcaaatgaacttaaaaaccgactcatactcggatgacgtaacaaattatcggcaaaaacatcttcagtagtttttctaatagtagagaaatgttaggttctttaccacttttagattcaatgttgtaagtgaatctttagtaaaaaaaaaacgttgtaagtgaatcaggtcctggagttcatcttcgaacctatatccggcgatttgcctcgagttgaagttcaatggaagtgtgtttcctatcaaaagagattaaaaaaaaattgcatatgggcaccgtttcacccacgcgcgcgcacggggcgccggattgggcggtcgggggcgtccgttttttctcctgcccgactccaccgacgcgcggattttgtcggtagagcggtgtactcattgcactgcacacagtttcgcacaccgcctgcttgcttgccaattgtcatcggcaacatctcctctagtcctctttggtttgcccatggccaattgccgtgcacactccctgtcacgtgtcgccattattattgtctaaacaaatgagcatgcagcagcgagcgagatagagagagaaatacccagatctgcatgcaaattgcaaagggcttctgaatttatgagttgactgacgccgtgtttagttacagaataattcttcaaactttcaacttttttatcacatcaaaattttcctacacatataaacttttaactttttcatcacatcgtttcaatttaaatcaaacttctaattttgatgtgaactaaacacagcctgaaaaccgctaaagaaaattaagggggggggggggaagaactgtaggctgggtcgaaagcaagagaaacggggtttaatgcgtcttcttcgtctcttcttcagacaggacaattttgcatgctgcggatggttgagaaggtattctgacaggtgtgaggcatttgttttggagtcattcgtttcaaattttgaagtggcaaagcttttgccatcctttcaaaaaagaaattttttttccaattttgtagtgcatcttgagaagagagtgagcgtttattcgttcactacagtactacacccaactgacccaagtctcagtcttactaactcttaaggatgtgttgttttgagggtttacaaacacttctaccggtcgtacgtataatggaattatcgattaacacataataattaactattagctaaataaacttaaaaaaataaattaatacgatttttaaaagtattttttgtgatttttttattaaaaatatattttttaacagtttggaaaacatgtttgctaagaatgaaagagtagaagttgataaagaagagaaaagaacacactcaccgttcatagaaacgtggaaaacccttctggttgtacgtctgtacatagcaagcttcgactcttgtatggtttgatggacttatattcccgatatcaattcattacttgttgtgcacattatatcagctactccaactaaatatttgaccaagagtgtcccttaaaaagcatatgtacgcatggggtaggggcgaagctaggatttaagattagggggtgtggtgagaggatatgccatgagaccgaataactaatattgatagcaaaggaggtcaaataatcaccatcaataacaatcaatgcgtaaactagtcctttaaaaaacttaaaatttagctctttaataatatcattgaaagtttaaaactagtaattattgctaaattctttcaatgtaaactattgaataatctcacaaataagtatcataaaactattgaataatctcacaagtaagtatcatctattttactttgaaaaaagatgagaaatcacaaactaattttgtagattatggttcttgctaatgttcttagacttgctaactaactaaactgataatattttcaagctatacaaataaactagataaatacttatcttagttaaccttaatatagagtaaaaacagggggtgttggcaccctccgacaccccctagtcggtgccactgtatgtaagatacttctacccctgtcccaaaatattcttatataggatgggttaaatctcatcggaagtggtaatatattgggatggaagaaattcagccaaaaatactcaaacactcaaaatacgagctgaagtttcatctcctcgtatccctacagacaagatgaaaatagtcaaaaatggtagtattttcttggaaacgggcaaatatcttttcggaaactagttacatgggcccactttgtggggcccaaatgtttatcactaaaactaactactcaatatcaatattaatacaatatagaaagaaattagaaaaagtaaaatttatatatagcaaaaaataataacaataaaaagtacccttatacgaaaatttccgatcattttcaccctacactccctactccaccagaacaggacaggccggagaatttaccagcgtacaactaactgaactaccacccaccattcacatttcaccacctgtcggctgtcagtcaagagtgtcagaacaacaacaaacccagcagtaaataaacaaattaaagccccaccaccaccacgccacgcgacgcgaggctccgcgcgcatcgcgccgcgcgggtgacgcagtgtacgcgaagcccatttatcgctagctagctagcggcaaagccggcactgacctcgtgcttgtcctctgggtctctgtccccctcatctctctcctcctcactctcctcggctgctctcctcctctgtcggtggtgcactgcttgctcgatcctctgcaatggcggtcgacccgcgccaggtggtggccgggttcctgaccctgtccatgttcgtcatgctcggcaacatgatcaagcacgaccacttcacccccgtcggcgccggccaggaggaggttcgtgcttcttgattccttccctttcccgtggagatctctctcgtctttagctaattgctcttccaggttcttggtctctgcgtgaggaattctttctttcgctgttgatttagctcactctctttgtccgggtttctttggttcggagagtagttcagatgaagggatttagtagctgttcgtgttgatttggctcgccggtggaatgcaggagtgtgattatgatttgggtttctttgtttttgttttaattcttggataattgcaagcgatctgtggatctagtggtgaaggggatcttgaacgtcttgtgaccttgactttcattaggggttaactggggtttacattaattattacctactagtcgatcagcacgttgtctgcagtcaaaaaagaatccgaagctcgataaccgtgaagaatagcactaaattatatgccttcagccttcctaaagaaaggctagttggtgggggacacatcatcagtaaagagagcatcaattgcaaagatgaaaccaaaggaggaaatacagtacatcgtttttaatctctttggatagtgatagttatcattatgaacttgatatgacagagagagctcagtctctccaggaagcaaatcatgtgcgattgtgtcatgagcttacttgttctgattcttgtatgcaaatcattgatgtgccagatttttggaatcttttactacagtgttcattttgtccaatgctcaactggtatgagtcaattgacactgtcccaagcttccagtgatgaacgattcttttgaactgactaaatttaaactgggcattatatgactgaccccaatttgaaaaccaacagttgggcttggaggcaacaggcatagaatcaaacgaaattaaaattgcagatactactgaaatgactaaggtcaacaaggctggagtggatctcccaaaggagactgctgaggagattagaccctgctggtctaaaccaagatcaagtaagtaaaatatattcttgacaagttctttagatcccaactcttgagtcttgacacattggcacttgtaatttctgcagatgttcaggagtctaagggttttgttacattctcattgactatgggccctgaataccacatctcacaggtgagcttgcaactcagagctcatatgtatagttaattactatatgtaagaaaaacaagttttgtgtctgcatattctgtttgattgaattgctggaaccccgcttgaaattttcaggaccatggtttttcttactgaatatacttctgtctgcagattactgatgctgtggttatcgcaagatatttaggtgcaacacttgtgcttccagaaattagaggaaatgagttaggaaagaggcggtatgtttcattgctagaaccttacacttttcccccctcaaaactgcacaaggctatcggctattgctatcttgtattcatatttactttagatatactgaagaatttcaaaactacaagcttttcttttccaatttataaaatcttccacaatttgtttacaattcctttcatgaattcattaaaaaaaacgtttcttctataaacatgaaaaagatgtcattcatttgcactaatgatataaggaatatacacaggaaattcgaagacatgtatgatgtggataaattcatgacgagcttggatggagttgtcaaagtagtacattcacttcctaatgcagtgtcttctaagaagccagcagtagttagagtaccaaaccgggtgactgaagagttcatcacgggaaccattgagccgatcttccaaagaaataactacttacgacttgcgactattttctcttcagtaagtttgaaacagaaggagtcgggtaacaaggacttggattcgactgcctgccttgcaatgttcagtggccttcagttgaaacctgaattttcagcagtagccaagcatatgttggacaagcttaaagaaataagcgagaaatccgatgggatggttatagctattgatttacagaccgaattgctagaaaagaagatctgtaagacgaatggaggtgcaagaagaagaggctgttattaccctcaggaagttgtgcacttcctgaagaaggttggcttctctgctgatacaaccatctacttgacggagacatggtggcacaaaagcctggatactctgaaggaggcatttccaaacacttataccaaggcaagaaaactctttcaccaattttttagtttgtatgaatcatcatccatcttctccccccaacaaaatttactgaatgctacactgaaaagctattcatagagaaacacacttaaagttcagactgaatttgatcgttggcttgtgattccaacttgtgacatacatcagtttttttttaataagtataaaccgagctggcggaattcttgacacatagttatcattcttgcaggatgatataatgccggccgctaacaaaggcgagttcctgaaatccggggattcataccttgcaagagcactggacctcaaaatctgctcggagagcgacgtgttcgtccctgccatccccggcctgttctacggacatgtcgccggtaagaggatcgctgcaggcctgacaaacatcatagttcctgctccagtgtccagcagttcagctctggcttcagagttcgtctccacatacgtgtccaagaagagccatcttgcctactcatgttactgctagtactgttcttatatcatcagcatcagcatcagcatcaataagttcaactgaagtgagttgcttggccaagctttgggtacatatgtaagtccttttgttgtatactagttcatgatgttgtgaggaacagtatcatttatgtgttacttaattgttgttgataacaaaaggagagaagcacagaattagtgtgctgaaaaaaaaaggacactagattaggcatgtggaaagagtgtgtgcttcatgtactaccaagttatggttcatcagctggaaattactccaaaatactgcttccatagaagatgtgatgtgtgaaattctcttaactttatatgcttatttcagcaatcccattctttgacaacaactcaaattaggctgtgtttagttcagcgcaaagtttggattttggttgaaattgaagatgatgtgactaaaaagttgtatgtgtatgacaggttgatgtgatggaaaaagactgaagtttggatccaaactttggatctaaacacaacgttaatcaagtttggtcctaaattacgcttattaaatctagtctcgtgatctcgagttgcggacggggacgaagacgccgggccgtacagttactcaggctcgatgttttgggattgagatcctcttacttcactcttcatatagtgaagtcagagaagcaaaggtactctaactttagggtattctcagccatccaatctgcagcgaacggatctgcagcgaacggatgagatcgatcgctacagtactttacagtaacacgtgaacagtacatgtacacagtatattcgcactgtagcacaaggtagcactaaagtcagacaagcatgtattgacacccttggtacgcaagaacaaagttttttagtaccataccgaatttttttttgtctaaagcccacataaaagaggacatttatgcatctgacataaaagaggattttttttagaaaattgattaaaatccggcttctacatccacaatggatgtacacagcccaacgtcatataagagtacttagacccgaattccttacaataaggataataaaaagtaccaaagtgacaacacttaaaagagaagactactactccaatcttcttataaggttccacccatattttgcatacaactccatgacccttgcctccaacatcttgcgatattctttcaaattgtggccatcctcttccttaaacaacaaagaccactgttgtgcccaataagtccccttgaagatcacctgcaaaaaggaattagttttggagccattaaaaaccacatcatttctatttaaccaaaccgcccaacacaaagccgtgatgcccacaaaaatttggtattttagtctaggttgaacaccatttaaccaactaccaaacatattagcaacactagtgggtggtcgaatcccaaaggttataaaaacgacattccaaacagatcttaccaaatgacaataaacaaagaggtgttgtattgtttcattagaattacaaaagcaatatttaatgctacccttccacttcctttttgcaagattgtctttggttagagtaatccctctccataagtaccacaggaaaatcttaattttcaaaggaattctaaggttccaaatgaaagtcctccttggaactacatcacaatacataagagcattatacatagaatttactgtgaagattccatttttattagctctccatctaaaaacatcattttgctctgaaaggttaactgacacaactttcgacactaggtcatgccaagccactagattatccccacgatggccctcctaaaagagacattaagaggctctgtgtttaacacatcagcaacaacaacatttttcctcctaactatattataaagtgatggatatagcttatcaaaagatgtggcaccaacccaacagtcctctcaaaacctcaactgagtaccattgtgaacctcaaaggatccacacgagaagaaggactccttaacagccataagccctgactagaaatgagagtcccccggttgcttatcaacttgggtaatacatttcttagccaaatacttcttcctaagtaagttctgccaaactccctcttcattaatgagcttatacacccatttactaaccaaacacttgttttgcagttataagttatgtattccaaggaccctacacaccttaggtctacacacaacactccatttagccagtctgtattttttttatggtcatcacattgccaaaagaatctagatctataataatctagcttcttgaggatacctttaggtacctcgaagaaggataatataaacatggctaaactggtcagctaaaaatctcaaacttatgcttagtacatttgagaaactttcaggcttgaaaatcaattttcataaaagcaaattgttttgttatggcaaggcaaaagaagtagagaacgagtatgtcatattatttggatgtggcaaaggaaattaccctttcaaatatttagggattccaatacatcacaagaaattatcgaataaagattggcagaggatagaggaagattccaaaagaaattgagtagttggaaaggaaaattcctttcggtgggaggaagattggtgttaataaaagaggacatgtatacataaaagaggacacgtatgtcctaagcccacataatgtgcttactaagctctcaccggccaacactatttgctaacatagcatccagattaaatatagtttgttactcatttctattcatattataatatgttttgaccccttcttttaatcatcaatatataagtgaattaaacttctttaactttaaccagatttatataataatacaacaatattttcaacacaaaccaaatataatatcaaaatatatttagtgttagatttaatagaattaattaagtgtttatagatgttgctacgttttcttacaaacacgatgaaacttgagaaagtttgaattaaaaattaaaatgtcttataatataaaatagagagtaattcgttttttaaggtcccacacattgaaggagaggattagtatttttgaaacagggataaattaccgtgtgtctcatgctatcaataactactgctgggcaggcagctcaatacacagcaacaaattaacattttagtagcactccaacaacagatgacagagctgaaaagggctaggattacccagaatatttcatgatacttcttggtccaaatgacaattttattagctacgtacttttacaatcgacgaccattatacaactaataatttacaatcgactagaataaatagaactgattcatcctatggttatttcagcagacgaggagaatccatctataagcttctgctttattagactcttttctccttggtcaacaggaaatctccatttgtttgaggatgtagatcccataccattcatggcattgcccttgtcacatggaacttgatcgagcaagcggattctcttcaagttcacagctcgctccataataagcctggtataatttatcatcttatcatccatcgcaaatcctgtaatctctaatagattcaagtggcgatgtttgaaatcagatgacatctgatcccataacaaattgaccttctcagcgctgtcctcgcatctgttcctttcacatggatgctgacataacttcaagcaacaaaaaccagttagataaatagtgctcaacagccaacataggcatacatcatcaagctcaagaatttggatatatcttgaatgaggtaagcacaagtttctggaaaaagaaaacgttttcgcagtagattggcaccataattttggattttataattgaataatctaatttacagtctcctttctaataaagtaggaaaaggaacaaattactatgattagttaatatggaaaatatatccatataaccatattggttctgcagcgcaacaatgtcattataactttattaaaaaaacaatgtcattatggaagttgcatatttgatagaaatgggcagagataaccagagatataacataccttgagataaaagttgctgagacgagctgcagcttcaaggacaaacacagtccagttcaggtcacattcatagaaaatgttgcaaagatagacatctctgacgttgctgaatacaggatagagaagtttaggaccttgtggctcaatccaaatctgcagcagaagaggaaaacaacataaagcagcggataccggtcagcacaggacgaatattaaaacaagaaagagaagcagtttgggaaagttttgctggtagccatgtacttaccatctgatcttggaaatccaggtataagatagttaagtttgtggcgcttgatataagctcggtcaacctgaacggcatctggtcatacgtcgcagagcaagagaggctcatgttgtgaaggcgagtaacattgccaaaacggattggggggtttggaaggcaccaatcccagcagactacccgcctaagatttggcaaatggatcagatcagctctgtcaaacccacaagtgacaatttcaagcgtgaggagctccgagtgtggggcatcgatcttgaggacaacaaagtccgagacacaagaacacaaggcaaggaacttcaggttatggcatgtgtttaggatatgggagacgtccgattcttgaaacgcgaggttgcgcagggcaagattggtgagccacctgaaagcaaccgggcaagagtgagagaatgacatgaagcgttgtctgagcagctggcaatgctcaagggtgagtttaccaacatccgaccacagtgagaactcgagcaagtcggtttttccggcatcgacaatggccccaacggcatggccaacagagcataggtaggaagggtcttcagagaggaagaaactgagctgcattcacttgataattcttctcgtgttgctgttactgctggagggggatgacaagagcaggttgttgactgcagccgtgtaggcagccatgatctgatctacattgaaattcacagcgcggcgaggaggagcaggcatgaagtgggtgatatctatgatgagatgggagagtaagcgagggagttgcagccatcttctggagagcgtgctggtccgaattgccataggcaggtcaagtctctcaaggatttgcagcagaatatcgtcaggaagcgcgctgatcctgtcatctcctacagtttcgagttcctcctcctaaagaaaacaatttatacttatttatgcagtatatatgatcagcattcagcagcagtgcagcacaacacaagagctagcagtttattcaccatacacatatataaacatggaaagaaaaaggaattcttttttttaacaaaaagataataaatctaaggacatccaaatctaatttaacattcattgtgatcagcattcagcagcacaataggcagcagtttattcagcacacacatattatatactccctccgtttcacaatgtaagtcattttagcatttcccatattgatgttaatgaatctaggtaggtagatatatatatatatatatatatatatacatatatatatatatatatatatatacatatacatatacatatatatatatatatatatacatatatatatatatatatatatagatttattaaaatcaatatgaatgtgggaaataatataatgacttatattgtgatgaaacggaggaagtacatgaaggaaatttattgtttttaaccaaaaagcgaagatggatagatgcaacaaaaacaaattaagggaaaacctaattaaggagattgcaaacgaaatatccaatctaatctaagctgcgacttacgatagcgcgcgaagaagccatagtagtggggagattgattggtgtcgatgcagcaggcaaatcaaatactactccactaggttccttacaacaagatattagtcccctggcctcgatcagatcagatcatcagaatcggctccgcttccgcttccgcttccaattccccttccgattccgagcccaatacctgctcgggtggggtgagggaggattcctttcctcccttcttctgttgactgctcgagctccagctccagctcgtgaatcgtgatcctcccatggccaaggcgagaataggtggcggctgcagcgctctctcaatctctctctctctctcatagaggagaactagcgtaatagaagtcaattgagatcctcgcatacagtact

SEQ ID NO: 28449 - DNA, 23653 bp, Oryza sativa
  unsure (1)..(23653): unsure at all n locations
ggctcacatgtcagcctgcactgtagacgacctgtgtccaatataagtatatatatataagtactccctccatcccttatatttagggacatatatataacttccacagttccacccctctactgccgctgaatttctgaatttcttttagaaataatactgattcctccgtcccaaaatataaggcataactactcataacacaaaaaccaaaaaaacatttaatcatcttcttggttgaatcaccttgaaacatgcaagcaatatgatttggaggtttgatgatataagatttaaacaaatcaattttataggaccaagagatgttaattaatatatgtatgcatgcctgccctatattatgggatatgagaaaaaaatggttatgccttatattttgggatggatggagtattttaataagaaattgtaaaagtatagatcgatcggctggcaaatttagcactgtgtcaaacacccatagttcaataggatgcatctcaaatggtcttaatatgattagctatgagtatggcaatttttttttttgaccagggagtatggcagattcggataccgttgttcgataggttgtttgacagatgagtcgaataacggttgctcgactggtttgctagcctctttttttttaaaaaaaaaatagaagtattatgcatgcactgtcacaaaagtagcatatcaaacaccctttaggcctgtttggatcccaccacaaaattttacaccctatcacatcaaacgtttgaacacctatatgaagtattaaatataggcttaaaaataactaattacacagattacgactactttgaataaaattagatgttctcttatcttacatgaataaaattaaatgtgacaattaccccttctgtaaaacttgctcttatctggctaaaagccatagcaggtgaccagccaacacctatgctttgacagcaagagatgcttcagatcaaagaaagctcgtgtgacttgttcattgttcaaagcaagggaagcaatacattacaacccaaaaagcatagcaacaggatgccacaaatgtcaggcttgcaattgcctacaagttcattgggaactgggaagaccttcatgccaaagtctagcgtcgcctctgccaattggtagatatgattttgagtgcatccgtgagatgtcctgcatattccaatttcctgtgctctccttatgtttccaagaaactatgctgtgtcatgcgaagtttctagctcagcaaggaattcgagttcgtaaaactgaccagccaacttgcatttcattgcttgtggtagtaaagcttgccaaatgattttgcctaggtgtttgtgaagaaaaaaatgacggacataattaagatgtaaaaaggattcaacacaactaagttagaactagaaaacactcatacaaatagtaggctaacaaaaaaaagtgaaaactcaccaaattgaattgaactgggaatggctgtgacaaaaatttggattccaagcaaagacgagctagctgattgacactgccagcgtcgttgcttgtacatcggaggaggtcgtctatgatccagcaagtcaagacttaccagatagcacaaaagaacagttgcatctgtgaccagtgaccactgatgagtttcctggaaaaaaatccctcgtacgaccatacggaaaatccagctgaagatccagagcaacatcgacatgcaaaacacatagacactcatgcttcatggccatttcttgtaccagaacaaaaataatacaagatttacattgatgcagtaatgcgcatgcgcacggctcacatgaaatgagaaaaaaataattcacattgaaagaatgttccacattctcatccacattcatgccagttacaattgtacatgtgcaatcagtcaggggggaaaccaacctgaaagctcagggctaagtttggtagagaccacaaaagatgaacgcgtgaagtaggctttgtgccttcttagtttggtcaggatccccacatataataaccaatgcatttgcatccccaggttttggatgatggacagtaattgtggcacctgacatttgaaaggtaacaataactcccagcgttagaacatcaaaataacaaagatgatgcgagggatcttgttatggcaagacatttagtacaatcattggttgaggtacaatcagcttttgtatatagcaccaattaatatggaaaattccaagaacaaatgaagatatattctttatggattgtcctagcccccatcaatatttcaacttcaaggacaaaatttttaagatacaaaaagacaagtttgctatgaataattattttttcacttttccttttaatttatcatttgattgccttttctcttcttttcagccttaaaacagagtgaatttgaaataggtatagtgaagaagaatgttttacatgttcttttaattttcatttcattttctggtaccagtaaatatggcatgatagtgactgttgcacaggctgtatgcatggactttgttctagagaaaaggacaaggcaacaagttgacaagggcttccactccatgataacaagtaaaaaaactggcatgtcctttgcatcactggtgagggcaagacaacaagggaagttagatgaatgctgaaaactaataaagcagagagtaagtaccttctttatctcagcaaggtcactgccattggctccacaaataaaacctatgtacttgcggggaataatgacttcagttgcattagatggtgtagccacttgatttgttctgttgagaagaacaagtcaaaacactgttctaagtaaccttctttagaaaggagaatttgccatttagttttgtttttcaaaatgggttgcattgctagaagagaactatatatgcttcgattcaatcttttgctttccacacaagttctcatgcatatacttttcaaagtcttttagcccctaaaagattaacagaatgagaaattgagaatatttccttttagtgaaaggtcaaagagaaagaaacaccaccaaatggaaattaacttaccctgccactgctccctttctgaaatctgcaggtggtactgtctcaggcatatttcttggagcttcactgtttggtgcctgcacaagatcagggactttattctaagcctacaacacctaaatcaacaagagaagtggtgtgcaaacttttacagttttctaataaaactctggtggcaaggcaaacccaagtcctggactttgatgtatttttttacgacaaatgggctttgatctttttatgatgctaagttaacatgagccaaaataggctgagttgtcccagactgcccagtcctggatccacccctgctggcaagcatcctatcgcttgtcagcaggacccgaatgttggtggaaattcatgaaagagaccattgtgcactgcacacccaggaaaaatgctgaagaacttctgcctaattccaaactgcatttcccatatatgtgtttcctacattctagaataaacgcatagtaagttacctcaggagcccaggcacttggtgatggctggtccagaaaaggtcgaggaccacctccttgttcacaaccatatgagtagggcatcctatcagcacccatgtgctccattgaatgagggggaggtggtcgatgatcgaccatatcaaaaggacccataggacgatcagctctgaaagaaggcataggatatggaggcatgcctccagtgggatgcggtggtgctggttcttgtcttgggtggtaggtggagcgtttccaccaggtggatatgggggcatacctccacctggatgtggcttcatgggaatgatgacatctctaatccttccagtgatatgaagcaatgcatcctgaatggattgaaaactacctgtgacctgtaagaagaaactccatagttacatttaacacctggtcagcaattgtcaagggaataagaataacacagctatgaataacctaagtaaactttcttaaaaggaagattcaatgaaagccacttgaaagagttgattagttgtgataaactgtggatcatttttcaaatggataacttgtgatgtgaaacaggttggccaaaattaccacaaaagagttacagcatatgccacaaagtaaacaattctgctttcttaaatttaacaggacaaagatattctgtagtttgcttctttgaatacgtataaagtagttcacttggaaatctttttcaagagcatgctttgcatacttgacatttcccaacatacttgaattgatcacatattcacagtatcacactgaagtctgaagaccttatgctcttagctattactggtaaacaaagttcacctcaacactgaacctttaatgtgattcagtaaggtgggaccctttatagtagtgttgatactttacattaaccaacacttgtatcaaacttaaaatttttgctacaagaccacaattaaagcaaagaacacactataactaggtgttattagtagattatatgcataacgatgaaaatttcgaatggacatgtaaacttaagagaccactgcggcgcacataaaacatggaacttattactgaaaattcatagcatgcacaagaacataaaatggagtggttgattactataacattaaatacctgaactagctcatcatttcgttgtgcacatcttggaatttgttcattcccgaaaattcggataccagctcctgttatttttctcatttctgcgatgatagaaccacctttgcctagtaagcaaccaatatgctgtgatggtacaagaagtcttgcagttacagcagaacttttatccatcgatgactccgagattctagaatgcacccgaagtactgcatcctgagctggagaatgcatcatctcagaattctgcaacaaataagattaaacccatcaaaaataactccagacaactgaaaacctaaggacaaaattaatcgcatatctcccatcattgttggcaggacaccgatgcacatggcatgccaatgtttacagatgcacagatctatattgtacgttgagaaaataaaattcactctccctgcataaggattttaatcacttgaaattaaacagatacttttatttataggttcagagacacacctcatgtgcagatatcacaattacacgttcttctgaatcagaattaggctctataatcttaatcgaagcaccagtttcactttgtaatgcgcgaatagttgaaccaccttttccgattatgctccccaccatttcattgagacatatcatcctgaagactatctcttgttcaacaaagaatctaggaccgggggcagccatattacttgaataattccttgcatgataatcaggcatggatggtggtaaatagcctctttgagaatgaggatctatgccaactgggccaggaggcccaaatcttccaggtggaaagttgcttgcatctggcctagggttatcttgaaggcaggttgtaactaacaataatgctttccttactgcagaaaagttcccacttatctaacaggaaaaggttaccgtgtcagaatgacctgaatttttaataggtacccaagttaaagaagaaaaatgtccatcttgagcatttcaaactataaagccgttagcaatgcaacacttaagtatacgggaaaggtaaaaagaactattacaattttagtatatttagaactgggacattatgatttcctagaactacataatcagaggtgcggaacttgctcataatgaatttgacttctatgactctatgcaacaaaaataaccaacctttaattatattttctctacaaactccttatcgataaaacactattgtaataaattatatgaaagacatcacccttatgttttcaattgctgaatcgcaataagagccaattataaagtacaaatcaggcaagatagctcatttcgaacttatttgttcatttgaacaagatgcatatgagctgaaagaaatacaggacccgtaacataaccatgaatgaactgaaacttatcctaccacctatattaaattatcatcctatcaaaaaattgccttttcattagtttgcatagtgcaatacaccgctcaaactcccataaacaattttagcagttttgcaagcaactaaggcacacgatccacctcattataagtttgaaccacctcatttcatcataaatttctagctaacggatgaacacgccgggcgcaccgaaaaattgtgatgaataatccacccacgcaatgtcaggggggatgattagatgaatatagcacaaaaaagaagaaatatctgtgagctgagttgagatgcgtacatggataagctcgtccaccggcgcagcccagggagggagctgatccctgttccggaacaccctgatctgcgcgccgctctcctgccgcatcctctccaccgtcttccctcccttccccagcacgcacccgacctgcccgctcgccgccagcatccggcagcccaccacgccgggcacctccctctcctcctccccggcggcctcgtcgcccccgaccctgtgccccacgacccgctcccacgccctcacggccacggcgggggcgtccggcccggagatggagagcacggcctcgtcgccgacggggggctggtccacgtggaggtcccgcgacgccccgcggagcgcggacgcgcggctggaggggcagaggatgcggagcgtggtggtgaggcgcttgggggcggatggggaggaggtcgaggaagaggccggagccgccgccgtggcggcggcggtggcggcggcggagttgggggagatttccatgggggtggacggttgagctaaaaccctacagcttagctaacagagaagaaatgctgacctctgcagttttaccgcaagtggtggcaacgggccgggtcggggccgggttgggctagaacgccaacccggatgggcccccaaaccccgggtcaagccccttaggagggactatgggcctgttcgaatgactggactgcggctacgccacagccagcacgaacagtgtcgtaggcacaaggcagctgctgccagccagccagcagtagggtgtgttgcctgattttacgcaaatctatatactatcaaacaaatgagagaatagtattgttggtggttattctgctactactttactactttagtatgtttaaaaattagtccttaataactttttcgatactatacaatagtataatatttgtttgaatttaatatatattgacataagcacgaaaaaaacaagaaaattagtattttacccataacaaagtatggttactttaaaggatacagtacaaatagagaagaagttcatgatatgatagcctcatccataattctacggaagcaatgaatcgtcatcctttgcatctcatgataaagtttcatcgctatctttacttcctatacttctgtatctctatttcctatactctctacatatattaaggaaatgataatttaaactttttcccaataaaaaatgataggcccatacaatgctaggtgcaaaatgtgcagcttggaactacaagggaaaacaagcatggcaccgttgtcaaacccatgttacagagggcgctccaatagttgtcgtaacaaatgaaaaacttctaactattatcaaatctctctgctccacttctttgattcgggagaagactccatcggtgttgagagcttcagttcgaaatgtttgtcagttgcattcttttgtgatgcatccttttccattgtagatatgcacatgtgttgtaaaaccctcaaaccctcaagaaaaatatatccttgatcctacaaatgcaattgaccacgcactttctttcttcaatttcctcattttttttcttctcgtttgcaatgtacatgcacttcaatagtggtctctcaataccaggtataaaaacataacgtcataattagcgggaacaagctttaatttgttttgattccctggttattggagtaatgttgtggttagaccgtattaggaactagagatctatgtctcaagctatcttgacctatcattctcgatgtaaaattcccgtgatagtcaatgtggacgtaaaatgcaccttcaatttgtgtgatgcacaaccataggatcaccttcgatgtcacctaggacatcaaggtcgtcctccgccgtagcaccaactattggaactcgttggtaacgaaaatctttcttactatcatgtcttaggcagggcaaggcaatcagggcacacacttgcgcctgtgaagtgacctccattgatatcgtgcatagtaggctttggtttaattgtgtaatatccacagagcctagcccatttctccacagccctctacttgtgaatttactctcgttcctcgcgatgaggaccccatgccaatttgctcccctctagctattacactcttcaattgtccaacttgcaagttgcgagtctttctactctaaactctgaactctgaagtctggaatccccttcacactttcacactttcacagccattgcgtctagcatcctgataataagttttctagtttttttttcttttgggattcactgttacattctattttttttttctgttttaaggatctggtttagggtaagaaagggctgaaagaaaaaggaaaaaatatattgctaatttatttgattattcaaagaaacatctatatatataaaaatctttacggtgtcattaagacaagtaactgaatcaaacagggctcttagctcaatcatacttggcttagtgacatttgcagattcatctctgtttcttgagcaattgggctgtgaaatgctcgccccagaaatggaacttttaaccacagacatatgcttattcctcttcgtctttttttggcgataactattttattttagggagcagaaagcgagcaaatcatctacgagattcccttcgggcacctaggagattccctgcgagcgattgtacgaaagtgacgaaggaaggaccacgagattccgtgggcgctacgaacgcgacgaacggccgagaaaagaaagagtagccgttacgaaatttggtgacaataactgtttttttttttgcgcaataagaggattaggcttgtgctgggttaattagcatgtgggctgatcagtaagagccagtactccctccgtccaaaaaaaaaagacaaaccctggtttccgtgctcaatgtttgaccgttcgtcttatttgaaaaaattataaaaaaaattaaaaagacaagtcatgcataaaatattaatcatgttttatcatctaacaacaataaaaatacgaattatagacggagggagtaccacactgccacagtagggctctgctgctgtctactgtgtattgttgctgcagagtggccgtagctacagccagccagttgaaacttgcagatatcatttcgaggttttctaaagcttatggtaataatggtatatgtggggctggtttgctttatgacctaaaattgaccttactaatttttgtcaatgtcaaatttttgtaagttttggcatggctaatcttggcaaggtaaagttgtgtttggactgaagccaaagcagtttcatttcattattgaaatggcctatttttttaggcatgccaaaatttggtttcaaaccaaatagacactaaacactattgaaattgtcaaatattggcaatgccaatttaggccacaaatcaaaccagcccatggttttttttactccctccgtcatataaaaaaccaacctagtaccagatgtgacacatactaatactatgaatctagacatacatatgtccagattcgtagttctagaatatgtcacatccaattctagattcgttttttataggacggagggagtacttacctactagattattgaaatgtgttctttgttatacgtttctaaaaatacatttttaccaaacaaagtttcactgtatttttcaatcagttggtttaagttatttgttaattttatctctaaaacatatctttataaccaaatcgataatccgatgcaataatccatttaataatcaaacttttcgttaccaataatttggtaaggccaggaacgcagctcattctaaatgccacctaaactaccggggctttcacacacctcacgcactcgacactttggaacagaagacaatagtgcatcgcaggtaaagaaaacgtgaacacacctcacacacacaaaatggatatcctagtctggccaaatttttggatgatctcatcgagcatttttatagatatttattttcgaatatcttatccacatctactcatcagcctaatacactcaaaagttaaatggacattatctatctagaaatatcttttccaccaaacacaccataagatgaacagatccacgtcagaaccagttgcatccaacagaagcctactcagcatccacgtcccagtgaagacagttaaaggcgtagctcccccgaaaaaacaattaaaggcatatctttatatactcatgatagacatacagcgttcaagacacttttataatattatactacctcagtcgctttgtcttatttcttagttaatttttttaagtttaattaagtttaaagaaaaatatagtaatattttcaagttaaattaacatactagtgaaactaagttggtgttatagatgttacttttttttataaacttaaataaaattaaagaagtttgaatagaaaaaaaaatcaaaacatcatataatatgaaaaaagagtaagattttaaatatttatatatttttaaaaggaaaaaaagatagcaatcaacgaaacgacgacactaccggtttaccacgccgcccacgcttcgccagggccatttcgtctttaaatacggacactagaccagaggcctacctgtaacctgttcgtccagctccaaagtctcaggcgcacgcgcactgacagcagcagacagggcgagcatggcggcggcggcgaacaacggcggcgagggcggcgacggcttcgacgtgatcgtggtgggggccgggatcatgggcagctgcgcggcgtacgcggcgtcgacccgcggcggcgcgcgcgtgctgctcctggagcggttcgacctgctccaccaccggggctcgtcgcacggcgagtcccgcaccatccgcgccacgtacccgcaggcgcactacccgcccatggtccgcctcgccgcgcgcctctgggacgacgcccagcgcgacgccggctaccgcgtgctcaccccgacgccgcacctcgacatgggcccccgcgccgaccccgcgctccgcgcctccatcgtgaacggcgccgccaccgaggtcgcctccgacgcggcggcgccgtggccgtggtccggggtgttcaggctgcccgaggggtggacggcggcgacgagcgagatcggcggcgtgatgaaggcgaccaaggcggtggccatgttccagtcgctcgccgccaagaacggcgccgtcgtgcgggacaggacggaggttgtcggcatcgccaagcaaggtaagacaccgatcgatcaagctagagcttagcttagcttagctatgtcgtcgtcgtcgtcgtcttcctctcgcccaaccaaccaaccaaccaatctcgttggaagtatccgggtagctcttgcatgattgcaactttgcttgcatcacgtgatcagtcgctgccaaccaaaatgccagcggcaaccaccatgcgagagctgagtgagctcctgctccttgcgggaccattgttcttgttgaatagtaccgcaggagagaagataaatattgaacacattgtactgagtcttagagaaccggtatacataagagatacatatataaatatggggaaaatatgtagtgcaaaccacatatgtagtggaagcttggaaactactgttggatcgagcaatagacgtccgagattcgtccacgtcatcgtgagttaaaatttaactcgcagatcattcatgagttaaaattttactcatggtaacgtagacgaatctcgaatgtccattgctcgatccagcggtagtttccaagtttttactacatatgtggtttgcactacatattttcccataaacatgggaggagtccacataaatcaatcctattataatatgactttaactactggtcgttgttcagtctggacaatattggaacaggtagccaaaaattagagggagggggttcctaatggatcgctattattggtagttaattaatatttgaacaaattaagcaatagttaatgccgtttactccatcaaaattcctcccattctaattttgtcactcggaaaatcaattcctcccattccaattttcctcctatcaactaactaattttcctccatccaaattaatgcgtgattttccatcttgtgttcttatctcatctcaatggtttacacatgtgcatatagtttccccccaatcttctactctcatatcaatactgtactatgagaatcaaaatattcgtgctagtattgagagtgtgtcaccatgacggtaacactactgatctcttttaacatgaataaatattcaatgtaatttttattgccgtaggaaaaacgtctatcttaaagtttacaatttactataccttcatagctactactatagaaacggagtcgtcctcctttcgttctctcctcccactgctcgtgcccagcacaacataagagcataaaaggaacaaccattagatcacattcttaacctattctcagccatataaacccgttgcaatgttcagtcatgttactagtatatagtacaaaaagaaaaaaaaattaaatttagggcctaaacctaacattaagcgtgcatcacccaacttccaggcacggccttggctctatattcccaagtcagacaagggtgaaaacaagaaatgtattgtctcattatttaataaataaataaatctggttagcatctttgttattgcattattacaaagcatgtgtcagcttattgtacttttaattagaactgaacgtctgttttaattttatagcccccctattgcccacatgacataaactcagataggtcagtacaagattctagtcaagtagctatttttttctcttaaaaaacttatttttagtttttttattcaaactgcaaaacctatatatgtgtcaattaacaaagttcttgatttggttggacatgcatcaggaaaactatattttaaaaaagaaactcgtcttttataaagattgggtaccagcaatccgttattgcactaaaaaaacatttttcatgggtttaatttccattccatttttatttatgcccttcagaatcatatatactagcttgcacataatgttagtgaaatccattagctgatttagaagtgaaaaatcttttactccattagcatatcaaacacttaatttgatcaggagacggatcgatcgtggtgaagacatcgagcggcgaggagttccatggcgccaagtgcatcatcacggtgggcgcctgggccagcaagctggtgaggtcggtcgccggcgtcgacctgccggtgcagccgctgcacacgctcatctgctactggcgggcgaggcccggccgcgagcacgagctcacgccggagtccggcttcccgacgttcgccagctacggcgacccgtacatctacagcacgccgtcgatggagttcccggggctgatcaaggtggccgcccacggcggcccgccgtgcgacccggaccgccgggactggctcgccggcgccggcgccggcctggtcgagccggtggcgcggtggatcgacgaggtcatgccgggccacgtcgacaccgccggcgggccggtcatccggcagccgtgcatgtactccatgacccccgacgaggacttcatcatcgacttcgtcggcggggagctcgggaaggacgtcgtggtcggcgccgggttctccggccatggcttcaagatggggcccgccgtcgggaggatcctcgccgagatggccttggacggcgaggccaggacggcggcggaggccggagtagagctccggcatttcaggattgggcgtttcgaggacaatccagagggaaatctcgcggaaaataaggtcaaaaattaggtcctcacaggtatggtcgcctgcgaaattggtgcaacgtgtgaaatgtggttatcagtagggggtttgtttaccgtaaatctattgaacattgtatttcataacttctatgtgtgctttatactcttggatattggtagattgtaataatttgcatcttctctgtccttgtgtataagattcaaaataaagttgttctgttgcatttcttcatctttttgcaaaacacaaaatgttcctcattttgatcttcactttttttttcctcgggagagaatcacactagtgctgttttttttttccctcgggagagaatcacactagtgctgttcctattcccagtcctattcatggtagatatgccgttggtgaattgaaagagacttgggtgttcgccattgtcggattcaggcagtacacgccgcaaacctcacaaagttaatcctttggaaacaaagggttattttggaggaattttgaagggattcaattctatagaaaattttctcatgtgatcctttggataaaagaaatagctatctaaaaatcctatgaaattcctttgggttcactctaaacatacataggggatttgtaggaatttcaacataaggtccaacccgtctctatctttctctcttctaattcctgtatttcctatgctccgttcaaacagttacatttttatatttcaaatgctcttttaatccataggattagagatgatagctccaatactatattttttttattgttcctacattttaagaattctgcattccaaatgggccctctgagcatgaggaatatgctaggatttgaatagctccaaaacgttgagtctttctaaatacgtcacgtcttgctgcaactatttcttagttttaatcatgcatgttgcatggtgaagaattatcacttacatctagctataacaacatgtgttacatgctagctgatgggtctcattcccatgactcatgagtgatgagtgcgtcaagtcatgtgctgagaaagtgacaattcacttgttgtttttgttaaacaatcaaagagatgggcacaatatctttgtatcttttcagtctgatgtaatggtgcaagtcctaaaaaatcagtagtgacaatcgaattgagccacacttcggttgcttgtcctcattaggtggcatcgatatcgcacaagtgaattaatgcctatcgatctgatctgaagacttggctgttttcaatttgcacaggtcatgttcttgatcttatcatttgatagattgtcgcatagtgcgttgtcatcttgatactatccaacactccatctgtatggagtatctggtgagacagtgatgctttagctttcgcagtacaaagctgtctctgttattgatgactggtacagtaggttcaagactgaagaacaacaggctagtggagatgatgaaatttggagtgatggattgttggtgtaattttcagaaggaaaaatcaggccggtcctgtgcacagtgggcacttggcaccattgacttgacctggacttggacttgttttttttttttttgcagggactggacttggacttgttaaagttcagcgtaatcaaatcagtttgggctgtgtttagttcacaccaaaattgaaagttttgttgaaattgaaacgatgtaacggaaaagttggaagtttgtgtgtataggaaagttttaatgtgatggaaaagttggaagtttgaagaattattttggaacaacacacggcgcaaatgtctagctgaaattcagtaaattcagttgacgaagtacatgcatgtgtctcgtcaatgtgaatatttctgaaattctgtccatgactactaatgtttctactatctagcaatatatttagatcttctgaacttgagtacaaagaatagaaaattaatgaatttaatcactgctaatatacacgaagaataggactaatctctgaacttctcgatcaactgatctctgacaagccttcttgatcgtgaactcgtaatctcttctttggtgcagttaattactactaggagatgacttccattaatggtgtgctcaaatttcccaattcttcatgcttcactgtcagatcagaaaaggaagacgagcagtagtagtagcagtagcagtagcagaagccatggctgggtgcatcgtgtgctcgccgacgacgccgtcatcgtctcaggctcatgtgctcctccaccgccgttgtagtatatcggcggtctactgccgccgccgccgccgccgccgccgcggtaagccggcggcgcatttccgccatcgccgtcgatgatctgtgctccgaggaacacggcgtccgacttattgatcctgcagcaagaatcacacagctattaaaatttcaggaatttcgatcccctcgaccagaaattatttcggctaaatttttgtttgggtaagacaattttcattcagatttaaccaaaatttgccctaatgtaacctttttggtccgaaattttcagaaaaccctgcaatttccgaaatttcgcttcaatgggtaaatctcagcaattccacttctatcggtaggttttccacagttcccaaaattcatgcaatttccgatatttcacttccattggtaaatgtccgcaatttccgaaatttcacttctatcggtaagtttccagtccctgaaccaaaacctgtccaagtgctaacttttttcaatccaaacatttcccgaaatttcgcttctatcggtgtatttccgcaagtttgaaaaattctcctggatctatcggtaacctgtccaagtgttaacttttttcagtcctagaatttcccgaaatttcgcttctatccgattttttttcgcaatctccgaaatttcacttctatcggaattttctatcggtgaatttccgcaatttcgaaaaattctcttagatctatcggtaaatttcagaaatttctcttctgtcgtaaatttcggaaatttggcttccgtagctgcatgcgtacccggaggtagggaggcagaaggcgatggtgtagtcgtaggcggccttgcaggtgaaggtggaggtggagtcgtcgtacgcgtagctgtaggcgcgcgggcacgccgtcttgaagatggccgagtacgccgtcggccggcacgccgccggcgtcccgtactccccggcgcagcagtacctgtcctgcccgaacgcctcacacgcgctcctgcacgcgatcgccccgccgccgccgcactccacctgcaactccctcggacacgctgcacacatcgtcgtcgtcagctccggcaatggcgaagtggcggcggcgtggcgcgcgttcgtgcgtgcacttacagcggttgaggtcggccatgcagccggtggcgttgcaggcggcggcggcgcgagggatggcgacgacggggaggttgtagccgtcgacgaggctcacgtcgtagaagtcctcgccgccgcccctcccgagggtgacctcgaacagcgtcgccggcggcgcggcgccggcgccgcggcactccacgcgcccgccgcagtcgcccgtctggcacacgccggcgccgtcggcgtcgaacacgcaccccgtccgcgcccatatcctccccgaccaccccgccggcgccgccagctgcgccgtctgccccgggtcaagccggaaccccgtcgtcgacagctgtggcgtgccggcgccggcgagcgtccccggccatatcgggtgcgaacaatagttcgctatagtgaacgtcatcgccatggaactgcacgaccaagaagccgccattgccaccacaagaagccatagcttgcaagctcttggctctcccatggctcctatggctcaaaatttgggaattgatgttgataggaagaagattgagcagggaaggggaagaagacattgagagaattcttgcaagatttaaaggtgcaagtgccatgatgcattgcatttttgcatgtttgcatgcaaagaaagctttttcttggtgtgcttggtttagcatgttgcacggatggggtggcctaggaaagaagaaataccttttgggatgatgcaagcttatgatggtgacatgatcttagcatcaagagaggtgaatcttctgatgcttgtgctaatgcagataccttaattactagtcaaacatgctatgttttgaatactctgtagtctgtacacagtctgaacatttggacagagtacatgtttgtgagtttgagcaaccgggaaaatggaaatgtacagaatacttttcttatttggatacagaaaaaagacttgagctgaactctattacagtattagaatcagtagtcaggataacagcatgaagattctgaatttgctatcatatccatgcgctgcaagcctgcaattctcattatccttcttttttcttagtctttatttgggtttgatttactgctcgagtagctgctatctcagaacattagttcgctacatgtagttctgaacacttcaacctatcggtaagcttgtaaaatttatgatccatttttgcgtcagacatgctcttcaattccaatttataaaatcaaggtgcaagactgcaaattcattttgtctacaaaaatgtcatgtgttttgtaaaaagcgtacgatccatttcatacaagattctttcaggaggcaatcatgcctttggaggaaaactgcaaggaaggaatcatacaagaaaactatcaacatgaacaaccggcacaaagatcaatgaagatgacaaaagatgcacctttttgcagttccataaaatcaaataaccttgcaaccagaccagataaagaatctattctgatttgattgcacaaaaaggaataatcaagctggaattgtgacgcttatggtagctctctgtatattgcctacctttcaagatacccttgactgaacaaaacatgtgtgaactgtaagctagtccatgagaactcagaaaaaaatccatttcagaaagggttgagaacagctaactcatagtgcagcactacgaccttgtaaattattagaaaacaatggaagattacatgattaggaagtttccatattgtacagtactcatgatcttatcagaggcacaacaaacaagtggagacctactgcagcatcactcctctgacacaggttcctcagcaccaccttcgggaacattggagtcatcaacaaccgtgacaccctcaagatccaaggggcgcccagtcatcggatgaattgggcgcctatcacgaggtccaccctttcgagccatagctagcattggaggtggaggcagaagcccagctcgaaaaaggatgcgctgcacaggatctgatggctgagcaccaacagacagccagtacctgcaacagaagtataattgtatgctgttacatggccttgcaagggagggaaggacatcatagcattcttctagcaattaactcaaagaaagaaatattgggaagatcagactcttgactctcgacaaggtgggcaatgaacactggcaactagacaatacaggatcaaagatactagttctgctattgatgaaactaagcaccatgcttgaaatgtctgaaactttatatctgtaattttcttccctgttacggatactgttaagcaaatctcatatgcttaaaatctctaaatccttttctgctatggatggatgccagtaagcacatctacaagctacaaaattcagaacccttgaatccatcattttctacccagagaatggaaggcacggatggttggaaggtacatggtaattggcaatacaattaaatagtacacagaagcaataacagcaccccaactcctggaacgaagatcgcattacaatgataactgaatcagtccattttgcctatcaaacaatcagtttccatcaaagaatcaggctgctatagcaatgtcagtcctagactagcatcagcaaaagctccagcacgccaatttttctccagaggaaatactagaacacatcaaacactccaaattacgagcataagcaaatgaaactcacttgaccctgtcgaatttcagccccatcctcttgccaccatccttccctgcaatcagcaacagaaagcacatactcctccatcatccatcaggcattcaatcacaagcttacagccaaattctcacgcacgtacagaaatgtttcacactctactaatccctctccaatctgatccgattcaccatttcaccaagacgttgaggccaacgccaaccaacggggcaaagacaacactcgagaacaagccgatccaggaggagcacgagggggggatatggaggaggagggctcaccggggagcgggttgtagtagccgaggacctcgaggtgcttgccgtcgcgcggggagcggctgtcggcggccatcacccggtagaacggccggttccggcagccgaaccgcgccagccggatccgcaccaccatgctcgcctcccctcgcgcctcctcctcctccgccgccgccgccgccgccttcccttccccttctccggctcgggtcgcgtcgtgttcactcctgtgggagcaagggttttggatttggattctggagaaacccaacaaaaaaagaagaaaaaaaactcagcgggctttacctctgtgatgggcctgatgtcccatagagtatgggccttccagctagagcttgttcacacgagacttctttctgggctttagcccatgggccaaactccggcccacttatggttatacttggttaggctcctgaatggttattagccatttaagctgacttatgcattggccaatcaataattcaatagtagctccatccattcagtgatgaacaaaattaacacgataaaagctcacataaactgtctgtaaaattaatgaaaaaaatcaatagtctgtttggacaatgtgcaggaatactgaaattgcacaagaatcggcccaaaagaagggaactgacaaggccagaattcatttgtagttctctgctcttaacacatttgataacctaactaatggaaatcaggaagccctggtctgtgttttgctgaagtctggaggcctggagaatatagcttgttgctcactcagtcacacccaattgatcattgtcatggttggtagacgaatgctttttcctgcacaaaagatggaagcacacatgctgaactttgcccaagaatgagtgcagtaagaatggaattggaagagaaggatgaggcacaaaaaactgaacaagcaaaaggcttacttgtttgtattggcatcgctctctaacaaaaccgaattggcaatggtattttgttgtctaacagacacaaaaagatccgtactggcatatggcatgctttttctcacctaagagcacctaaaagtgaaacaacctgcatgtaaagtcattttcttgctatgacaaacagctaaggaatctgtgtcaaaacaaaaaaactgattactcctttagggattagcatcactgaaatcatgagagaataaaatgatgtcttacattcaatgaactgatgcatcaaggaccttgtacctgtagaagtaggacccttcagattaggctgctccatgtttgaagaataaaactgtgatttagtcatccaaatgcattcatacatgttaaagaaggcaaaatcttttccatcacatacttttcctagcattagcatgaacaaacaattactgcgaacgtcaagaaagtaacagaggttcaaaaatgatataaataaattagtagatgatgcctaaaaataaaaacgataaagaaacaaaattttatatgcatgtcaggttgagagaaactctaaatgaggaagatgtattggtatgtctaggtagtttatttacccttctccctttcttttctccaactcccaatgtttaactaagatagtctatctcgcattattccacaggcatctattgccacccataattttatgtcccatttggtaagaaaaatgattgattgctgaacccagaagtactgaattgaattattgctagacaggttacttgtgctgccaacaatgtccatattgagtactctctactatgctactgctagatgtgaaaaaatatatatactcacacgttttccttgaatgtcttaaaaagcaaagagaaagtacacaaataatacaccaggaatacgaatagaaagagatgccataaaaaatatatgttctctggaacttcagtaatgatcctgtaaaatcaataatcatgaaagctacccctgtgatgcattcatccagaagaaaactagatactccacattgaaacttccaaatggctagccaatgtgaatttcataattttatatctctgttagtttctgtgtgcatatatgaatacttagctaacaaatcttggcagtggagtaaggatgtcgacaacaagcgattgcgcgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28450 - DNA, 583 bp, Oryza sativa
tttttttataaaaatatataaatgacatgcaagaacgaaggatatgctctaagggtattaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtacctccggccatgaaacgggcaagcgccaagacggtggtgttgaagctgcagcagatgtacctcgccgacgactctgccgacgacaatgacgaat

SEQ ID NO: 28451 - DNA, 539 bp, Oryza sativa
  unsure (1)..(539): unsure at all n locations
nnnnnnnnnnnnnnnnnnnnnnnnnnnnnnnnnnnnnnnnnnnnnnnnnnnnnnnnnnnnnnnnngtggtaatactgaatgcgagctcaagcgccagcgcaggtagccgataagtaaggctgccgacaatcgagcgaccgaggccggtagagcggtgggtatcggcactagcggctgaggacggtggttggctagcaacaagcggcgcgcggggccggactggctgcaagcggcggcgcgagcggcggtggacgacggtggccggcggcgagcggcgcgagggggcggacgggcggtgggcgacggcgcgagctgcggcggcgggcacgagcagctggacaggttggtgatgtcccacaccagcagcgacttgtcgcgggaggaggagacgatgaggggcgagatgtcgatcggcgccgcgattgccatgaccatgtcgttgtggccgcgcagaacgcccgccatcgtcgccgcgtgggtggagaaccggggctctcgacggcagatggcagcgtggaggcggcggcggtggcggaagg

SEQ ID NO: 28452 - DNA, 141 bp, Oryza sativa
aaaaaaaaaaaaaaaacaaaaaaaagaaaaaaaaaaaaaaaaaaaaaaaaaaaaaaaaaaaaaaaaaaaaaaaaaaaaaaaccaagacaaaaaaaaaaaaaaaaaaaaagaacaaaaaaacaaaaaaaaaaaaaaaaaaaa

SEQ ID NO: 28453 - DNA, 50402 bp, Oryza sativa
  unsure (1)..(50402): unsure at all n locations
tatggctggagctggtcccatgacaatgtgtgcatatgatggtgttgttattagtgtatcattggaatctccacttcttatcgtctttctggttttacttttgtttactgctaaattctaatgaccaattgaaaatttgtggggcctttgttcctttttgaagtgtttttttaatgataaggacatcgaattgattttgtccctttttcgaagtggtgttatgccactaaactgttagctatttgtaacacacatttctgcattgtcagagtgatcaaagtgtttctcattaaaaatcagatatgattagtgctgatttttgtttcagaatgcatgttgatttttgttgaagtagcccttaaattaccgaagtttctgaatactatttttggtacatgaataccagttgattaattgattatgcaatgcatatcctgcagggacaaagcatcaatctcaccaagattacatggaaaaagctaacaaggcgaggtcggagagactttcttctggacagtcatcagcaccaaaagcatgaagtagtaatccgtaactcagatctgtgaaacctcagcattcatagttttgatctataatctagctgagcactttatctattgggtgaaataagcaggccatctcttgaatattgaccctgatgacatgatcttgtcagtttcagaaaccatgtgtaaacttcacatgaaattttgtcaaatgtagcctttctgttcactttatgcgcaattctgtaggagatgatcaacaagcaccagatttttgtctatcaaatattcaaatggtggttctcgagccaatttaacctttgcgtttgactttagaatcattattttcatgatgttcctacggtgtgtttatgatattgactacggggtatgccaagtgctgagatttttcagttaagtcgcaaggtgaatttagccgtgggacattttcaaaaataaatgaaaatgttgaaggaacacggttgtcgtggcgtttcgcaccatctgaacattactatgttgcgaaataaacttcaaattattttctcttatgcatgtagaccttttcctcaaacttgatgtttcttcgccgaatgtactacgacaaattttgccttttataggattgcctacaaatcctagcattggtacaaatctaagttattctaggaaatataaaaacaaactgaactaaattattctaaagtcacagggtgtagtgatcctctgtcctaaaatataacaacttttggctctaaaaatgtttatattttaggatggagggagtaataaatatcaaaccgaacaaaaaaaaggcaaattttgctacaggacatcgcgattatgtgtatttagatcagggacaccgcgaaagtgaagctttggggaaagacatcccataatcgtggttatttgctgatggacactgcgccgtctagcgtagacttgccatgctgacgtggctgacgggaggctgttttttgacgcggtcggacgtaaatacccctgcgccttatctcctcttatccactcagtttggctccattcgcaagcagtaccagtgaatctggcattgtagctggacggcggcggcgaggatcgtcttcgtcaaaggcggcgaccgcttgaagtcggcgtggtccctttggtagacgtagaggggagggagctcgttggcagcgacgatgtcttccgcttcttctttctcacgtgcttcttcctctcgggttcggcgtgattcacaggtcagtgagttgcctcttgtgaaatgtccattctgcaagggcgattcaacggtagtggagcggacatgcaagaaggaagagaatttcaaccgcaagttttatcgatgcctcaccggacaatatgtaagttgttctttgcaatccccaatttttctagggtttgagttgaaatcgagtttgtcatttgataagctgtgtgctcattgttgttatttttagacaagtgcacaatgtaagtttttcatgtggcaaggggattatgctgtttggttggtgaaggaaggtttccttcatggatggacagattgcaatgctcacaggatagaagatgatgtcccagaatcagtgaaggcttcattgaaaggactacatgatggaattgagaagataagatgtgagatgaaggaggcaatgagtagaatttgtatgtttgggattgcatttgtgactgcttttgttatgtttgttgccatgaatgtaatgaagtaggaccatgtaatgaagtaatgagttcaattgtgatgaatcaaaatttgtgcacttaatgtaatgaagtagaaccatgtaatgcagtattgcaggaaatatttgtgtttgcccaaaattgagatgtaatgcaagaaatatttgttgttgacatttcagaatcataaggcatatgaagtagcaactatatgaataacaaccattttcctccatttcagcaataggactttcatagataggtgaagtcatgtcttgcaacatatacataggtagctaaagtcatggcttgcaaaataagggatgtctttcagctggcaatttcacatatacacaaaagacaagtcttgctactacttcagctagaaatttcaacaaaataacctactctaatagcattggattacagcttctttgcagtcctggtaaccacagccttccttttgttggctttaaatggacttgcatgttctggggatgcaacactcttgctccttgtaactagtccagggatgtcatccacctgcatagcaacttgtgcaggggcttgatcaccagcaccagtaggggcttgatcaccacaagcagcaccaccaacaggggcttgatcagcagcagcagcatgagcttgatcagcagcagcaccaacaccagcagggccttgatcagcaacatcagcatgggcttgatcagcagcaggggcagcagtagatgtggcttgatcagcactatcagcagcagcaggaggaggcctgtgaaagagatattgaacaaatattttaaaaacaaaatggcaactgaaaacttgatcaaaacatgacacacttacatagtgttgttaccaccagtaggcacttgtttaggcttggatttcttctttctaactctcttaggcttgggtggagctgggggaggggcatctgggtcatatacaggttcattgcatgtcttttgtaggtggccaaagccatggcaccccttgcatctccttcttttctttcctgaaccaccttcttcaacaccaatgaacctccttgttctaggtcttccagctgatctcttcagtattggtggccacatcttgaatcctgtgtccactttctcccataggctcttgtctggcattggaggcacaactgtggaataggcaaccctgaacatggccactgaatagtaggggctgacatagtcttctagctccacttctctcagggatccaataaaagagatggcatgcctacatgggaggcctgttagctgccattcattgcaactacattcttgtttggtcaagtccacagtgtgtctccatgttgtcaagtcccttttttgcaccactgacttcacctacaaatggcagactcttgtggtgattgtagttgagattcctacttttgtcatggagttgcttcattacatttcctaggatattgccttgcagcttaagagataatttgtgccttgtacacatcctctccatgatcatctgcctaatcttgtcaagcaactcaactataggtagtgacttctctagcctaatccaactattaaatgtctatgcaatgttgtttatcatgaagtggagaagctagaccttgcccacaaatgctggtgattctcttcaatccattgcattgctcttggtgaagcctctttcatgatattaaaatgcctgtcaaaaacatctttcctatatgctcttgaggcaggccacaaatttctttcaaatacttctccatggaaccttttctgaaaattcttgtacaaatgcctcatgcactctctatgctctactccattgttgaacacccttgtcactgcagcatctatgcccttgcctgcatcagtagacagtactaggacttctggagatccaattgccttattcaaacaaaccatgaaccattcccagtttttctttgtttcagatccaaagacagcatagggcactgggaacatccaattgtggccatctataccaatagctgaagccaactgccctctccacttgcctgttaacacagttgaatcaatgcctaaatatggcctgcacccattcaaaaatccatttatacaaggcttcaaagcaataaacatcctactaaacctatgcttctcattaatcacatcatactctatctccactatactaccaggagatctcttctcaatctcagctttaaaactatacactacctcaaaactttgctcccagccaccaagtatctcatctaaagccatctgcctaccatcccatactacatagtatgacagggtgattaaatacttctcctccaaagtcttctttagagcagcagcccctatggttggatcttctctaagcttgttgataaccctgtctttaacccaagaattgctggccatgcaattattctccaatttgcctgtgctagcacacctatgctcatatggcatgttctttatctgcaaccaaaaagggacagtaaacatccaaaccattattcagttgcaaaacattaaatgacaaagaagtaaaacaaaagagctacatacctgccaagttctaccatctggcaacctagaagcatggatcctccatttgcacttctttgccttgcaataagctctgtatcttgtggcctcagagtagggcactgcaagctcaacctctttcaggacagcatattgtctcatacacctcttaaaacaaattacatcctaaaaagtaacaccaacttctatccttggattgcctacatcagttatatggattagaggctcacaacccctattatcattgacttctaaatcatctactggatcatcattctcttcatcaccatcagattcctcaggagtgtaatttggatcattagcctcatcatctgacaccagctcattgtaattctccctctcatcactaactcctacatactcaacctcatcaaactcaccccatggatctggatttggcattgattgatcagtagctttgtccctggacttgctatttttttttggtgggaaccttttttgtggtagcatctctggtaggaacattgtcagcctgacttgcttgtgtgggtaaaaccatactcagtggaaccactgttttagcttcatccacacaagacacaatttgggaacaaggctcactcactgtcacttgcaatggaagcttcctaacatcccagtattggttaaatgcctctaataacacagcatcagaacaaatttctacatccctacccactctcttgtcccagaaagtcactctaagctcctgcgcactaccacggatgatttcatcatccaagtccttcatcaaatctatcaagcttattgtgtctttatctacaacccacttatgtggagatgatacatgataatcttggctaccattatccatatactcaacataagcaacaaccctaaccacaactctgcatgcagagttcggatccatcctacaatgcaacggcaaatgaagagaaaaaggggatcccaaatcagatccaccaaaccatgcatcctaatgcatcccaatcgaatcaaagagaggaaaaacgaatcaaagagaagaggaatccaaacttaccctttcggaatccatttcggcattggcggcgctgccgccagcgcagattccaccgcctcctacgacggtgaagccatcaccgccggtcaaacttgcatcccaccagcgacaatgcctgggcacagccagtatcgagggtgacggaatcggtgggaatgggcactgtttggatggaatcggtagagctagggttctaccacccgtactgcttgcgagtggataagaggagataaggcgcaagggtatttacgtctgaccgtgtcaaaaaacagcctcccgtcagccacgtcagcacggcaagtctacgctagacggcgcggtgttcatcaacaaataaccacgattatgggatgtctttccccaaagcttcactttcgcggtgtccctgagctaaatacacataatcgcgatgtcctgtagcaaaatttcccaaaaaaaaaatacatccagaatgcatgcacacgaaaatctgacatatctggagagaatataggagcggctcgggcggcgatccgtgatggcgagctcgccgttcttgccgtacctgaggcggaacgtggtcatgtgcagctcgcacttgtcgccgtcgccccagcaccgccagtatcggggccgctctcacgacctgccctcgacgaggcagaacttgccgccgccgcccatagggacgagcgtcgcgtcgtcctcgactgtcgaggtcatcaccaccatctcgcacagcttccagttgggctcctcctcgtggctcccggcggcgacgatgtcgcaggagcagagtttgccgtggcggtgagagtcgcaatggaggccgacccacgcgtcgagctcgccgtcatagtgcgcctcgccacggaacggcagcagccagtcgccgtggcgcgtccactcgccgcgctcggtgtcgtaggagaaggtccccgccatcttcttcgcctccgcctccgccgcctgcgcggcgacgtggtcatcaccgtgcccggggcggggcacgctccaattctctatggagacgaagatggcgctgcctccggggcgcacggcgtgcgatgtgatccggcggtgcgcgtggtcgttgtcgaacgggaccggcgacgggtcgtggctccaagaccaccgctccgtcgccaacggatcctcttcgaggcggtgcatcgccgcgtcgatgcgagggcggcagtccactgaccggtcggacggcgtgaacgcgtacagcttgttcccggcggcgtcccaccgctccagcgcctccgggaggcggtgcacgaaggcctgcgccgccgtcttggtgtcgtacacgacagcgaggccatctttgtcgctgaacgggtagcccttggccacgatgttgctgcccagcgcggcgaactgcgcgctgctgcccatcatcttcaaccgggagtgcacgtactcgaatcggacagccggcgccggaagacgcctgtaggtccgtgccggcagatagtccgtggcggcgacggtgacgagctgatcgtctgcgtcggcctcgttgccgtcaaggtccatcttgtgcacgctgaatcccctgctccagtcgtcgagcacaacgtacaggtgctgcctttgcggcggccaccagctgcgacgcgaggacccctcaccgttgttcaccgacgacgttgttgaggtcgtcgtcgtcgtgggtgtgggtgtggagacgacgaagtcatcataatcgtcatcgtcgtcggtgtaactgtaatcatcgcaatccgtgaagtatctccgtggtgaaaggagcacaccgcctgcgccggccagagcagccaacaacacagcgcgtggatggtggcttgcggcggcacatggccggagatgacaattagatcggcggagaagcgattgcagcattcgaattttttgcacccactctcccgaggattccggaaaggtaaaacctaggtgtatatgactcggacctatatatagcggatggaaattttacagcactagaaaaaaaatgcttccatgatatgagaatttaagaaaatattgttggcaactttttttgacaagttgacaagcacgatcgcagcaccttaagctttgcggtgatcctagagtcgccaaccacctcgatctagcaaagagctaaacctagatgtgttttgataactaaaccggctagcggagccgatttctagataactacccgtctcgtgggcaaaacggaaggttttcaggacaaacctacaaagagatgtcgcactctcgcagcggcggcggacggtttacggcgcaaactgacaaagatggacaaactaagagaaaactaaaagcaatatgaaaaaacgattcgattgattgattgtagattggttttttacaatgaaccggccatgtccattatataggggttggtcttgccctctacaggctctcctccaagtccaactccgggtagaaaccaaaggaaacccgaaacatgccttcccgagcaaggaaacctcaagacccgacgaaacacagtcggactcggacctgccggtcagaccggccacacaccgccggtctgaccggccctcaactggcagtctgaccggccaacacacggcggtcagaccggcccactcggaggaaaccggtagatttccaaattttggcaatctttcctattttaatcctaggtgccaaatttgggtgtaaacacatgccccctgccttttttatgaacaacgtgaatctaaaagcatagaacatgttttggtctaaggacgataatccaattaccggccatagtacctcctaagcgtcttgccaaacgctcgggaagtatttcttcaagtatttcccgttgattgctcgctaaaaacgctccccttgaagtgtctctaaaaaatatgcgttccctcgaacaatgccgcatactcgataaggaccctcccaactaagagaccacataccgaactccttggatcgagtacccaaaggcaaaattgtcttccaaactaagtctccaactagaaacaactttgctttcacccttttgttgtacgccttagccaccctcttcttctctttctctatttcttccaatgccttcaagcgcttgtcgatgacttcatcaagattgtcttccatcaacgtcttgtaatcttcacttgacaaaccatcttgcttgatataacgaagagaatcaagatttacttccaccggtaaaacggcttcttgaccataaaccaactcaaaaggagcgactttagtggcatcatgtttagaaatcctatgcgcccacaatgcttcggaaagcacctcatgccacctctttgggtgttcctcaatcttcttcttcactgatttcaacaatgtcttattactcgattcgacttgtccattagcttgagcgtaataaggagaagaactcaacaatttaataccataagattcggtaaaactcttcacttccttagacataaaagaagcaccttgatccgtagttaatgtttgtgtaataccgaatctatggataatatgcttcaaaataaagtcaattacctccgtatgagtcatattcttcaaaggcatggcttcggcccacttggtgaagtaatccgtagcaactagcacgaacatatgcccctttgatgacgaaggataaatttgaccaatgaaatccaaagcccatcctcggaacggccatggtttgattatgggattcaacaaggcggcgggcgccaattgaacattgccgaaccgttgacaagcctcgcatcctctataatatttgaagcaatcatcaatcatcttcggccaatagaaccctactctcctaagcaaccaattcatcttgtgggccgattgatgagttccacaaattccttcatgtacctctcccatagccactttagattgatcttcatctaagcacttcaacaagacaccatctatatttcggcgatacaaatctccatcaagcaatgtatatttgaatgcttgccgccgaattttccgatcaaccttaagtgtaggatctttcaaatatcgaatcaaaggaattctccaatcctcttctgttcccttggcacaaatgtccgaattcacacttaattcggcctctaaattgattgaagcgtgccccccagcgctctgcccagaaccggtcagactggccacgcagggccggtcagaccgctcggggtcgccggtcagaccggcggcatgcggccggtcagaccgcccctgctcaccggtcagaccggccgtgcaatgccggtcagaccgcccctggtctccagttttgccaatttcgcacaaagatttaaaatcaagcaccggctcttctaatatcagaaataatcccttcttcacattatagccagatgcttgttgtgacaagtcatttgctctagaattatcatgcctagcaatatgtctaatagcaaaattatcaaaattggcaataatatctaaacatgaatcgaggtacctatttagtgatccgtccaagcatttgtagactccagcgacttgttgcaccaccaattccgaatcaccaaaagcctccacgtatttagctccaaccatctccataacttgtaagccgaataatatagcattgtattcagcttgattatttgtacaataatactccaaatgaaccgatgcttcatcacacatgccattaggtgaaaacaaaactacccctatgccctgaccttctttgcaagaagaacgatcaaaataaatcttccaaggtataactttaactaagcaaacctctccctcatagcaatatctatatgatggtctactataaaatcacatacaatttggcatttcatagatttcaatggttcataaggcaaatcatattctatcaaagcatatgcccacttgccaattctcccacttagaattggcctttgcaacatgtgtttaataacatcggcttgacaagtaactatgcatgtactagataacaaataatgcctcaatttgctacaagcatagtataaacatagacaaagtctctctataaaaacatacctcgtttcggcatccaaaagagggcggctcaaatatgtaatgatatattccttgccatcttcctcttgcgccaaaacggcaccaataactttgtcttcggaggcaatatataaccgaaaaggctttccggctttaggtgctcgcacaacgggtggagtagacaaatatctcttcaactcttcaaacgcctcttgttgttttgccccccaagtaaaatcggcttcttttttcaaacaaagtataggaacaaaagcatcgattttacccgctaggttagaaataaacctcctcaaataattcatgttacctagcaactttttaacctccttcttacatgtcggcgctttgaaatcacgaatcttttctatcttcttaggatcaatctcaactcctctctcatgcaccatgaatcctaagaacttccccgccgacacaccaaaagcacatttaagtgggttcatcttcaaaccataccggcgcatcctctcaaaagctaacctcatatcggctatgtgtcattccataccatccgatttgacaacaatatcatcaatgtagacctctaagataatacctagcaaatcatgaaagattaaattcatcgccctttgatatgttgcaccggcgttcttcaacccaaaagtcatgaccacccactcaaataaaccaacaaatcccgggcaccaaaaagccgtcttgtacatatcctcttccgccataaagatttgactgtagccagcattaccatccaaaaagctaatcaccttatgacccgaggcatcattaatcatcatgtcggctataggcataggatattcatctttgggattaactttatttagatctctaaaatctatgcaaactctaatcttaccactccccttcttctccaccgggactatgctagagacccactctgcataacgacacggcctaataaaccccgccttcaacaaccgatcaatctcctctttgactcggtcatatagcaaaggattaaaacgacgaggtggttgcttataaggcctaaaacccggtttaattggaagccgatgctcaacgagctcacggctaagacccggcatctcgtggtactcccatgcaaaaccatcaacatactctttaagtagctcgattatcttaaccttataatcggctctcatgtttttgtttacgaaagtcggccttggtttagtttcatcacctatatctacttcttccaaaggatcggccaatgtaaacccttttccaagcttctccacttcatcaaaatcttcaacagtttctccaatatcgttctttgtagaccgatattcttgcaccctcttttgtaaccactctaaattagcctctttactcattatacaaatttatatggcttagccgtgctacactagccggctttacagagataggtacaaatttgccatcggagatactaataaaatcatagctagaaagatccctccccgataagtattggatattcccatgacaccactcaaaagtagcatcggccattgcaacctcggctgatgtatccgcttgaacaatttcaacatcatctccgtcccattgaattaaacattgatgcaaggtagaaggcacggaacaattggcatggatccaacaacgacacaaaataacattgtagttaccttgcacatcgacgatgaagaaagcggttggtagcgtcttgtttcccacggtgagctccgccgaaaagatacccttcgcctccgttggttcaccattgaagccattgagaatcatgttggtcttcttcaactcatcatcctcacgccccaacttcttgaataatgagtacggcatcaagttcatggcggcacctccatccactagcatcctagagaccggcttcccatcaacatggcctttgagatagagacactacaagatatgtgtggctttttgacgtatttaataagacacatgccataatgtcactatatcatataatttatgatattttatttcaggcatttcaacttaatgacaataaaaagttgtgtgtcacaataaatgtcatatagctagtctaatgtcatccagtgacaatatttagtatgtcataagacctatttgtgtgtcacaaattattcggcgacgatgaagagatgttgtgtccatgccgtcagtgtttgaatcgggttccccaatttaaaggacgggtgcatgatcacttgcatattcatgggatggctactgcttacactagatggatacatcatggagaaccattggaggttgtaccacatgaaattgatgaccatgttgatgaggatactagtctcaatgaggattttgacatgaatgtggatgaggaagatgacactgatgatggaattcatggtatggtagaggagttgtacacagctgaagaagaaggtcaagggaaaaagtctatgtttgcaattctattggaagagatgaaacaagaactgtaccctggtggtccttgcacaaggttttcttttgtggtgaagttacttcatatcaagtcattttaccgaatttctaatgttgcattcacagtgttgctgaagttgttgtcatcatcattcccaaattgctctattcctgcatcaaacgaggaagcaaagcgacttatctgtgcattggggcttggatataattcaatccatgtgtgcccaaataattgtgttctatttaggaagaatttagaaaaaaatgatgtttgtccggtttgtggtgcatcaagatggaaagacaatggtggaaggaagaagattcctgagaaggttttgcgacattttccattgattcctaggctgaagagaattttttcttccaaaagaacggcagaggaggtgcaatggcataagttgaagaggaagccagtggagaatgagctcaggcatccagctgatggcgagtcatggaaaaactttgacagaaagtatgggtggtttgcagaagatgcaaggaacatcagacttggccttgctattgatggtttcaatccatttggtaaaatgagctcctcgtatagcatgtggccagtgtttcttatcccgtacaattttcctccatgggaatgtgtagagcaatcaaactttatcatgggcctgcttatccctggtcgagaatgcccaggaaaggacattgatgttttcttggagccacttattgaggagctgctagagctttggaaaggtgtccctactgttgatgcacttactaagaagaagtttgatctacatgctgctataatatggtgcattcatgattatcctggtttgagcacattgtcaggtagagtcacaagaggttattatgcatgtgtgcattgtgataaaaacccttgctccaaaaggataaggaatatgatatgttacattggccatcggcgtttccttgctagggaccatccatggaggagaagcaaggtgtttgatggtaatgttgaaaaccgtgagaagccagagaaatttaccacggatgagctgatggagcaactggagagggtcaaggatgttagaccaggaaagcatcctgaaagcaaaaaaagaaagtgggacgaagagggccaatgttggaagcgaaggtcatgtttgtgggatttgccgtattggtcgagtttgaagctgcggcataatcttgatgtgatgcacattgagaaaaatatatgtgagtacatccttggtacatttctaggcatggctgggaagtcaaagtacagtacaaattctaggcttgatttggaagatatgggtattaggaagcatttacacttgatccgtgatggagattcatatagttctcctcatgccccttacacaatgactaaaacacagaaggctgatttttatgattttttgaagagtgtaacatttccagatggatatgcttccaacttagcaacatgtgttactgcagatggatgcaacctccaaggattgaaaactcatgattgtcatattcttcttcaaaggattatacctgctgctgtacgaggaatcatgcccaaggacataaacgaagcacttgctgaattaggtaatttttttcagcaactatgtgcaaaaactttgaacttagatgtgctggaaagattgaaagctaacatcccaatcattctgtgcaagcttgagaaaatatttcctccttctttctttgatgtgatgctacacctggctgtccatttacctgaagaggcaatttttagaggtccagtacaatatggatggatgtacccaatagaaagaaggttattaacattgaaacggtttgtgaggaacatggcaaggcctgaagggtccattgcagaagcatatgttgctgctgagtgtttgactatttgctcgaagtactttggtgatgatgttgagacacgacacaatcgggagggcagaaatagagagcgtgttgctattgtgaaaaaagacctatctgttttccagcatggagttgatcttcttggagcaccaagtcttacatatcttgaacatgattgtgaaaaaatggtttggttcgtgctaaacaattgtctggaggttgagccatatattgagtatgtcatcgcatctactattttcattgtttcttggatcttacttattagccctaatgtttgaattaactatcatttttaggatatataagaaagagttggagaatgaaggatgtcctaatgttcaaaaaacccttgagaagcaattttctcgctggtttaagaagcacgtgagtttgatctctattactttatttcatcattttcttcctggtttaagaagcaaactttttatgtcaattatttttttgtgcagattacaaaacttcgttacgtggatagacaagacataaatgatgagctatttgcgctgtcatgtgagcctgatctgcgagttcgaatttaatcagcttgacttgtcaacggtgttcgattccacactgtagaccgtgagaaaaatagaagaacacaaaatagcggaattatggttgagggtacacatgataaccaggaaattgacttctatggttccttgaaagaaataattgagcttagatacaatgcagattcaagtggcgataggacggtggttctatttcgatgtgattggtttgacactcatggaaagaagttccgaatgaaggaagatgggttcttcaaaagcataaaccatggcagcttgtggtacaaagatgatccatttattctagcaacacaagcaacaaaggtattttatttgttagacaccaagtatcatgagaaatggcgagttgttcaaaaattttcacatagacacttgtggagtgtggctgaaaatgacaatgaggatatacccaatgctgtggtattgtcctaccaagacgatgattgtgaaggtgtgcatgttcaacttactgaaggatgtctagaaaatgaccagccagttagtgaaggtggttttcgtgttgatgctagtgtagttgatgacctccgtatacaaagagaagcggaagggcaacaagatgagtcgggcgacagtgaagatgaaactggatggcaatatgtgagtgataatgaaggtccaacattccctctagaagatgacgatgatagcaattatgagtagatttagttgtggtttcaatttagttgtcgatgaatgatgacttggactatgtggattattttgtttaaatagcctgtactgcaattgatgctgatgttgtgtgatgctgctgtgttgctggtactactgttttgctgctgtgttgctgcagctgcagctgctgtgttgctcctgctgctgtgttgccgtgctgctgtgctgcagctgctgtgttgctgatgctgttttgctgctgaaattgctggtttgctgcgaatgctgctgaaattgctgctggtactgctgagatgctgttgaaattgttgctgctactgaaaacttgcagatacagctattttgctgcagctgctgctgttttgtggctgttgctattttgctgctacagatgcagctgatgctgtatgatgctctaataatatagaactaattaaaaagtatatatgaatctcaaattattacaatcccaataataagagttttctgaaatttaataaaaataacattgttgactaacaaataatataggtatccacccactaatattggtctccatgacgttgccacaaatgttcgatgagatcctcttgcaaccggttgcgaattgtcttgtcattaatttttggatgaggaaatcagccacctgagtagtttttctctcttcttaatcttcaacatcttcgatcacgccggccacaacttcattgccgccgtggagctcgcccactccatgtgccatggacaagctcgaccatgccttcaccgttgaggggatcacctgaggtacgtggggccgacaggatctagtgacggcggcctccctcgatgccagatctggtgatggcggcctccataggtgcacgggagggggctcctagtgctcctagagggacgagagggaggtcggcctgacgctagatcaatctgagctgttcattttgatcagcagctctttttcccttccccaccacgaactgcctctccccctccgccgctccgtctccgtcctccctgttccctcaccggcggtgcctctccccctccgcccctccctctccctcgccatgaggttgcaggaggactcgacggtggtgggcggcggcaagcggcggatgacgtacttaaaacccaactcaaatacggatctggatttccaaaagcaaacgaacataaaaactgggcacatacacggatgacgtaccaaagtaccagcaaaaacatcttcaatttttataatagtagagatagagattttcccatcggagaaggattgaagcgggatcgatcgcacgcgcgttggatgattttttttggtgacggacgaaaattctcacccggaagccttacatatttttttaagtaggtatagatgtgtaacaatgaataggaaaaaacggggcgtgcgccatatttctattatccttgtaaccttacatattttaatccaccaagaatgttctgtacaacttgaaaataaaaatatgtactgcattgtgaccttgcagatagaattattttagagaccttggttcaatatagtgctgcataatctagagttgacacttgtttatgctgcttgttgctcgctgttgctgcacactcccagggtatcatttgaatgctatttaatgatatgttcatgctcttgtccagagtcaattcacaatcaacacagatgctgatccagtgatagctgcattttctgatttgctcaaaaatggacagcggcagatgagatacaggctaaagaagaaatatttcaatggtataccagcaaatgaagttagaacaacttcaccgctaagctctatgactgacaatgagtggaaacaactcgtggacatgtggtctaccccaaagcataaggtatatctttccttaatatctatcataaatgttgccttacaaaatatgaattgtctgtccagtaatgtttgtctttctataggaaaaatgtataaaaaacaaagatagccgtgagttagttcaataccaccagatgacaggatctcggagctatgttgcacaatgctatgtcatggtaagataaaccgttgcatctctacaaacttttgtgatttttagttgatataggagcttgtatatgtccagaatgtccactagcagcttgtatgtgtcttgagtgggttgaatattcagaactattgtctaatttacagaattgtgctttggtggcgtctcggctaaaatcacccatattcaggatatgggtgattttatcccagccaacaaggtcctgcatgtgggtgattttagacaatatttcagaaaagtagacaacagtttggtgttctatgttttccttgttttggtcataagtggctgctattgttcagcttggcgacaatagtgcagccagcttttgtcgcctgcagctgttgccctccataaatgatgtgttcattgtcaataatggtttgctcgttcatctctagactaagggcattaaattggatttttgagctgctactattcatttaacttttcacgtgcttttagttaacttctttaaaaaaaatatgcttttagttatttatttttctatttgtatgtaatttcaaaagcaaaccaaatttaaggatgtgccaccaactgcgattgatattttcaaggacacccactgcagtagcaagtcaggttttaatgagaacgcaaaggatgccattgtgagtacctttccctatctggttactatgaacaacacaatagattactacatatctccatatggacatcagataatacctatatatattctggacactatcatagaaggttttattccaatcatttcatttcttccactaggttgcatttctatatggacatcattacacatatattgttctgggtacacatacataactagcatagaaaatctgattttttttttggttttattgttgctaggctcaaatggaggcctatgttgctcaaccaacagaagaaggcaaagatccaaagactcctgttgaagctgtagctcatgttctgccaaaatcaacttttcttcgcaatgttggcatgcagtccacagagatgaagaaaaatgccaaagctgctgcaatgaatgatcatgtacgtgagctagagagtgaattgcatgctgagaagatgggatcagccagaatgcaattgcagatagctgatctacataagcaattagaggaccagaaagaggtagcaaggaagaatgaagaagaaactgagaagctgaggcatcaaggaagtgaaatccaaagcttccttcgctccttgtttggcagcaagtttgcatcatcagatgctcagcagtaagctctcatactcaattaggttctagatgatattttggtaacactgaacttgcaaccattgtgattgtgggatgttattttggtgctgttgtgcttctggccgttgtgctgttgctgctgtgcttttggccattgtgctgctgctgctgctgtgaagctattgcaaatatgctgttgttgctctcaatgtagcaggaagatgaaatttgatactttggatatgtattgaattagtggatagatgtactgatattgaattttaagacttgtggaatgtgaaatgcatgtgacattgcaatcatttgtggaatgttaattcatttgaatctgattttgtatgtgctgaaatattgtatctgggctgaattgtatgggctaaaaaaaattagttgagttatgtgggctaaaaaaattatatgggctggaaaaatatatgggctaaattgtaggggctggaaaaatcatatgggctgaattgtgcgggctagaaaaatcatatgggccgaattggtgtgggctgaaaatttgtacaggctgcactcattaaaaagaagcaaataatatgctgggccaactagaaacaaccccagaaaaaaaaatatttgtggcccatgagctacatgggctttagcaggccgaatcttattttgtgacgttttttttcaaccatgtcaactgccaagtcagctgccacgtggcaagccctaggattttgtgacaataaagcaatgtcatatgcttgtgacaatagatgtacaaacgtcacatactaaatttataacggtggctttttgacgtttgaaattacgtcaaccgtttgtcacaaattgtaatttttgacataaatttcacatattatgacataataaaatgtcaaaaagccacacacctcttgtagtgagaggcttcatgtgacggtttgactcatcgggcttctcaaaaaccgcgtctttatgacctaatgagaattgagcaacctcggcttcatccatagcacaaaactccataggcaacatacataccatgttgatatccatgtcttcttctggagatgattcacctttatcaaccgattgctcctccttctcctctacaacaaccggcttttccttctctatggatttatgcctccataccgtggtggtcgtaactcattaaaccttttatctctttgttcttcggcttttttctctcttatctcttgagcccgaagacgttgcaaccttctcttttgagtagccgtcaaatccttaggcatccacctaggattcggctctgttccaggaggtaaataatgtcctctattgattttgcttagagacgatgaagccctcacatcaccctttgcaatcctcctatcaaaccggcgctggagcccggtcagaccggacgtagaccaccggtcagaccggccagatgcgcctgtcagaccgacatttggtgcgggtcagaccggcctgaagcgtcggtcagaccggtgtcggttgggcggtcggaccggcctgatggcccggtcagaccaaccacatggctgcggtcagaccggccagaggacccggtcagaccggccgactgcgatgagctggtatcggcttcggattttttgtttggggacactccaactccatctccagaaggtattggcacatcatgagaccccactttgatagtaatcacctccgaagtcctcacctccaccttgacgcgctttccttcccttttttcttcattagcccgattcttaccataaaaccggctattgtttggtgaagacaaacgctcatgaattggcctcctcggtcctccccacccttgattgaattgcattggaggcatatgattgaacattggtggcgtcgccccccatggcatgaagtaaggataaggataacccagcggtggcattggataagaaccccatgacatgtcttgtggatgatgatatgaaggggaatgtgaccgtcttggtgaatgaccaaatcgctccctaggaggtgatcttggtcttttccctttgttgcgagccctctcaccaccttgcttagctccactcttattctccttccaaacgtcaacctccggcttctttggcactatcatcttaggccttggttcgccaatgaccactcctttttccttagcagatttggcttgctccggccgaatcaactccttatcattgaaattaattgtgttcaccggaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatctaatttgtttttcttgtaaaagataatcaaaaatcttatcgcacttggccacatcaaaactatatttaacctcactttgccaatctttgcgaggagtcggcattaggttggagcaaacaaaaggcttgtttttgttagtccatgaccattcagcaacatatatatcatgatcaccctcctcctcactatcgctagcctcagggtaatcaatcacattaacattaggctttttgtcatatgttctaacaagttttttattatccttgacccggctttcttgagccaaagccatttgcataagttgactaacatcaagaaattgttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagaaaacaagcgcaatttaaaagtatcactattagcctcaccacattgcgccaaaaattgacctacatgctcccatgtggtcttaccatcctcaccactaaacttggtaaattcggaaactctataattacggggaaacggcacattatcataataatcaggatacggctttttgtaaatcctagcacgattcctagtttcaatcccgaatctattcctaataatctcactaattatatcctccatattattaggcccatgttgatttggcggtggatttggtggcctaataggttgtgtttgtggcgcaatatgattatgttggccttgtctaggatcgggaggataccccctagcaacatcattataagcattaggaacatgtgggggaacttggggactacttgtagcagtagatataggcggatcaaatgttctaagatgatacaaataactagcattagtcattggatctattccctgtatcggaataattgtgccggtctgaccggcccagggcctggtctgaccggcatccagaggcgcggtcggaccggcctgagtaccggtctgaccgccggggtaatacccggtcggaccggccgtttggccggtcggaccgacggctaagtcgcggtatgaccggccgtcaggcccggtcagaccggccgtgtgtgccgctccatcggtttttctacccgtttgatctataggaggttggttagcagtggtaaaggctttatcctttgacatgtaatcggccataagagggccgaatttaacccttaaaaactcatcaaacttaccctcaaaagttgcatctaacttatctttaaaagaaatcatagatgaatctattgtagatgctacttgttgttggatagattgtgttacctcatcattacttaccaaatcgggggcgagcttaggacgtggcccgggcttgatgatcacgccttgacgagtcctagtgcttgccctcatcaacgcctcccgtgtgagttcgttgatgtactcctccatagctttgtggtcctctccttcgaaatcctccaatgtgaccagtatcacattggatggctctacctccgtcttggatggcggcttcgtcatggcgaagtcgaagttgagttgacgatgaacggatctcctccctagcggagtcgccaaaaatcgtgttggcaactttttttaacaagttgacaagcatgatcgcagcaccttaagccttgcgatgatcctagagtcgccaaccacctcgatctagcaaagagctaaacctagatgggttttgataactaaaccagctagcggagctgatttctagataactacccgtctcgtgggcaaaacgaaaggttttcaggacaaacctacaaagagatgtcacactctcgcagcggcgccggacggtttacggcgcaaaccgacaaagatggacaaactaagagaaaactaaaagcaatatgaaaaaatgattcgattgattgattgtagattggttttttacaatgaaccagccatgtcccttttataggggttggtcttgccctctacaggccctcctccacgtccaactcagggtagaaaccaaaggaaacccgaaacatgccttcccgagcaaggaaacctcgagacctgacgaaacacagtcggactcggacctgccggtcagaccggcggtgtgtggccggtctgaccggccctcaaccggctgtctgaccggccaacacacggcggtcagactggcccactcggaggaaaccggtagatttctaaattttggcaatctttcctatttttatcccaggtgccaaatttgggtgtaaacaaatatattcctaaaaaattaagaaagtttaaaaaaggaataaaaaaaggccactttgtaccccgccggcctgctagggcatttgcgcatgcagcccatgtaaaccacaggacccaatggtgctgcggcccaagaatggaggcccacccgacgggggatcgatccgagtcgttcattttgatggacggcacggattgatgctgaatccatcaaaacaatcgatgacaagaaccctaaccctaattcacattttcccctcccctccgccttccccactacccccatcaatgctctccctcccaccaccgttggcccctttcctccttgtcgggtgctgctgcctccccgctcctcgccatatatggccttaggaggcggtggcagtgcagctcgaccgagccaccgccggcagccactccgcgcccccttctcgttgaatctggccataggaggcagtggtggcagcttgaaagcgacagcgagggctgaagctcgacggtggcaagctcatactgctcatgtctctggtgaggtttggtgactggattttttgttcgatttgtgtttttttttcccattcaccattcttcaatttttgtattttcaaactgaattttaaagttgattttaagatattttcaatgtagtttctattttagtattaaattttaagtcgctagcaatacatatataaatgttttagctataaattaatttttatctccaaataagttgtttttttgacttattagagaatactgacaaccaatgaggaccttaatctgtgttcgacggtgtgagaaagtgaaaataaatcttgttttctgcatgcatgttacccgaattgataaatgacgtgttttttcaaaagaaaaatctgtagattttttacttaaaaatcatattaattcatttttcaggtttaaaatagttaatactcattaatcatattgtaatgacttagttttttgtatcttatcattgttatcttttctcatttactcaaacactctaaggttgtgttcggcacttagggatgggaattaatccctcgcacacgcaaaacggagtaactcattaacacatgattaattaagtattaatcctattttttgaaaaaatgattaatatgatttttttaaagcaactttcatatagatttagcagtttgaaaaaacacataatttagcagtttaaaaagcgtgcacacgaaaaaaagagagaggtgagatgggaaaacttggaaactaactcagcctaagtggtggtaattttgggataaattttaaacccaaaatagcagcttttttttttggaagggatggagtaaattagcgacctcatattttcgcttatgcttatgcttatcaaccaaaatttgaattttcaacctcaaatttgaagttaattttgaggttttttcatcgaagtttattttagatcgctaagaacacgtatataaaagttttatttgcatatcacttttcgtttgcaaatatgccgtttcacttattcaacgtgaataagcaaaacgatggggctgtagaatgcaaagtgggcccacagggtgtctatgtaattgtttttctcatatatggttcatacgataaaaaaatgttaaaccgtgtgttttttgcaaatgaaaagaagagtaaatcactttgggccattttttattggcgttgtttcgctttgcatcaccctttaaccatttttttacacttttgaccgggttattttacctttatagcactttgtaccaccgtcagttgttttatccatccacatctaaattgtcatatatcaaataaacggtttacatacagctaacggagtttattgacgaataagggcaggagtactcgaggtcattcatatgcatgagaaaagattaacagaggcaagattacccggtctaaagtaaaaacattggtttaagggtgatcaaaagcgaaacatcagtaataaagatggtccaaaataaaatttactctaaaagaaattttatagaaaaaaatatcttaaaaaacatattaatccattttttaggtttaaaataattagtacttattaatcatatgctaataacttgtctcattttacgtatcttaccattcttctcttcgctcaaatacaccctaagggttagttaatttgggacaaattttaaaccgaaataagcagttatttggagatggagggagtaaattagatcgtgaagtgggcccatagctgtacgtaattacttttcgagagaatcccttatatgccactacaaattggccagtccccttatgtgccactcaaaattagcttctcccttttatgccactggttcaagtttttcgccgctcccaacactatagcgttagttgactgttagtcaaatgttagttttttaaatgaccaatatgccctctcaactaaaaaaatgtgtaaatttcaaaaaaatcataactaatttattttaaatcttttttgagtgaacaaaattttgtcagaaccagtgaaaaatgctctttgtataagtattgttggaaaactatatgttttgtgcttatattgaaaatttatttgtgatggtgatggctaaaattgcatgtgatgaaaaaaaaatcaattttcatatgttgtatccagtagctatattagtactaaaatacctaccattggttgtataccaactctcaagggcaaatgcgtctttttactatgaagttagcggtcaactggcggtggagtgacggcaatggcataaaagggaggacaaacttgaaccggtggcatagaagggagaagccaatttgaagtggcatataagggaaccagttaatttggagtggcatataaggaattctatagttcataaggtaaaaaatcgaggaatattaattaataaaataagaggacttaaatagaagaggtagagagctgacatacaaaatctaccatcggtacattaagattatcgtgtgtcctgaaacatatgtgcttccattgtgaatatctcaaaagtacacgatcttcacaagaattcaatgaaaaattgagctaattcctataaactctaccaaaatattagcattaattacccttagcaattatacaagccatacaaagagcacgccaaccagcacgtttatttttccgaagagctggctcttgccttctccaaaaactgttcattacccttattatattgaagacttgctaaatagtacggcatgtgaaacatttacataattgaccgaataaaacattctgcattttagcacattaatatgtttttacttgttggcccattatgcggcaaagccacgtctcttttcatatgttattttgagctcagatttttttttgcaagttttcatttatctaagttatcacaaatgctaccgatcattgtcacttagttaatttatactccatctcatatatatctaagaaatcaaactaattccaaataattatttatgtattctaacgaaaaatataaatattcacaggatatttttagttggtgcgccaaaggcgcaccctttttctagtctactaatctaaagccagcacttttgccgacattccattggtccacgtgacattccattgcacatatatgtagtaattgcttattttatgatatatggagcatcaagatgcagacgttgttgctatctaaaggattgtggtatattgttgagaatggctacaaggagtattctggtagagacactcttacggcggaacagaagaagtctttggtagagtatcggataacggacgccaaggccttgttcttagatcccacaaggagttgcggaaagtctatttccgcgtattatcggggccaagaactccaaggcagcatatgacaagtttgtggtgtgacatttgtcaaaaatctagtcatactgcagatatgtgctggaagaaaatgacctgcaacaaatgcaaacgaaagggtcatattgcaaaatattgcaggtcttgagaaattaatcgggctaatttttcacaagaaaaggaaaaaaaatctgaagaaatggttttctcttgccatactgctcaataagaaaataatgatgtttgggttattaatagtggttgtacaaaccacatggctgctgatccaaatttatttcgagaaatggattcatctgatccaaatttatttcaagaaatggatttatcatatcatgcaaagattcacatgggtaatggctctatagtgcaaagtgaaggctaatgtacggttgttgttcaaacaacagatggtccaaaatttataacggatgttttgctggtacccgatctaaggcaaaatttgctaagtattgggcaacttctagaacacgggtactctgtttattttgaggatttttcttgcaaaatattggaccgtaaaaataatcatttggttgccaaaataaatatggagaagaataggaattttctattaaggatgaaccatccaactcaaatggctctcaaaagtgaagtcgatatttctaatctatggcacaagagaatgggtcatctcaattacaaagcactaaagctactcagggcaaaaggcatggttcaaggccttccatttattactctaaaatccaacccatgtgaaggttgtgtgtttggaaaacaaatacaagcttctttcccacgcagtggagcttggagagcaagtgcaccgttggaactagtgcgcacttatatagttggtaaagtgccaacaatctcagaaggaggaaattggtactttatcacatttattgatgattatacagaatgatctgggtatattttctaaaagaaaaatcagcagccctggatattcaaaaaattcaaggctatggtggaaaattagagtaatcgaaaaattaaagtattacgcaacgatcaaggaggagaatatatctcaaaagaatttgagaaatattgtgaaaatgttggcattcgaagataattaacgacaggctatagtgctcaacaaaatggagttgctaaaaggaaaaatcgaacaattaatggcatggcaaactctatgctccaagacaaagctatgcctaaatctttctgggctgaagcagttaacactgcagtttatattttaaatagtagtcctacaaaggcagtaccaaaccgttcatcttttgaagcttagtatggtaaaaagcctatcattggacatatgagagtatttggttgcatttgctatgctcaagtgctagcacaaaagaaagtaaaatctgataataaaagtgattggtccatatttgttggctatgctgatggtatcaaacgctatagactttataatttggagaaaaagaacattatcatcagcagagatgtgatttttgatgaaagtgctatttggaactggaagtctccagaagcctccggtactccattattgccaaccactacaatcacactaggccaaccacatatgtatggcaatcatgaagtggaagatcaaactccaagtcaagatgcatcaagtccaaggtcaaggtcaagcttcagttcggattcaagcccgagtagtgaagagcaaatttctacaccggaattagctccaagatgtgtaagaagtatggttaaattattataatctacttctcaacaaagagggacaaaacaatatgaattttccaattattctgttgttgagtcactgttttcaagaagcaaaaaaaacataaaaattgggttaaagccatggaagatgagattcgtatgattgagaagaataatacctaggagttggttgatcgatctaaagatggagaagttattggagttgaaatgggtttataagacagctaaatccagatggctcaattcagaaatataaagcaagacttgtggcaaaaggctttatgcaaaagcctgatattgactactatgagaaatatgctcctgttgcaaggctagagacaattcgtacaataattactctagcagctcaaaacaagtggaagatatatcaacttgttgtgaaatcggctttcttaaatggctatcttgatgaagaaatttatgttaaacaacttgaagggtttttagttcaagggggagaaaacaaagtattctgacttaagaagacattatacagattaaagcaaacacctagagcatggtacagtcaaattgataagtactttattcaaaaaggatttgccaagagcataagtgaggctactctatatgtcaagaggctagatatggacattttaattgtctcacactctcactatatgttgatgacgatatataccagtaatagtgagaagatgatgcaatattttaaaaaggacatgatgaatacatatgagatgagtgatatgggcttgttgcactatttcctaggaatggaagtgcatcatagtactgaagggatatttatatcacaaagaaaatatgcagaaaatattctgaagaaaattaagatggataactgcaagtcagttacaaccccttgttgccaaatgaaaagcaaaaggcaagagatggtgctgataaagcagatccaacaatttacagaagcttggttggaagtttattatatttgaccgcaacacgaccggatattatgttattatgtttgcggcaagtttattatcaagatatatgtttagcccaagtcagttaaattttactactgcgaagagagttttgcggtatatcaaagggaccacaggttatgttatatggtacaagccagttaagaattaaaattaattggctacacggatagtgattgggctggatgtcttgatgatatgaagagcacatccggatatgccttctcacttagctcaggtatatgctcctggtcaacaaagaaacaaaatattgttgctttatcttcagccgaagcagaatatgtagcaacatcaaaagccgtgtcacaagctgtttggttaagaagaattatggaagacatagacgagaggcttacacaaatttattgtgacggtcaatttgcaattgttatcggtgaaaatccagtcaatcatgacaggacaaaacacattgtatccgggaaacagttgatcgctaggaagttaaattgctatcggtgaaaatccagtcagtcatgagcagttggcagatatatttgccaattctttatccaaagaaaaattcatccacgattgagaaatgattggagtatgcatgaagtgaattaacggggagtttgatagagttaattcacttctataaactagtaatatgcccgtactaaacgctacggtgcaatttcatttctctttaataatttttagaatttcatgttagcaaaaaaatatttttatatgatctatgcatttgaactttaattcaattcatatcgtacataaaatatatttcatgtaaagtgcagaactatgatattgcgtgggcacaataaaactttacaaggtgaggcccacatgtaagtgataagagaaaaactaaaaagcgtagggcccacttgttagccctattctccctctctatcctttcccccaaaaaaacagcagagcaagcggagacggcggcgatggcagtggtgcgggtgatggcagtggtgcggtggatggcgatggcggtggtgcgggctgtctgcggtgcattatccatttaagttgtatggataaccatataaaaaaataatccagaacaattttgtaagcatatatatatatatatatatatatatatatataatacagaccataattacaatctcaaatgacagcctagtgcaaactgacgcatctagtgcgagatagtatgtagaagataatcacacgacattccatataaaaggtgatggcgtgctgtacaaaacaagaggacgatggtgagtaacattccgatgagcaatttactatattctgcaatatttttttgaattaatttagatcatgcgaacctacctttgctcaccagtcaagaacatctttatacacgatatttctagtgctcttccctgttgaatcaacttctttctttggctttgccaaaatccttgttgttagccttgacacaccccttgacaatgcgacatataggtgaccatgtgaaaacacgggctctggaagatagatcccaacatttgggatggtttgtccttgtgatttgttaatggtcattacgaaactaaaacgtattgggaattgcttcctcttgaatttgaaaggtagagatatatcgtcggagggagacaaagggatccgtgggataaacacccttttgctggcatgttgtccaccaacaatctcagcatcaattgcattatcttgaaaagctctaaccattagtctagtcccgttgcacaatccattatttggattaaggttgcgaagaagaatcacgggacaattgatttttattattagctcgtgtggtgggagaccatttagagtaatagagttaaggtagtctagaggatagctattgtgagggtcatcatcaacagagtcaaagctgtgattaaccttggcctgccctggaaatctgtcaatcatattaacattcagcttgtccacataatcattttttgtggatacaatggcacgtgtgctcatataagatgcagagcttgcattctttttatcatcaaacgagggaaacacatgattaatcaattcgtgtactaaatcctcgctatccccataagcaatcacaatttcatcaggcaaacgaacattatcatttctgatagtgttttcagtgccatttccaattctaaggagatattccgaaaatcatgtatcagattgagccctatgttcaattattgatccaattctaaggagatattccatcaattattgatttgtttcatgatattgaagtatattattcaaagggattgtgactgtttggataacagggagaggcggtgatattttgtcacatcaaattgagattttaaatagcatccatgcattcaaattacagaaaaaacttgcataccatgacttataagcagctccttaatatgtggatatgcacatatacacgtaatagatatgtgacactatagttcacaatcacatccactatttaccagcaaatctacatttgtacttgaatagtattaccttctctgtcgtgcagtggagagggttccggagatcactttgtggtgtcgcagtagagaagggggcacaggggcaaggagtcctggtagttggcatcggcgatctggaggcgaaaatcggcgccaacatatgtttagtctatattggtgtaagcttgaatgaaaagggaaatgcaaataaaaaacatatgagcctataacatttcatcccaaaatataccactgattattgtctagtaatttgttttctcatccttctccaattcaatacatattagagcccaaccataattccataatctgaatctacactaaataacttgaggtatttattccaacacccagcaattcaaggtagctgcccatccagcttcttttacttagcattctactgataaaagaaaaactatcgtggatctctaaaagaaattagagctagcatgactaaaaatccgatatgttttattatttcagaattaattcttggcatgtaatactcaattgtagcagaaaatagcaacagatactgatcattcacgcaataacaatcacaattgaactgtatggtaaattgatatggatcatgtccaagaacccgctgtcaactggaatagaaaatatgaatgaaatgctaatacagggaaagtgctcagttcagagtgaggtaaaaacatgaccaggcagcatttttgggcagaacctcacaaaaagcaccggttgtcctactattcataataagaatatataatgtattgtaattctaaaacactaaccatgattctattaaagcggttgtcaacgtccatggccgccagtctccatccagactacaacacgcacaacagtaacagccaaaatccgtcaaaacaaacataacaaagaagtcagtctctgtatatggctcaaataaggggataaaatcaatattctcaaagatatatggctgtccttagagagtaatagaaaccctgaaaaaaaattgtcctatcaataaaacaggtaaaataatactcctacctgagaagctaatagaaaagagcattcaataatatacacggtcggcgtggaggggcgccggcggcgtcacgcgcgaaggcggggtgtcggaatcgacagatcgacggcggcgcgcggcggcggcgggagagggaaagagtggagcggcgacggttagggttaggcggcgaccggcgttgcgcggggtaggggtgaggagatgcgacgacggcggagaggcagaggggcggcgcgggagaggagagaaatcgaggagcggcggacgcgggatcgacggcgaactggcgttgggatgaactcaagtggggaggggcggcgctgcgtggggcgtcgggcatcgacggggaagcgcgtgattcgggcggagatgggggagcgcgattctggacggtgtttgcgtggacgatttcagccgttagattagatgattctggatcgttggatttgataattcaacaactcattttactcatactcatccatcattggacaaatccgatggcttacattcatctgcgttgattcaacggcaaagatcggtccttgtccacccgcacttttcctttccttcctcactctttcccctaatcactcccggatttccctttcctttccaaccgcgcacaccgacacaccagtacacgaccaaccagcccaacactgtcatgcttgtggcactccacgccggcgagacgccgccgccgtgtcacctgctttgacggctccgcttctttacgatggcctctatcgacgacgcagcttctccgcacgccgctgacatccacggcgagagtccgtcgccgacaccaagtctcctttgtcggatcgtctccccataaccgcgagtccgtctcctgcagccgcacctgccgtcgactgtgtggggatcgattttggagatgaacagtgggcatggcggtggccgtcgttcgtgcttggggggataccaattgcgagcagtgagcctggccttcctatcccatgggccatggcgccgctgattcccggaacagatacccggcggcgcccatgccgcccatctcctgacgtttgcttccacgagtccccacgcgccccagcccatggcgccctcctgtgtgttaaaaatttggttataattcgacatattttaatccaaaatattaagacaataaacatgacatacataattagaagcgatcttgtgataaggctaaacataaacatgagcatgcttaagataaaataagcatagccatcgttgacattcacataagattgaaatcctatggataacattgtgaacatgtaaataacaagaagaaaatcaaataaagttagaatcttatatccagagaatggtgcagaagatattgaggcattcgtattgcttccgttgatgttgtctcctccgttctctcaagtagaagccatggtgaaccagaagtagtggaagatgaaacgttgtcgtcgaagaacgaagaacaggagcagtcgcgcttcaagcgctacccaaaaacttgatcgcccacctacccgtgcaagttctcaagcggacggagtttcggaggcacctgctcgtcccgtacacctgtgcgcgcaggtgaacagaaccggggaaggattctgcagctcaggaacagaggaggaggaactcgaagtgcaagagttgggaagaacttctccacgtccttcacgtcgctgcagagtatatacatatatatatatatatatatacccatatgggactccatggtgcccgggctccaaggtataaaacacacaaaatctcttgaaatttttttaaaaaaataaattgtgagtatatacttaggtatatgaatttgattcataccaatacctaacaacaaaataactcaaactcaactttatttcacaattcattattacatacctagcgaattatatgctttgatgttatataactagaaccaaaatctaacaaaaagaaaagttcaaactcagttcaaacttgtttgaacttgttagtaaagaagttaaagttcatacctaaatatttaaaaaaaattcatactcattcaaattgggtatatactcaattttaatcttcgagcccatactccatgtagcaccagttaaattacctatatatatatatatatatatatatatatgtgtgtgtgtgtgtgtgtgtgtgtatgcgagcgcgagagtaacgttcggagtcatcaaccgccgtgtttaatttcgtaaccgacgcgctcgttagttcggaatcaattcacggcgtttaattccgtaaccgacgcgctcattaatacgaaatcaattctccatgtttattaccgtccgttacaaagtgagagagagaaaacagctgtagctgcctgcctcgcctcgtcccaccccacctggctgtccgcacaccatctcaaccggtcaacagagacttttcactagttccgtatttaagttgagacctcttcacatagatttccaaggtggtattattacccatagcacttaatgtgggccaatggaatttattaggatttaattgggcctaacccattaatctaacaatccccaccaaatttcatggctcacaagaaatgctctcgattctgatcctgtttgttataccagtgtttcggtggagacttttaagttggacatccacctaggaaaagagctacaccagatcacaactgaacagtggactatgccttgaattatcagtcttgtgcgattcaggtttcactcaaacccttaaatggtactggactatcgtttgcatcccctctgtttggagcatataagtcatactcctggccttttcatgagtatctagagatcaccaagatctcatagactgtgactagcagtcggactcatataggtatgttccttctaagatgttctgtaggccaacatctctgctttatgaaaagccactcggatcacattaaagtgtataccatcctaccatacagattagaagagaagtgcatcatgaagataggctcattttagggtctcttctctcagctacactatagtttgttttgccatccaaattcacgggatctccgatcacaatggacaggtttccactattgtccaactctaagtgggtctcaagcccatctccctcgatgcacagtctatcacattacgtggtagccccttggtaaactgatctgccagattttttgccgtctagacatagtcgaatgctatcactccggagtttttctgctttctgacagacttcagtcttcttttaacatgcctggatgacttcatgttgtccttcgaactgttcactttaataatcactgtttgattatcacagttcatcaggattgctggtactggtttttcaaccactggcaagtccatcaggagctcacgaagccattcggcctcaactgtggcagtatctaaagctgtgagttctgcttccattgttgacctcgttaagattgtctgcttgcaagacttccaggaaacagcgccccctacaagtgtgaacacatacccacttgtggcctttatctcatcagcatcagatatccagtttgaatcactatagccctccagcacttttgggtaccggcgtagtgaatttcatagctcattgtcccttttagatagcgcattactctttcaagagcatgccaatgatcatctcccggatttaaaacaaaccggctcaacttgctcacagcaaatgagatgtcagacctcgttgcactagctaagtacatcaatgaaccaatgatctgagagtatctcaattgatcccttgctattcttcggtttttccttaatagcacactgggatcataaggagtaggagctgccttgcagtcactataaccaaagcgactcaagaccttgtccacatagtgagattgcacaagtgtaatcccaccctcatctcctctcagtagtttaatgttaagaataacatgtgccactcccaaatccttcatttcaaagcttttggacagaaagtccttgacctcctcaatcacattgaggctggtcccaaagatcaatatgtcatcgacatataaacacaagatcactccctctaccccaccatagcgatagtacacaatttgtcagcttcgttcacaacaaagccagcagatgtaagtgtattgtcaaactctcatgccattgcttaggcgcttgtttgagaccatacaaggacttcaacagcttacacaccattcccttctgaccttctagtacatacccatctggttgatccatatagatctcctcctccaactctccattgaggaaagctgtcttaacatccatctgatggccgagtagaccatgagaggctgccagagcgagtagtactcgaatcatggtcaagcgagcaaccggtgaataagtgtcgaaaaagtcctcgccttctttttgggtacaacccttggccacaagccttgccttgtacttttcaattgtatcatcaggcctaagctttttcttgaaaaaccattcgcattctacaggcttgcacccatatggacgctcgacaactttccaagtaccattagacataattgagtccatctcattgcttaccgcttccttccaatagtcagcgtcaggagatgaatatgcctcttcaatggttcttgcagtatcatccacaagatatacaatgtagtcatctccaaaagactttgcagtcctttgtctcttactctttcgagttgctacaatgttatcctcctcaggattttcctcaagcgtttgatcaatatgttcttcggcacaaagtgctcaggggataaaataggttcttgactagaagtgctaggtgcatttttcataggaaattcattctaaaaaaatgtggcatctctggactcagtaattgtaccaacacgcatgtcgggtaatccagaatttactattaagaacctatatcccacactgtggatagcataaccaaggaacacacaatctacggtctttggtccaagtttacgctttttggctataggtacatttagcttggccaaacagccccatgtgcgctggtgagagagatttaatttcttcctttcccattcctcgaatggtgttacttccttatgcttagaaggaattctatttaggacatgacacgcagtcaatattgcctcaccccaccattccttggaaagtcctgtagtgtctaacatggcattcaccatctcagttagagtgcggttctttctttcggctaccccgtttgactggggtgaatagggaggcgtcttatcatgaataattccatactcttcgcagaaagaaataaattcattggaaaaatactctccacccctatcagacctcaaccgtttgattttcctttccagttggttttctacctcagccttatagatcttgaagtaatgtaatgcttcatcctttgatttcaataggtacacatagcagaatctagtgcaatcatctatcagtgtcatgaaatatttctttccccctttagtcaacacgtcgttcatttcgtacagatcggaatgaacaagttctagtggtgccaaattcctcgcctcagatgccttgtgaggcttgcgaggttgtttcgattgaacacaagtatggcacttagagcctttgactaaagtgaattttggaattaaactcatgttggctaagcgtgtcatacaaccaaaattcacatgacagagtcgtgaatgccacacattagactcatcatcatcattgcttacatggttcacaactttattacacatatcatccaaggaaaagcggaacaagcctccgctgtcataaccttttccaataaacgttccatatttagatatgacacatttattggattcaaacacaagtctaaaaccatctctacacaatagagagccgctaactagattcttctttattgaagggacatgctgcatgttcttcagctgcacgatctttcccgaagtaaactctagatcgaccgtaccaacaccatgaatagccgcaagcgatccgtttcccatcaacaaggagaaacctctcccgacctgataagaagaaaacatggaaatgtcggcacacacatgaatattagcaccagtatcaacccaccaatcaggtgagtgacagacagagagaactgtaggtaaaaatttaccatacctcgatgttcctccgccctcactaataaccatgtttgcagacttcttgtccttgcgctcaggacaatccttagcccaatgcccagacttgccacacacaaagcaacctccttttgcctttctcttgcctttcttcttaaaattggttgtagccttgggtttgacgtcaggtttgacttttttgttgttgttgtgggatgcgtgagggtcttcttctacaccaaattggcgctagaacctctctcgatctttttgccccggttgtcctttaccctcgcattctcctcaacacccaaagagccaataagatcagtaacactgaactcttgcatcttgtgttttagagaagtagcaaagtccgtccaagaaggtggcaatttgacaataatgccacctgtcacaaacttgtccggcaactcacagttgttgttctcaagttcctttgccaacatctgaatctcatgagcatgttccactacagaacgatcatcgaccatcttgtagtcatagaactgctccatgacatacagctcgctgccggcatcggaaaccccgaacttggcctcaagagcatcccacatgtccttccctgaaggcatgtgcatatacacgtccacaatattgtcggcgagcacactgatcaatgctccacagaacaagcaatccgcagccttgaacttagcctcctcctcaggtgagagaggcggttcactcggtttgccccgtgagacaaacaaacaatgcatcgccgtcaaccacaaaagtgcacgtgctttccatcttttataatttgaaccatcgaaagcatatggttttagtgatgcaacaaagtcaactaccgaaaaagacctatcaagtttttggattgttggaaatttggtcataattcggcatattttaatccaaaatattaagacaataaacatgacatttgaaatttgagtagatctagcgacagtgctagatgtgtaatagtgaaacgttgtaccccgagaatggccctccgttggagtttgaggcagtattgcctccgttggtgttgacgagaggctccttctccttgtctccagtgttgttgttgtcaccggttgtcgacatgttggtgaagatgatgtagagcagtcgcgcttgaagcgctacctaaaaacttgatcacccgcctacccgtgcaggttctcaagcggacggagtttcggaggtacctgctcgttccgatcacccgtgcacgcgggatgaacagaaccggggaaacaaagagacagcgcaggaacagaaggagagtatcgccaaggaacaatagtaggaggaagacacacactttgacagcctttgccttgcgttatatgtagagagagagatctccattaccacacaaataaatctcatttgttgtgaaggttaccacaaaattaatctcatttgttgtgaaggttaccacataatgaatcttccatttgttatgaaggttacaacaaataaatctctcatttgttgtggatgttacaacacaatgaatctctcatttgttgtggaggttacaacacaatgaatctctcatttgttgtggaggttacaacacaatgaatttcatttgttaatggtgactttattctcatctgttacaaaacgaaagagcagcaggcaggctcggctcggtcggccgcctcgcctcgctacgcccacggccgaggccgactcggcatgcgcgcatgcgtgtggcagtccaaccatcacctcaaccggtcaacagggaatctctaatatcaccctatttaagttgaggttcttccacctaaattttcaaggcagtattattctctctaacattacttgtgggctcttgagattttagttgaattaaattgggacatatgagacaagaaagttcgcttcatttgatggcttttaacatgatttcacactttttcctatggttcgtccagatgagtacaggcctagcagtgacttccatgcatactcttttcatgtcatcctaccataccctctgatttggtcccgttagtggatacaagcctaggcgagattctcgctctcaggttcggtcctctacgagcggatacaaatcacggatacaaacataaattttgcataattcaccataaattaaacaagcacttgcttcggtcatgcttcatggcttcgagccatgctagtagtgatacaggcatagtgataaacaaaattaattgagcatactaattaattagcacgcacatttgctagttttgacatatgttcagccatatttctctaacaagaattaaaataaaatggcgtttattttctttccgtggtcagagataggaaatagatgtgcgcatgcatatattttctccttccatctattcatctacaaaatgttggataaatcacgaactacgccgagtcatgacggccggccataaaattaaccaacactcgcttcggttacacttcacggcttcgagccatgctagtagtaatacaagtggagtgaaaattataatctcaaaatcatctgcatacatatatttgcttaaaacagtgtatatatactcactgcaccatatataaagtgtagtataaaaaataatctgatatacgcacatgcatgcatccatatactctggccgtgcattttccttccaattgcaaattaaccatgtacgcacaacaagtggcgacatcgtgatagtcgaccataaatcaaacaaatacccacttcggttacgcttcatggtacagggccatgctagtagtaatacaggtgtggtgaaaatcaaaataggcaatgcaatgtgccgcaccaaaatccagtgacatgttgataataatggcgctaaaataaatactcgtttggctacgccccgcgagtgctcaggaaaaatttatatatgcgtgctacatataggaaaaaataaagtcacaatgccaaacaaggaagctatgtataaatttgctaccatacacgcagtgatattaaaaaccaacaaattagtgggcatctaaaatacttggacgcccaaaataaaataaacatataaatggaaatctacagaagattctacggctgcgacatctggagctttaggatagattttcctttttagccttttagcggtcatgtaattttattttctttcatgttggaattcctaatcaggggttttctctacggagatgtaattaacagaatttctatgtaaatgtatgaattctggaagtaatggactcgcaatttctgatttttatttatttattgcatttaaatcaaattgtctgtaatgatttgtagatagcagacctactattacgactgtcccggttttcccgtcgtcagattctggcacgcccggtgggacatacttctcccctcatctctgagttccaacatgtagaccgcaaatatgcaaaaaaaaaaggagataaatgcacatatccttagtagaaaaattcacgtactcatgtgcttcatccaaagcgctttatgaaattattatatgcatgctatggttttacagaaccagatcggttactcaaggagagggacctaaaccggtcaaatgtagtcattcacggcttcaaccaagcaggccaagaagccttgagcactatatcgttggtcctaaaactggaaccattgtccacctatgtgaccttccgtataattgatgccactacttcatataacgcgttacttgggcgcccatggctgcacgagaaccaagtagtgccatctactctacataagtgcatcaaatataaggataaatcaggagaaactgtgagaattttcgccgatgaaaggccattcacggtggctgaatccttttacacggatgctaaattctacattgagcccatcgaaaagatacagaaaccaaaagcaaagtcgctaacagaacatttcgtcacaagtggaagttatggtgaatcgtcttcaaaccggaaaatataccaatatataccaagcaaccggagaaaggagggtgagccaatatttcgtataatgaataggccatccgctagcaaagcaaatgggatatgacacccttaccggaccatctctatgtgatggccgagggcagctcgcgccgttcgagaaaatattgtctcaagcacagctcgaagcgttgcagcaagataagaaattaaaagagaagaaatatggacttggttatcaggtttgcaggacctcagccaagctcgtggacgcaacgatggcatctccacaaatggaggatgggaatcaacccaccatcgatgaattggaagaaatagatattgggacacctgatatcatcgcccaatttttattagcaagcacctatccgaagaaaataagaaaaaaataccataactttctttcagctaacaaggacgtgtttgcttggtcttatgaagaaatgcctggtttaagccctacggttgctgtccaccagctagctgtgcaggaggatatccccccggtcaagcagccgcagagaaggttccgaccagagctcctcccaaaaattgaggccgaggttgacaagctcatagctgtcgggtttattagagaagtcaaataccctacatgggtctcaaatattgtacctgtaaggaagaaaaataaccagatccgcgtatgtgttgattttatagatttaaataaagcatgtccaaaggacgacttccccattcccatttccgaaattctgaatgatgccactatgggatatgaaatattctcctttatggatggtttttcaggatacaaccaaataaaattagcaccggaggacgaggagttaaccgcgttccgaacgcctaagggcatatattgttatgaagtcatgcccttcggattaaaaaacaccggcactacttaccagcgcgccatgacagtcgtcttggacgggttattatatgaaattgtcgaatgctatatagatgacatcgtcatgaaatcaaaacgcgaagaagatcatctgcaacatttagccatagtgttcgagaccctcagaaagcacgaacccaaaaggaaccctatgaaatgtgcatttggtgtattgtccggaaaatttctcggatttatagtcatgaaacaaggaattcggatcaacccgacaaaaatacaagcaatagtgaaaatgccaccacccgtgaacctacataagctgaaaagtcttcagggtcacttagcatatattaggcgttttatctcaaatttatcagggagatgcaaacctttttcccgcctgatgaaaaaaggagttccatttcagtgggatcaagcgtgtcaaaatgcattccaagatattaaaagatacttaattaatcctccagttttaagtgctccagttaaagggcggcctctcatactatacacggctgcgatgcctacctccctaggtgcactgttggcacaaaataatgatgatggaaaaaagacagcattatattatctcagccgcacattagtgggggcagaatgcaattatttagacgtggaaaaaatatatctagcgcttgtcttcgcagcacaaaaacttcggcactatatgctagaacacaccatacacctcgtgtcgggggcggacccattctgatatatattgagtaaaatggtcctctcaggaagattagctatatgggcgatgtttttgtcgcagtttgacattatatttgtcccacaaaaatcaataaaaggacaagccttagcaaacttcctcgctgcacatccaattccggatgagtttcccattgatgacgacttacctgacgaggaagtatttgcgacctcaatttttaacccatcatggaaaatgtattttgacggcgcgcgtcgccggtcgggggcaggcgcgggtgtggtttttgtcacacccaacgaaagcataattccatattcgttcactttaacgacggcagtgtctaataatgctgctgaatatgaggcactgattgtaacacccaaaaaaaaaggtttggttgttggttttgagttgctttacagaagtaaataagttcgatagaaattaatggtagaaaaaaaaatacctatagaagtggaccaacctgggaaggcccataaacccagcccattgtttcttctctaataccctagaggaggaggggccggattcccccttctttccccccaaacgacgccaacactgctgccccctccctcctttgtacggtcttgggtgttctctcctctccacgacatttccactttcatagatctgttgcgtcgtatgatgaatcaagaaactagttgtaaaaacggaatgagaaggaggagaggaacaagaggagtggtgaattggtgtttcccgtcatctttattcttgttctccataaaaccttaggtgagacttccccactgttttaatgttgtttttgggtgtttttagagttgcaattcgtgggtaattagggtttagataaggaggttttgttgctatgattcggattggtaattctactctcgggaagatttacgaatgtaacacccaaaaaaaaggtttggttgttggttttgagttgctttacagaagtaaataagttcgatagaaattaatggtagaaaaaaatacctatagaagtgggccaacctgggaaggcccataaacccagcccattgtttcttctctaataccctagaggaggaggggccggattcccccttctttccccccaaacgacgccaacactgccgccccctccctcctttgtacggtcttgggtgttctctcctctccacgacatttccactttcatagatctgttgtgtcgtatgatgaatcaagaaactagttgcaaaaacggaatgagaaggaggagaggaacaagaggagtggtgaattggcgttcccgtcatctttattcttgttctccataaaaccctaggttgtggtgctccggatcatgcttggtatcgtctctttattgttcgagtcttttcatgtatttgctgtgacatgtttgcatgaaaggatgggattagctacacagtcgcacaacatgatctcacttagtcatgagtattgtaatatgctgataagattacttgtgtttagaaataatgggctaattaattactagagttgttgaccattggttaactacttttttcaagcctatccctacatgtcagtcaattgttgtatcataaacttaatctatatgttgatgcttctgcgatgtttttttttctaaggtagttgttaccgaaatttgcttgttttggcacttatgtgtggttgtttagtggcatctagacttatgtggttttctggggtgttacactgataatcggccttgagatagccttgaatatgcggctagacacactctatatatgatgattcacaactgataatcaaccagcttgctggaaanatacgcagtaaaaaaggaaggtttaatggcttactccctccatccaaaaatgtttgacaccgttgacttttttaaatatgtttgactgttcgtcttattcaaaaaatttaagtaattattaattctttttctatcatttgatttattgttaaatatccttttatgtatacatatagttttacttattttacaaaagtttttgaataagacgaacggtcaaacatgtttaaaaaaatcaacagcgtcgatttaggaaaggagggagtatttcacgagagcaaaacaactcatggccatgttcgcaaatctaaatatcgaacatgttgttagaagtcaaaatgagagagttgacgctctaaccagcttggctgctagcatgtcagtcaattcttattaaataatggacattcaagttgagcagcgtagagtattaccggtactcattgaaaaggaggaagaaattccatcggcagctatgataaccgatgttcacgaaatagaggcaggagattggagaactcccctcctggaatatttattgcacggatatttacctttagaagcatccgaaagatctagaattagaaaaagggtgactcgttatacgtgcattaatgacacgttgtactgacgtgcatacgacggaatgctactgcgttgcatcgcgggtgatgaggtcgtagacgctttaaataaagtgcatgctggagtttgcggtgcacatcagtctggatctaaattgtactatcaattaaaacacttaggttattattggccgactatgtttgaggattctatgaaattctcgaagaaatgtcatgagtatcaaatacacgctgactttatccatcaaccacatgagctgctgcatcctactaacatggcatggccattcgaaatgtgggggaatggatgtagtcggacaaattcaaccgccatcatctaaaggacataaattcatcctcgccgctaccgactatttctccaaatgggcggaagtcgtgccattgaaagaggttaaagctgaaaatgttgaaaattttattaggacacatctcatataccgttttggcatcccttctcggattatgtccgataatggttctccattcaaaaatgcactgatcgaaaagttgtgcgcgaagtttaaaattaagcataatttctccacagcatataacactgcggccaatggacaagcggaggcgttcaataaaactctctgtaaacttttgaagaaagtggttacaaagaataagcgagactggcatgataagctgctcgaggccctgtgggcatatagaacaacaacacgcacgccgaccggaatgactccttactctttagtgtttggaggggaagcgatcttacctatagaagttcaaatcccgtcactgagggttgctattcatgaaaatatagcagaagtcgaagcggcaaaacaacgcggaaactctaatgcgcgatcgatcgctaccgcgatcgggtagcgatcaccacctctcccccctccctccctccatgtttcattttttggcaccgcattactttcctattttagtaaatttatgtacctaaagtttatacacctaaagtttatagacccaaagtttataaatcaaaagtttatatatccgattcaaatttaaatttgaattcaaatatttttatagtatttttatacatctaaagtttatagacctaaagtttacaagtcaaaagtttcaaatttgaatttgaattatatccgattcaaatttgaatttgaattcaaatattttctatatatagtatttctatacatctaaagtttatacacctaaagtttatagatacaaagtttataagtcaaaagtttacataccgattcaaatttgaatttgaattcaaatattttctatatatagtatttctatacatctaaagtttatacacctaaactcaaagtttataagtcaaaagtttacatacccaattcaagtttgaatttgaattcaaatttttatatatagtatttctatacataaatttttctaactttttgtttttttaaattttttttgtggtttactgtagtagaaggggaggaggaagaggggagagagagggggagtagggggacggaagggtgatcctggagccatcacccgcccattaggcgtgcccaaaacaacgctta

SEQ ID NO: 28454 - DNA, 22631 bp, Oryza sativa
tcaaccgcccattaggcgtgcccaaaacaacgcttagatgaattagagaaattggaaggtaaaaggctgcaggcgttacaaaatttggaagcctatcaggctagagcatcgcgagccttcgataaacggctcaaaagaaggtcattcaaacaaggagacttagtgcttgctcttatccgccctatgaatattacacatcgaatgtagggaaaatttgagccaaaatgggagggtccctatgtcatgaggaagtagcgcgtacaggatcatctcgccggacggtgaatattatccggcacctataaatggaaaattcttgaaacgctattatgcataaaaaggataaaataaaaataataacaaataataatgaaaatactgcaccaagatctcaagtgcctaaactgtgcaatatataagaaataggggtgtgtgtgtatataagctaaaaatgaatcatacacactccatcactaaaataataataataataataataataataaaacaaacgctccatcgccgcacgagcttaaactgtaggcgacgaaaaaaaatcactcgcgctccatcgcagctcgagtttaaactgtaggcaacaaataaaaaataatcacacacgctctttagctttacaggcctacactataagcgtaaaaaaaacaaacaaatcacaaacactccatcactacaagtaaaaaataataataataataaaacaaatgctccatcgctacacgagcttaaactgtacgcgatataaaaaaaaatcatgcatgctccaccgctgcactgcacgagcgtaaactgtaggcgacaaaaaaaaaagcccacggctccatgagctcaacctctgggtgatatgtttatacatgtatatgtgggcttaaagactagtaaatgatgatagttaataaagttaaaacaattaaacactccaaagcctcaggtattcggagtgtggcgtacatgtgcaaatactgacaaaattaataaaattccccaaagtccgcaagtgctgaccaaaacaaattgcagcacagagtattgaccttcagagtcaagcaaatgtgctccttaattttctcaacaacgtttcttacaacgggcacaggaatagttgtgactataaacctcacgtgcaacaagtccctacgaatccgaaattatatgtcgagctccggatgcaaaaacaaaattttgacacccgcagctcgagggaggatctgttgacaccaatttcggctcgtgtcttaaacaaggtatattcgatataaattaatgtataatctcaaatataatgtaaaaatataataaaaaataaagaaataaaagtggaaataaacagtcaaaacagtcaaatgaataaatagagtaaaatggcgaccaaaaataaatgtccacaatataaaatctctcatttgttgtagaggttacaatacaatgaatctctcatttattgtggatgttacaacacaatgaatctctcatttgttgtggaggttacaacacaatgaatttcatttgttaatggtgactttattctcatctgttataaaacagatgttataaaacggaagagcagcaggcaggctcggctcggtcggccgcctcgcctcgctacgcccacggccgaggccgactcggcatgcgcgcatgcgtgtggcagtccaaccatcacctcaaccggtcaacatggaatctctaatatcaccctatttaagttgaggttcttccacctaaattttcaaggcagtattattctctctaacattatttgtgggctcttgagattttagttgaattaaattgggacatatgagacaagaaagttcgcttcatttgatggcttttaacatgatttcacactttttcctatggtctggccagatgagtacgggcctagcagtgacttccatgcatactcttttcatgtcatcataccataccctctgatttggtcccgttagtggatacaagcctaggcgagattctcgctctcaggttcggtcctctacgagcggatacaaatcacggatacaaattgcataattcaccataaattaaacaagcacttgcttcggtcatgcttcatggcttcgagccgtgctagtagtgatacaggcatagtgataaacaaaattaattgagcatactaattagcatgcacatatgctagttttgacatatgttcagccatatttctctaacaagaattaaaataaaatggtgtttattttctttccatggttagagataggaaatagatgtacgcatgcatatattttctcattccatctgtttatctacaaaatgttggataaatcacgaactacgccgagtcatgacggccggccataaaattaaccaacactcgcttcggttacgcttcacggcttcgagccatgctagtagtaatacaagtggagtgaaaattataatctcaaaatcatctgcatacatatatttgcttaaaatagtgtatatatacttgttgcaccatatataaagtgcagtataaaaaataatctgatatacgcacatgcatgcatccatatactctggccgtgcattttccttccaattgcaaattaaccatgtacgcacgacaagtggcgacatcgtgatagtcgaccataaatcaaacaaatacccacttcggttacgcttgatggtataaggccatgctagtagtaatacaggtgtgccgcaccaaaatcccgtggcatgttgataataatggcgctaaaataaatactcgtttggttacgccccgcgagtgctcaggaaaattcatcaatttatatatgcgtgctacatataggaaaaaataaagtcacaatgccaaaaaaggaagctatgtataaatttgctaccatacacgcagtgatattaaaaaccaacaaattagtgggcatctaaaatacttggacgcccaaaatgaaataaacatataaatggaaatctacagaagattctacagctgcgacatctggagctttaggatagattttcctttttatccttttagcgctcatgtaattttattttctttcatgttggaattcctaatcaggggttttctctacggagatgtaattaacagaatttctatctaaatgtatgaattctggaagtaatggactcgcaatttctgatttttatttatttattgcatttaaattaaattgtctctaacgatttgcggataacggacctactataacgaccgtcccagttttcccatcgtcaattttctatatggatcatctatgtgatcctaatccatgcaagatttgggactaactatttgattgctcctgaactgatcttcagaaaatactctactgttaggtgttagattcagaaatgctgtcttttccggtttgttgaaattagttccaatttgaagaaatcatgtttgacttttagtgattgaattaatttagtggcagagaaattagaacaatagcctagttaactactttttctcaggaagtatttaggcccttcatcagtgtatttgcagaccttgctgaaacattcaggccatacctcctggaaggagaaaatgttgctgcgcagccttgctgccctcagatgttctttatacactgatgaagaacaaaaaaacatagagagcaaaaaaaaaagataaaattttgatagaattataacgttaaaactgttagatttttttcgacggataaaatataatgaatttgaggttaagattttacacgtaagtataatactattgaaagtacatgcattattttttctagattttttggtgatatttattagttggtatgtacggtgtatacaagtgagaacttgtgtggataggatatgtttccaacttgtttatgcccacatgttaatggaatagctcttcatcaatctatttatgtggacatatgttgtcttaaaatatgtattaaagtgactatatataatggtgaatgttcttaattattttttctagacaatataatatttttgcattttgtcttaaatatatttttttatatgatcgcttaattggatcgattctaagaaaatcaattttactgtcatcaaatttaatgatttattaactaaaatattatgtcatcgtagcgtagcacgggcatattactagtaggagtgtagttggtgaattatagggtaggtttgtagatgtctctctaagactgtgtttagatccaggagtgaaaagttttagcgtgtcacatcggatatacggacactaatttgaagtattaaatgtagactaataacaacacaaattatagattccacctataaactgcgacacgaatttattaagcatcattaatccattattagcaaatgtttactcagggccgtgccatcaaatttgtaggccctgtacaaggctctaagtgaggcctaaatcaagtaccaaatatagctaaaataatgtatatactgcagagcaaatgcgatatatcaacaacagtacatttttgaactcttgttttataatcagaaactgtcaaactgaaaatggagaatgttcgttgctgttgctagcttgctgcctagtgccttgcttgttggttgcttgctaagttgctatatgctagatgaatgaaaatatgaaattagatgagccggctagcggcctggcgctcagaagagacgagacgtcgagactcgagacgaactgaataagtcacagatacgaaaaagaaatacaatacaaaaagccgtgaggcctcggggctcggagtcgagaatacgaagcgccacgcatgtgaagtcgccacgcggagatatgcgcgtactcgaacggggttctggcgctctggcctcacacgaatacatgggccttctctggttgggctgattttttgaggccctggaaatttggagaccctgtacggtcacacaggtcgcacgcccttctgcatggccctgtgtttatgtgtttattgtagcacaacattgtcaaattatggactaattaggtttaaaaaattcgtctcgcaatttatacgcaaactgtgtaattaattatttgtttatctatatttaatactctatgcatatattcaaacgtttgatgtggtaggataaaaaaatttaccagggaactaaacaggccctaactctccctaccatacttgatactagtaccaaaagtcaatgtgcagtacaaccattatctgtaaaaatctagagaaagtgtagactctccctacatgtatgcagtgtagtagtactaggagagtactagctaggatgggtagatttcttcggcttctaccatagggtgtgttcgctattcatggatcccaatcggatccttccacacggaaaacggagtagttcattagcgcgtgattaattttgtattagctttttttaaaaatagattaatttgattttttaagcaacttttgtatcgaaactttttgaaaaaaaacacgccgtttagcagtttaaaaagtatgcacgcgaaaaacgagagagaggttaggaaaaggggcatccgaacactccaatagagtgtcttcgatactcacgtttgggaacggtactctctaccacggaaaacggattagtttattagcacgggattaattaagtattagctattttattaaaaaaggaacaatatgatttttaaacaacttttatatagaaatatttttaaaaaagcaccgtttagcagtttgaaaaacgtgcgtgcgaaaaacgagaaggaggggttgggaacccggaaaaaccaatgcatgtgtaagtgcctgatgatgtatccattcatcaaacaagcaagctactagtagggcctctcacagtgcaagctatgtcgcccgtacccctagcccaaaaggttggtccaaaaacacccacctcatagtgcaagcacccatatatgtatggtttaattggatgaaggcactagtaaaggtaccaagcccacagtgggtgtgaccctagacgtgttaccacacatttatttctctcaattaccctcgcctgctactcacgcgagtattcttctcctctcctcggcgcgaccgcctcctcctctctcccgcatcgccgcgcctcctcctctcctgccacgccaccgtgcctcctcgcctcccacgccacggcgcggtccacggcgccgcctcgtcgcaagaaaccacgcgcgcaccggcgagtctttcccctccctctctgtcccacgctctgcttctcctccctcacacgcgccgaggaggaagcgggcacgggagaagggcggaagcaggcggcgtccccggtgacggcggtccggagtagggcggacttcgccggcggtggtgttaacgaccaaatttgataagatatgaaccaggttcgacattggaatcgaagcagattcggcaaagagatggattcgaagaacagagtgtgcatcggttgtgaagacatcggttggggtatgcatcggctgagatggatcggttagaggatggctgatgcaaccaatagagctgatatagctgatttcgatggagatagcttcgaggctgtttctggaatcaatcgatgtgcttaacaaggattgccacaatggagataaagctctcagataggcaattgtatctattaattaggatatcttatgtaatttctttagagatatgtttgggcaaaagtctgccgcaaagacttatagtgtcttagagtttgttagagatagtagtcgtgtccggcaatgacatattttgtatctcgggtataaatatgacccgaacccatgtaatcaaacaacacatgttcaataacactttcggcgcatcgccacccttttactttcgttctattttgacgagttcttgctttcgggttgagctgcatcgattcaatcttcaactagaggtaaacttgtcatgacggtttgcgttctcaggattagtgcttccatctttataacactctaatcttgtttatgtaattttttgagttatcatatatactttataatctctattagtttcgctatataacttgtcatcggctagtttttactgttagagagtagccgatagagttagatctcattattaatctagattataccgtatatctaccatctcttataggttttcatcatcttgtttagatcttacagttatctttatgcttaatgctgcatcggttgagtttgatctattaagtttatctataattgtgatatctagcctgttttatgatcatcaatagagatagtatcagagtttcagccgatcttacctgatttagttattcttatctcatatgcttgtttgttatgctaaatctgccctttatattaagatcttgttgcattgaagttatattaggtttattatttaatatatcttgcttgtctcaaatcttgatatagagtggtatcggagtattagccgatacatggtagatctatctgatcggctatgctataaacttctatataatctttgctttaatatatatttcgacttaagtaatttatactgtcttggcatgatgaccgatctatcccaatcacttagttcaagtatataccgaagtaaagattatatgttgttaatatctacagccgattgagtagatttagttttatcatttttattcattattgccgatcgagtcaaacatgacatcggctcgaagataaatgatatgtcattggcaactagccgatcggctatcatttatggatttaaccacggtttttcttattcttgttgattgcatgatcaaatcaactggcacgctcatgaacctaaaggcgagattttggacctgcaaaggagttaagcagatcttccaggccagtgtgtgtttttcacatcaacagacgactggcgcactggcgcggcggcgggaggcgtccccggtggcggcggctggcgcggtgtggcggcgagcagccggagcgtggggctgcagttccggcgccgccacaaccggatccagcggttcagcgttcgatctggccggggtcggcaagagtggacggctcaacgccgacgggcggctggcagcaggagcggacggcttctccacctcgccgatttcccccttccttttctctaccaaattactcaagaaatattgttggtttggtccgcatctgtggtggtttccttccttttctctaccaaattactcgagaaattttgttggtttggtccgcacctgtggtggtttgggagggaatttgttgtgcgtttggggggatttcagttcgtcgatgattccgttggagggtgatttggggttttctgtaggtggattcggcgcgagggcataaggcagtgaagaaacgctgcccacagcgcgcgtgcctcgcttttccctgtccgctcgcgccctcgccgcaacaaagtttcgcatagctcaggtaggggacgagaaacctagctaagggacgggccccgtcgccacgtcgacctgaatccgagctggcgcgacgaggtcccggtccagctcaccgcactgtgagaggcctaaagagctgtctactcttgagctgtccactcttgcatcacacttgctcctcctccagtacatcctctgcttcagaacgtgctcaacaaatatttaagcaccaacatcctctagtttggaagctgtgttcggaagccttggttgagaacccaacttctatgcatggaaaacggagcattccattagcacatgattaattaagtactattagctaatttttttaaaaaaaaaatggaacaatatgatttttttaagcaactttcgtatagaaacttttttaaaaaacacaccgtttagcggtttgaaaaacctgcataccgaaaacgagagagattaatgaaccctgagttcctctcaacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggatggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtaataggtggccgaatcggattccagcacttggaggacttgatcttgatatcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatacaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaaatgacatctcaaacatatcgttcttctcattttggagacttttctgaacttcctgcaaaacatcagtgataggaggcacaagcatatcttgttgctccattggattctccaaaattttgcgctcaacaatacaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacacactcaagcttttaaccaagctcttacaagatcttaccaatgcaagtggaatggtgatgtacaccgactcaaccaagcaccccaatagaggttggatatatcgatgcctcggcaaacacttgccgtacggttgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttctttttttttccttttcttttctgattttttttggtgcggctttttttttcttttttttttcacctttctgccttttttttctcactttttttcttattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcaaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacttctgaaaactacaaaaatagaaccgtggcagcgagccgattccgttttcgtaggtcccgacaacaacagagacacggtggcagcgacgactgtggtacaaaacgtgaccagaactcgagactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcaacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtagtaggtggccgaatcggattccagcacttggaggacttgatcttgatatcttcttgttgattcatgatgtgagcaatggtcgtatccatagtagctatggtcacatcagacatgagttgggaaacttcggtgtacttttttttccaaaagaaattagggaaggcccaaaaagtaagatggaattgaacgggatcagatcgtccgcgtgcgagccgtttcgatccccctacctcctcctcgtacgataagtacgcaccccgagcgctcacgcgcttcgcatcccgcaaaaccccggtagaacccgcacccgcacccgcacccgcaccgccatggagttccggtaccgcgacggcgacgaccgcagccggtcctcccctcccccgccgccgccgcccacggcgagctctggatccgcccgtgtgctcccggccaacgaaggttacttaattaattattctcgatcgatcgatcgatctcgctatctgcgtctttttttttggtatcgtttcctttcttgatcagacgatgggcatcgtggcgcagacggcgggggcacgggagactacaacgggggtgattcggccgtgtcgctggggcagtcgtcttcaccgtcggcggctggtcgcgacgagctgcggcaggcgaagaagcagaagataatggagcggatcctgcgggaggaggcggaggaatgggagctcgagtcggaggtccgccgggagatcatggagcacatcttcccgttgctgaggagatctgggaatgcacggccgccgacgccggcggcggcggcggcgctcctgcaggttcgatcatcatgtcttttttcgtctacctcgattttgggttgttttaattttgatcgatattgaatatttgtttctagattctagcttaccttctcctactgctccgactagccgcttggactaatagcgtaccactaaatgttccgttaaattaatatagaccgtgtaatgaagaccatacccttagacattttacaaaagctatagagatcaaataataatattgtatactccctccattccaaattgattattttataggtgcaccaaaacaaaaaaaaataataactctctcatactatatttactcgagcaacaaactcaatgtatgcaccatccccactatttcctagtcaataacaaatcaagatattgcatgtgggttatatatacttagggggtggcccctctctcccaaacacccccttatgtgcatggatgcatgcatcaatgtccatttactccaatgcacaaataacgaatagacttaatgaataaacataaatatatatagatcatttaggaataaccttaaaaaaacctatatgtagatcaatttggaatggagggagtaacgtgtatctcgatcgttcatgtttttccattacatgtcttatttgatgacaatataacttttttatgaataatatactaataggattgataatccatatatggattcattactatagtcatatttcatcttcacaatgacctaagaataagtaattctatttattatccatttaaatattctactagttattccttgtaaacacgcgattcattaatatttacgtttctcaatgcccatgtagccaatcatgtgtagaagaatagacaatcatgtgtagaagaatagagagtcacgcattaaatccgagaaagtcaataagaggataggtggttggattgaaatatgtctatcaaaactaaatttttcagatttggaaatatgtctatcaaaagtagattgagggagtataatatagtacatttttatgtaaattgctttgggatttgcgatgacatgccgatgaagaagcacaataggaagattaatactattgtttaaaagcaatgaatttcaagtcgtgtcgtttatggatagaaattaatgcaatcaccgaaatgaggtgtgctatgaaacctcaaggatatatgctctcctctttagaaaactcttggtcaaaaaaaagttagaaaactggaaaagaaaacacttagaaattgtgtcaaccacctattgttttagaaacatacactgtcaaaatactaaagttgtggatggtatttcacattattaattatatggtcgtactcacaacatgagtccagttgtggatgatatttagaaggaaaaagtacgaattacctcccccgaactatcacagtcgtctgaattacccccctgaatcacaaaaccggacattcttcacccccaactatgcaaaccggacgaattaccctctcgacccaatccacggtggttttggtctacgtggcgtacgcgtggcagctgagtcagcattctattcattaaaaaaataacgggacctacatgtcatactcttcctctctctcactcttcctctctcttctcttctctctctctcactattcctctctcacgggcgggaggcggacacggagctgcggcggcggtggccggcgggtgacgctgaggcggcggcggtgggggatgagggtgacacggagccggcggcggtagcgcggcctcgccggagtcggacgtcgctacggcggaagaggagaggtcacgcaatgtggaggcgaggcgggtcgtgtcgcggcggcggagcacggcgtgggcctcggcgaggagctgcttcagtgcttgagcaccaggggcagcggagggggaccgaggacggcgacggccgggggcagactagttgggggcgacggtgccgcgcgcgcacggggaggcacacggcggcgtcgctttcttcccgcgctccagggccgcgctcgcacgagggggcaccggcggcggcgacagcgcacgagggagaaggctgggccggcgagcatgttcgtgcgggaccggcggcggacgggggcggaggccgtgcggatctggaaagacgatgcgggaccccgacggcccccgtgcaccgccgtccgccgcctgcccccacgcgccgccgttgtccacggcgtcgggccgccgagcgcacttgtgccgcccttactcgccgccgtccgccgcgcgcccccacgcgccgccatcgtccgcggctccgcgccgctgtgcgcacttgcgccacccccacttgctgccgtcgtccgcagctctgcgccaccgtgcgcacttgcgccgcccctactagccgtcatccgccgcgcgcccccacgcaccgtcgtcgtccgcggctccgcgccgctgtgcgcacttgcgccgcccccactcgccgctgtcgtcccctccgcacttgcgcggttgttgcgcccgcgtgcaccagtgagagagaacggagagagaaattaggaagaggtgaagtggaggcatgacaggtggaccccaccaatttttttaaaaaaaatggtgactggactgccacgtgtatgccacggggtcaaggggggtaattcttctggtattgaaagttcgaggtgaagaatgtccggttttgtggttcagggggtaattcggacgaccacgatagttcgggggggtaattcgtactttttcctatttagaaacaaatctatttggttttctcaacattggtgaccagtctacaccaatccatgagttgtaactgtatgaacaatgacatgaactatctaataccatctaaataatcccaacggtcgattttgaaggtcggtttcataggccataattatgcttgcaagtgcgatataattcagttgtttgtatggcttgccacatcctcgtggatctatttttagagagttcatgggtaactaagatggtcacagttcctgatttgttgtatattggcccccgatgttcatgtatctgaataaactagtttctattaatctacaacatgcacttctattatcgagatatgatcaaactgttaaaaaactaagaaaacactttgaaattgcagcaaccatctattgttgaagaaacatgcaatgtttgtggatgatattttgcattattaaccgtgttcatactcacaacatatgagtcaagttgtggataatatttagaaacaaatctatttggttttctcaatgttggtggccagtctacaccaattcatgagttgtaactatatgaacaacaccatgaactatctaataccgtctaaataatcccaacagtagattttgaaggttggtttcatagtccacgattacgcttgtaagtgcaatataattcatttgactgtatggcttgcaacatcctcgtggatctatttttaggctcagttcggtagtacaggtacccaactcctcgttttccgcgcgcacgctttttaaactgctaaactgtcagggttatgataccacatacctaatagtagttgactaaatctcggcaggatccaccacataccatgtcctatacagaagcaaccttcggatataggaggagttctggataatgaaagacaaccagagttctacatgaaaatgacaaggactactcggattgtatccatattggtttccctagttctacttggacaaggggacaactatgggtataaatacaagcccccctaggaggacagggggacaaccatcatgagacgatcaacacccaatacaatcgacatagaagccacaatatagaagcctacatatgccaagacacgccgccggatatcgacttcagggataagcacgactagtaccctacggtgtctccagatactgtcaggagagacgaaagcgttatctctgatctcgccgggcgcggattcgaggaggaagactaccctgttgttgactacgagtcagatcgtcagaccgccatgtcgataacagttagataggctaccccaaacattgtactggtgtgattatcatgaataaaagcaataccggctttggccaacaggatgtagggttattacctaacaattcaggggcccgaacctgtataaaaatccctgtctccatctcttttgcctcagtctcgcgtatatcctagcaccaacgatccccatactgtccaaataccgtagtcgtgacatcaaacgtcgacataaacggtgtgttttttgcaaaaagtttctatacgaaagttgcttaaaaaaatcatattaatctatttttgaaaaaaaagctaaaacttaattaatcacgcactaaaacgttgcttcgttttgtgtgccggggagtgatggttcccaaccctcactcccaaacagagccttagagagttcttgggtaaatgagatatgatatatagtcatagttcctgatttgttgtatatcccccccccccccaatgttcatgtatctaaatagactaggtgctattaatctaccacatgcctttctattactaggatatgatcaaaactgttataaaactaaaaaaaaactttgaattgcagcgaccatctattgttgaagaaacatgcaatgtttgtggatgatattcccattattaactatatatttatactcacaacatatgagacgagttgtggttgatatttagaaagaaaatctatttaaccttctcaactttgtggtcagtctactccagttcataagttgtacctatataaataataacatcctgaactatctagtactatctaaataatcccaacagtgtgtttgaagtcctattttataggccatgcttatgtgcgcaagtgcaatataattcagttaccctgtaaggcttgccacccacatcttcatggatctagagatcaagcgtaattgagatagtcattgttctgggttgtactatatggcttccaatgttcacatgtctaaaaagggaaactctattcatcactcgaagggatatcctctcgattttcatgctacttaaaaggtcataaaaatattaaataaattaataagataaataaatatatgatatatcacttcacgaacatgtatattcaaattcaacttatataagtagaaacaaaaataacaaatttgattcggaatagaactttcaatttgcagtcaaatttgttatttttctttctataattgtttaattccaatttgaacttggcaactttgtgcaatgacatctatcttgccaagtttttaaatattttttgatgactttttaaataaaatgcacaaaacaagagaatattctctggatggataaaattccatctctgtctaaatatattactagttcttactatttctacaacattcggttctgtttttaaggatggctctaatattaatttatgtatgtgttgttgtaccttaatttctatctccatctttgtttcaaaatataagtattaaaatataagtattaagtacgaaggttagttaagttgaaaaggtggtactgtgcactagaatttcttttattttgtatacttgattttggatttaaaattttttatgtcttactatatcgatgttgtcaatattcactattccctctgtcctaaatgatgaggtttatatttttttctacacgatctttaataatatactttaaccattaatttattacgtgttatgtttccgacgaatatgaaattagcttaatataaaaatatttaaaatataaatctagtaatataatatgtatatatatggttagtataattattaatcaaaaacttaattaggacgccgtataggacggagggaatacttccttccgtgttgttcttatatacgtgttctaaaagttgacgagcgtgttcatttcacgcagggcgccgtcacgaatgcaaacgcatcatcatcggcggccgccttgccggccaagaggaagaagaaccccgccgcagcagcgtccgccgtctccgccgcgacgagtagcaagaagcccaaggccgccgacctgacctgcgccgtctgcggcatcacgtcgaccggcgagaaggctatgcaggaccatctcaacgggaagagccacaagaagaaggcggccgcgctcgcgctgtctgcaccgccgccgccgccgccggcggaacccgagcccgagcccgagcaggacgaggaggatgcggcgtcgatgatcccgccggcttcggacggcggcggcggcggtggcggcggcttcagtccgacgaagctgagcatgctgacgagcgccggagtcgtgtacgaggtgatgcagatggacggctacctcctctgcgagggctgcaatgtcaggacggccgaccgcgtcaccatgatgtgccacctcgacggcggcaagcacgtctccaaggccacgaagctgaagcagcagcaagccgggaagccgccggcgccagcgacggcgactgcctctcctatgaatggcgtgaaagcagcgggggcgccgccaacaacagctgctgccgccgacggcgagcatggaacggtggtggtggaggtcgacggcgagccacacgccatgcggaggctggacgaggtcttcattatctgcgatgtctgcaacgtgaaggcgccgtcggtgactgtcatgcggtcgcacctcgccgggaggaagcacaagtccatggccgcggcgacggcgaaggcgaagggtgccgaagctgccgcctccaccaccatggccgctgctggcaaagttggcgggaaccttgaggcgggagccatggcagtagcagaaggtgtcgccaccaacaacgtcgccgacaacacttgtccggagaagggaaccgtcgacatcgtcgtcggcggcgagcaccacgccgtcaagcagatcggcgagttcctcgggtgcgcgtcctgcaacgtgatggcgacgtcggagagcggcatgaggctacacctagccggaaagaagcacaggaacaaatcgatggctgaaaaggcggccatggacgacatggagattgtgaaggccaggtcgaaggaaacggcggccgccgccgccgcctcctcgccatcgtctgcgccgcgagctgtcgtcgctgcacaaacgggcgatggctctgtggcgcccatggaagtcgaccaaactgcagaggccagagatggcggcgcgccggtggccgccgacgccgcggcggcggcggctgccaccggcgggcagcagcaggtgaaggtccaggtggaggggaggatgttggcggtgctgcgtgaggcgaacggcgcgctgctgtgcgagccctgcggcgtgcgctgctccggcaagaccgacatggtgctgcacctctacaccaaggagcactcggacaagtgcggcgcgcatccaccggcttgagtcacttcacgcgaacgtggagtggatttttaaacttttggacgtcctcacattatttacatattatctaaatgaatttcttttaaaaaatttcctcttatagataggacgaacaaagaacaaagttttttgatcacttacttcgctcgccctttttgatcggggaagataaattaatatgtgatgtatcgctttataaataataagttaaaatttaacttttaaaattaagaaaataaattaaacgactgttaacatatatttattgttaaatttgttttttaacatataaaatttaaggaaaaagtacgaattacccccctgaacaattgcggtcggccgaattacccccctaaacccaaaaatcagtcattgctcatcctgaactttcaataccggacgaattacccccctcgatccaattcacagcggttttgtcctacgtagcgtacgcgtggcaatccggtcagtattttctttcttaaaaaaattgtgggacccacttgtcatactctccttcctctcttcctctctttctatcttcactctctctgtgtcacggtgacggggagtgcgagcggcgcgtgggggcggactggcggtgtgcggcggcgcgagcggcagaggacggcggtggaatggcggcgagcggcgcgcgggggcggacgggcggtgggcggtggcatgagcggcgcgcgggggcggactggca

SEQ ID NO: 28455 - DNA, 27804 bp, Oryza sativa
cagagagagagagtgaagatagagagagagaggaagagaggaaggagaggtatgacaggtgggtcccacaattttttagaaagaaaatgctgaccagattgccacgcgtacaccacgtaggacaaaaccgctctgaattagattgagagggtaattcgtccggtattgaaagttcagggtgagcaatgactggttttcgggtttagggggtaattcggctgaccgcaattgttcagggggtaattcgtactatttccaaaatttaaatacgatcttgtattgtttatggagtgatttatcatatattaatatatcttttttttaaactgtttggataacatataacgagagaattttcttttcgagagtttaaaatagtttcgtgatgattccttgatcgtctcatgttaagatgactaatgtgatcgtttagttccggtgatataggctgtgtttagatcaggggtgtaaagttttggcgtgtcacatcggatatacggacatatatttaaagtattaaacataaactaataataaaacaaattacataatctgcctgtaaattgtgagacaaatttattaagcctaattaatccgtcattagcaaatgtttaatgtagcaccatattgttagataatggagcaattaggcttaaaatattcgtctctcaatttacacggcaatctatataattagttatcttttccatttatatttaatactccatgcatgtgtccaacattcgatgtgacagggtgaaaaattttgctagagatctaaggcccaaactttttcttcaaacttccaactttttcatcacatcaaaactttcatacacacacaaacttccaacttttccatcacatcgttctaatttcaaccaaacttttaattttggtacgaactaagcacaccctaaacagagccatactgtttgtcttgttgggatggatttctggccatctgcgatagtctggacgtgtggcggcgcactaggccatttggttggggataatgccggtggaagtaaattacttgtttctaattgtgagatgtctgtcaatcgaaagtgctcgttttaaattgtgtttgtggatattgttccatgattcactattatgtgctactaaggccctgtttagttaccacgcaaaatttttttatcatgtcacatcgaatgtttagacacatgtataaagtattaaatatagaaaaaaatagttacacagattgcatgtaaattacaagaagaatcttttaagcctaattgcacaatgatttaacaatgtggtgttacagttaacatttgctaatgacggattaattaggcttaataaatttgtctcgcagtttacaggcggaatctctattttgttttgttattagactacgtttaatacttcaaatgtgtatccgtatatctgatgtgacacttttaccctggatctaaacacagcctacatgagtcgataaaatctgcacattctccattcatcgtcgaataattcattgatggcgatgtcttaagataatcgtcaaatgattatgccgtccaatacggtttctcagtactaaaataaatcaatccaaaattattctaattgtatatcacatcttacctttgattaatttattataggaatgaggctcactgacttataggccccacagaccctcaaacccatataatagcgagcagtactgcagagaggatcaggattgaaactagaattgcatctaccactgattccagcaacacgagaggaacagcatgatagtaggtgacatgagtcttcaattgcaataatctcttgcccgaaatcatggcgacaagatgagacaaacttgtagaagcagccataaatcataatgccaccacatgcgaacccatcagcagagaaccagtattcctggggttagaatcctgctgaactacactacctaaacatcagttttaaccagcaccacagttgtactgctgcatcttactgtaatactaattcttaatgaaagaccaggaaaaagaacacatatggctgccagaactagcatggcattgcatcacagtagccaattagccactaccagaaatataaaacatcactatggagtgaacatatatgctgacattactatagtaatattcacacatggatataatctacaatggtgatgggttccatgacttccattctattccctagtgtctacataaaacaagattgagctcaagaatgaattacagctctacaagaatataaacatatgcagctgcagcacctactacaaggcatcagacagcatttgtattaattattcatttgctcaaatactattagccctagagtagttgttgagatggcattcacgctaacaaaacagacaagtgattgattatacacgactacgatctcaacaagtgccaggagcattacacccatccaccgattcctcttaaggattcttttacaactcgaggaacagggatgaacgaaattcagttcctcttcccaactatctcaacactgttattattaacctatactctgagagctaactgatcctgccatgatatcttcctcttcccagctcgggaggaggcggcgttccggacatcccagaatgccgccattttcgcatcactaggaccggcggcaaaatcaccctccattgggtacctcatgaccctgccaaccctaacaggttcctggtaaccatgaagctcctccatctcttctgaactctggaaagagcaaattcaaccacattcagatgataatttcttcagataacggaacttaaccgagttcgccccaaatattaccggctcgcaggcctcgttgaggtcaatcaccggagatgctcttggagcagcattcagcctccggtgcgccgatgggcctttgctagagcttccgatagcccgaaccgtgtggtactcttcaccatgagaccaaccaggttgccgcaatgtgggcggcaatgccggattctttactctatagacaaacgtctgggatggattttcggacatggatttgtaccttttccgcaaaaacctacagcgcggcacaattatgcgcaggataatgagacaatatcaacatgtttgcattgtcgtagagcataatcatccaggcatgtaaatcacactggagaagatgatgagttcaggcccttacttgacttcagccaaaagcctctgtttcttgagcttctccatctgtaatctcttcttctttgcttcagtttcctgggtaacccaacacagctaatcatcagcaaacatcataatagaagtaactgagatggacactaaacaccatcaaacttgcaagaaccacatttgtggaaatcctcctagattaagagagttgcgatccttggaagaaagtttaactacgaaccagaatgaactgatacacttattagctgacttggaacatatcaaaacatgctaattcattcaatattaggagaagaaggataataaatttcagaaccccacagatctaacccaaaatattgtcacaagtaaaaaaaaatccagatccacaaaatacaccaagaaaacccctcgaataatcagaaaaccaagaacaccgaaaataaaatcgatcaagaaacaaagccgccaagatccaatcggaatcacaaaatccccaaataccgagaggaaaatcaaacatcacaaaacccccttccggagagaaaccgatcgaaaaatcgcaaaacccccaaaaatcaagatcagatcggcgaagccaaccacgacggcatgactccaagaaacgccatgaatccacccacccacccacccacctcgaggagctccttgtagtcctggagaagattcttgtacttggccctcgccctgtacgcctcttccccgccaccaacgccgccgccacggctgtgccccggcgccctcggcagcagcggcgacggcggcgccctcgccgccggctgagccaacaccaccttagccttcttcatgtccgcctcacctcacccgcgaagaaaccaacaaacgccccgcaagagcaggagaccaagaaagccagggagagagagaggtagaaggagataggaacaagcaagggaggaggaagaagaagacaatatagaaataaaggaggaggggaaggtggacgtggggagggaagtttcttgcggccgctgcttcttggtgctctcgctgctggctggctgcagctgcggcgccgtggtgaggtgtgaaggagacccatggatgtggtgccaaaaaaacccgaaaaggcccatgcatggtcatggatggtgctagagtagacggactggacggcaagatagagagagagagcaagggaacaccaaccaaaccaaaccaaacaatctctcatgtgtttctctctctagacttgtagtagtagcggtggtagcggagagggagggagggtgggtggtggtaatggcgtggcgcatgtggtaatcaggtaatggagtggtagtggggcgcttgcttgctgctgctgctgctgctgtctgcagcgttggcttcgtcgtcggtccagctccgtctccaagaccaaggagaggagaagagagagggggggcattcttggaatccgttggggttgagaggtcagaggtgtccaccatgagtgaatgctgctgcagctaccccctctctctgtgtacacagatgtcatggtccatagggaaaaaaaagcgagatgacgatacgggacatggacatggacatggatgtgtgtgtgtgtacgtctctctctcctggcgtccatggctgggtggctccatggatccattcttttgattctttcgtttcgctttcttgctgtcctcttgagagagaggccgaacgctcccgggtcttgtgcgagtgggtggtggcagcagcccagcatactacaagcgttgcagtggttgggaggaggatgatatgatggcgtttgcagtttgcacgcatttgatgctttgatagtgtgggcggaggaggaggaggagatgatggatggcgcagaccgtagaggcggatgggccagtgcgtgcggttggtgtacaacggcgtgtgtgcgtcttgcagaggctctgcggcgttgctgtttgcttgctgatgttgttgtggctgtggctgcgagtgaaatggcgagattgccatcccattcccaaacaaacaacaaacctacctgggtttctctccctgccgttgacacggtcgcctccgctcgtttttaagatgggggatttgggaagagaggagaattcttgtgtgagatgaagatggcgatgaaacgatgataggtggggtgggtgactgggacgtgtagagataagatgctgtggactttgtggtcctgtggtttgctcgttgcatctgtctgcccggtgctttcgtatgcataatataaagtactgtatcatattaggtaaattttactgtatgatattaggtaaatcgtgatttcatagttttagctctagaacatggtaaaaatcgatctttggaaaaagacacatccaacatgtgattatttgctgttgtatcccgtccacattaaaatattaattttcagttcactaagagagataaacatcgtgaaaggtcaaagtacctctagccccatttgtcatcttcttcctctttctcatttccctctttctcatttcccctttctgggagccgatatcgaggtggattcaaggtggcttggaggaggcgaggtggagcgacatggacgagtcggggtgaagaagatcgacacgtcgagtggtgagctggtggggtggtcgatggggtctgtgtggaagccgaggatgagccggttgatggcgcggttgcaagagagggcgctggccggaattggaactgaagaggatgacggagaaggcggtattatcctcgatccggagaagcggtggcaaggagtgctaggcagagctagggtgccatgcggtgatggaggcggaagaagacgacgccgtgctgccaagactgatttagagctggcgaagcctagcctgaatggtttgcatcaaaaggacggcgtacccgaaggcggcccttgcaaacgcggcgaagaggggcccgtcagaggcatgcagtgcacagaccaaagttagcagcggtggttgttattgatgcgcccacaacgcgaggtagtgtgtcgatgacgcgggagaggcttcgcccacggatctgccaccccacctcctccaggcgggaaatttaactatttgccactcttgtgatatggcaattaactatttgccacaccctgtcaatgacatgtgggccctcatgtgtttatgacatctgggcctagtgacaaatcgttaagcaacattcgtaagagtggcaaatagttaaaagcccccctctaggccaccacctcgatgctgactcctctgttccgtcaacactggggtgggggggaagaagaatggaagagaaacgatagcgatttggtcactccgtgtaaatagttgtgccccctatcaccttgtcagaatgaatacattattttaatcgacgtagttgtaggatcgagatgtcgactagaagggggtgaatagacgatattaaaaataagagaaaattggaaccatgccattataattttgcaaaatcgagatatgccatcctgacccacatgccattgactcatgtgggtcctacatgtcattgagataccgatgacatatctcaaactttgcaaaattataatggcatggttccaaattaccctaaaaataaatagcgcctaattaaaactaacctgagttgctaggcttggtgaagggtaagactaactaagcaactaggttatgttttacaatcctaaggtgatagggtctcaagtacgtcattatgaatgtaaattgcacacaggtaaatacaataaataaatgagacaagagagaagaaaattttcacccgaggttcggaaactcgctggttttctaattcccgttgagacgagcctaactttaccgcttaaaaccatagagccacaacaattctactacttaaaagatctgtagtggtgatggtgaagctaatgtagactcatgatccaacttaaaaacgtagacacgtgaccgtgaaaaaaaaaaaacgaacgcttcacagcgacgcgcaacagaagcgatccgaaatcagcgcaacagaagcccccaatccatcttcgcgcatccccacatcgccgcgcccgctccactcttccacccccggcgccgctgacccctccccagctcccgcctcccggtctccctcgacccatccccgccgcttgaagccctcccgtcgcgcctcacggtctccatcacgccggctcgccctcgacagatccccggaagccctcccgtcgccagttcgtcgcacacacctaccttgccgatctgctcctcgccgccactgtcggcgcccgcatccacgacgccgccgtcatcccttggtagtttgatgtcttctccttctcctcaagatggatccaaatgtgccaaatgcgtttattagcaaagcgaacaaactggggatggcgccacgacctgcttgtgctggagacagaggacccctcgtcctcctcctcctcctcctcctcgccgtgcctccctgacccgccgccgcttccaccctcaagcgccaccgcacgtcgcacgagaccccacttcctcccgctccccccgctgccgcgcctcgctgacctgtcgcctttaaaccttgcgccggttccaccttctccgaggtcgctgcctccctagagggccggccagaggtcgccgtggagtccttgaaagaggaggaggaggaggaggagagacggtgccatatgcgttgcatcacacgcgggcgccgtcgctacctcgagcaccgtatgtgcgattgcagccgcctccgctcgccatgagaacaatagcgtgtcttggtgctaccatgccgagtgatctaggagtactcccttttttctgtcagtttttctttttccctgtttgcttgatttgtggtcaggcctttttcctcgtgctgtttgaaatttcatggtgaattatattcctaaattatatctactttactttctaggtggaatttctccaggttttagttgagtgcttgggactaaacagtactgtagcaagcattatcggcctattttgttcgcagagtgaagaccatggatgcagcatgcatgcagagttgcagactgaagacaggccatcattcttcagtctaccacgagatagcggcgcaaatgcttgattcacttgtgagaatcacttctttcaacttccaacctgattttagagcaacagtgcctcaccaattgaaatcaaccgatcaacatatatgtcactggttctcccatctattagatatagttctgaatttttaaacaaaatgactatttgtgtgctgtgagtacaacaaaaatgagctcaagaaaagctatctctatcaacattagcgaaaaaaaagcacacttaaagcctttacaaaaaaaaaatatatgaagtctttacaagtgtaaacatttctgaaattgcctggtgagcgattaaaatgtttttcttgtggtgccttcagagagtttgatatgtttctatatatttttacatgtgtgccattttctgctgccccgaacattgatctgagagtaatcaaattccttgaatagtttaacttctaaatgttcaaaaataaagggagcgccatggaagtcaaattagtgaaaatcttaggtatcctgcagtgtgtatgggggcactgtgcaatatgatgttgcatgcagtatactatcattcttttaaaagtatcttctcggaataatttcttatttccaaatattctcagatacactttcaataatgtagatatgagatattatgtgcgaatggccaccccaagataatatacttcaggatatgcaaaatcagttggagaatgcaaattcggttgttctctttcatccctcatatatgcatatgtttcttaaataatttacaaaattactgttcagtagtggagtaaataaatatgaatgacggtacctgtcattatgcacatgttctctaaacacatttcatgaatgacaaggtaatttttggtaatattgtttggcagcgagtatttgggtacaatgtactaaagttaatcaatatgtgtggcatatgcattgtttttcattgttaaggttcgaacaactgaaggcaagtaagatgaaagaccttgtttgaaaagggaaagctgaactggaagagcatagaagatgcgctcatctaattagccaggaaggttatgcagctgagtttagcattgaagttattgaagtgcaggtaagatattctcctatcttactgacttccattgttcttgaaaattgtcattccaaacatgttcatgttttggccaagatggccgaatgatccactttggttctgaatattttgtttgtcgtttttgcaatggcagggacgtatgcgttttgcaggctgagcacatgaagaatcccagttaatgtctctttaacttccatccataaggagactcgtgcactttcctgacaccctagcacaagttattacgctgtgcagacttttggctatacattaagcaagatgcagcaagtattttggattgatgatctgtaagatttgagttcagctcatgctcgttgatagcacatgacacatcggttgaataactgtgttcatttaactctggacctacatatacataatttcctcttactttgattccttggctcaaaaggctcacagaagcctatattttgcaattaagcaacaagaagcagggcttgatttgcattccgattcaggtaaggtaacagctgacttcgagtttttttttaattggtgcattatccatgaaacccttttccagtttccagtattcttttgttaaattttctgataacttaataggaaagacattaattaactatgcatcacctgctctatatataatataactataggacattgaatattttatttcattgcactaaaatataatcaatgttggcctatttttatgaatatattattctggcatgtcactacaagatctaagtaatactgatattttgatccatgggtgctttataagatctaagaaattaattatacttgatctcagggtctgaagaaattaaaccttaacaacattgtgaaatatagtgagactgaatcttggagataaattactgaagaactgaactattattatgagtataatttactttctgatcttttaacaaataaggatattgtttattagtggttctagatttggttaccttgcgtccttgccttttattcatcagtgcaattagggccaagcttttgcgtggccttgtcagagagatgaaaaagtacatatgcagtgcatcacttataattggttgtgcaacctcctcatccgcatgctaagtacaatgagttgaagatgatgtgctgcaagtacgccctttccaccatctgattatgtacacatttttatatatttcggtacatccgattatatacacatcaatataaattgtttttacgcattcttatatatttccgtgccacctactatgtaaatgagcaaaaaaaataatttgtttcttacatatattatttacaattatttttctccacttctataggattgacatattgttttccaaaggaaacataatagatcgggcagtttctgtgagctggatcagtacgggcatatgtgctaactgcctcctatgcagttgtgctttgcacaacgaagtgagtgtggttcatctttagagccatgttcaaagagagtttgggtgttgatcaattgtgagaaaatcatgtgtagaaatgccttgggatgatgtctaaaatagggcattgtattcatttcccgtgaattgctgcacaaatattttttgatgtactttatggtgcaacatgcatctattgacactttctactttaaacatattaaaaatatttgatgtattgtttcgtgctatagtttttttcctgttgcaacgcacgggcacctaactagtattttaataaatccctacttattataaaaattgaagatatttttgtcggtattttggtacatcaactgtgtttgagtcgtttttaagtccgtccgtttttgggaagacatatctgtgtttgagttgcattttagtcttgtttgcttttgaaaatacaaaaggagttgtataagaaatcttaataaaaaaactcacattacttgagatgaaatacaaactcataattgcagcccacgattttctttaaaaaaaatattcatacgaattcccaaaatgaattttaccctaactaaaccgtataagaatgataaaattaaaatagtatttacccgttacaacgcactggtattttttctagtctctactattataaaaattaacaatgtttttgccggtattctggtacgtcatccgtgtttgagtcggtttttaagtttgttcgcttttggaaatactgatccgtgtttgagatggattttaagttcgttcgcttttgaaaatacagatctatgcttaagttggattttaagttcgtttgcttttggaaataaaaaggggtcgtataagaatctttttaaaaaacacgcatgctaacttgagatgagtgtcgaactcttaattgcagctcatgattttctaaaaaaaatatccaaacgaattctcacagtaaatttcaccttagctaaaccgtataacaataataagatttaaatagcattcacccgttgcaacgcacggacatcttttctagtctctactgttataaaaattgaaaatgtttttgccggtggcttggtaagtcatcgtgttcgaatcggcctcgcatataatcactgccaatttaactattttatgtgtccaacatgtacgagctttaaacattagattttccataagaaaatttgcatgttcggatcgtgcctttggccgattgcgttttgtcctgtgcattgtcacaaaccaaccgcctccgcgaggttgtcatcttgccgatacggtctgttgggcaacacggtttgggacctgctgttgcgcacctatatcaacaccaaccagcagcagtcaggtgtgttgccgtgcgccgaggcaagcagcacgacgtaccattgttgattattctctacacgcacacactgtatcgagaagaattcctaccgtgttcatcagaaactcaattcaatacggtctgctgtgtatacgtgttccaaaaaaattaaaaaaaaagttcaggagcgatatcaaagccgagatctattactacccacatattgaatatccacgcgtgcagcaagacgatcagcaacaacagccgatcgatgacggttgccaagagaaatacaaaaacctaatcagagaaatattcaatcaagctactgcgcacatatatctttatctttactattatatctctatctctactattataaaaattaaaaatgtttttgtcagtacgtcatccgcgtatgagtcggttcttaaatccgtttgattttagaaatacaaatccgtatttgagtcagtttttaaattcgttcgcttttaaaaatacagaagaaatcgtacaagaaatctctttaaaaactcacatactactaacttgagacgttcggacacctaattgcagctcatgattttctaacaaaatatatatccaagcgaatttaacacagtgaatttcatcttaactcgatataataataagattaaaataatcttcacccattgcaacacacgtgtattttttctagtaaaattaaaaattttaaaaattctcatctggagcgttgctgggctcgcgcggcccacatacggcgcagatcgatcggggctgtggggcctgcgcgggagagagcgcatctagcgcgcgaggctataaaacacgccggattctgatctcaccgcccggcaagcacgaacacgatgacatcggatcgggtcggtttctctcttgctgtcttctcgatcgatcgatggctcccacggcggcggcggggctggcagcgcgcgacgcgtccggccacctctccccgctcaccatctcccgcaggtgaaacttcaattatactcctatatatatctagatagggttctctagatagtagtgtaatgttgcgaggggctagctagcgctgttccgttcgtacacgtgatgccgttcgtgagcggcgccggcgccggaccgagtagggaataccgttcgtgagcacggcagcggcggcggcgttggcgtgcgtggagatggatgattctgttgaaacctctattcccatcgatattcatgatagttcatgattctgttcaggcttgtttcgttcgattttgccgacatgtcgtagtacatggtactacctccatctagatttgggcacatagaattaaatggtggaaggttattattgattaagaagtgcaggtacatggggaaattaaatggtgaagggttataattggttgataaaggattgttggtggagaaattgtattttgggataaattttaaaggctatgttatattttgcgacggaaacaaaaatatccaatccaggttctgaccttgggattaatttcttggcatcacacaaattaatttataggaaataaacttatttcagcaacaacttaattatattttagtactgtttgtcctagaaaataatcagaataatatatgatatagatagatagatactagtagataggtaggtaggtagtcgtactgctgtttagggtgcatgcatagtaggatgatactatcacgtacgtcccttcatgcgacggtttaatttgtcgatctagtggcagtccaacctattacacaccaaaatcgatcaacatgtggttttgcactgttcttttgtgaggtacatgcaccgggaggcttatgttgacacataatccaaaccgcattgtttgtgattacgtgatcagatcgatcacctcgtagtcttggtctcttggatctgtcattttctgtagtacgtactgtttggacttttagaggtacgatgtgttgagtacaactgtatatgcacagtaattggccattgtctctctgttcatatctagtgcactggtagcgttgcacctaggactttaccgtgtgatgggttgtatttcttcgactattgtcacaatctgtataattcctagccatatacgatttgccttttatgccagagtttagattgagtacgtttttaggcctcgttttaaagatgataataatttgagagcataaataataatattgatattgaaaagctgaaaaatgatttaagaacatacaaagaaaataatgatgaacaaagttttacaaaagacgcgccgtctagtagttggtgcctgtgcgtagagtttttctttaatcaacaatataaatagcgtttgtgctaattacttgaaaatctgtaggagcactggagatgatgatgtggtgataaagattctttactgtgggatctgccactccgacctgcacagcatcaagaacgagtggaagaacgccacctacccacttgttcctgggtaattattaattaagcaagctagctttacaaacaggttttgtacgttgttacatactccctctattccaaattgatctacatattttataggtacacaaaaaccaagaaaaattaataactctctcatactatatttactctaacaacaaactcgatgcatgtaccatcaccactattttctaactaatagcaaattaagatattgcatgtgtgttataaatacttgtgtgcatccatgtgcatggatgcacgcatcaatgcccatttactccaatgcataaataacgaatagacttaatgaataaatacaaatatgcagataatttaggaataaccttaaaaaaaaactatatgtagatcaatttggaatggagggagtacgatgcattattctgaattaattctgatcaaacaaacatgcactcgatggcgcaggcacgagatcgccggcgtggtgacggaggccggcaagaacgtgaccaagttcaagggcggcgacaaggtgggcgtcgggtgcatggtgaactcgtgccactcctgcgacagctgcaaccaggggttggagaaccactgcccaggcgtgatcttcacctacaactccgtcgacaaggacggcaccgtcacctacggcggctactcgagcatggtggtggtgcacgagcgcttcgtggtcaggttcccggaggccatgccgctggacaagggcgcgccgctgctctgcgccggcatcaccgtgtacagccccatgaagtaccacggcctgaacgtccccagcaagcacgtcggcgtgcttggcctcggcgggctcggccacgtcgcggtgaagttcgccaaggcgttcgggatgacggtgacggtgatcagctcgtcgccggggaagaggcaggaggcgctggagcggctcggcgccgacgcgttcgtcgtctccaagaatgccgacgagatgaatgccgcgacgggcaccatggacggcatcatcaacacggtgtctgccaacattccgatcgcgccgctgctgggtctgctgaagcccaacgggaagatgatcctcgtcggcctgccggagaagcccatggagatccctcccttcgctctggttgcttgtaagtgcttaatttgatccggatccattacagctagctactagctagctagctgctctgtgttgtgatccattacattctgtctgtggcatgcatgttgcagcgaacaagacgctggccgggagctgcatcggcggcatggcggacacgtaggagatgatcgacctggcagcgaagcacggcgtgacggcggagatcgaggtgatcggcgccgactacgtgaacacggccatggagcgcctcgccaaggccgacgtcaggtaccgcttcgtcatcgacatcggcaacaccctcaaggacgccatcgagtgatgcgtccggtccggtcactgcttaatttatctctctgtccattctggaaccggccagactgtctaatcgaacgtttgattagaaaatgaacatttaaaataactttcgacagaaaacggaacagaaatctgtcggatttttttccaccacaggatacgtacccaaagaaaagattaggcctcaaaggattttgtttgcacactacgacatggttaatcgatgaaactaattcagactttatttcccgtaattttgcaaacaaacagtatggttaaacactaaattagcatcaatcaagcatttctttacctattacatgaagcacggtacaaagtttagacattgcataattaaactataactacactataatttcctctctctttttttaaagaaatacggcaggggaggcccccactgttaataaattttattaataaaaagagaggtataaaaatattacaacatagcaatccaattgatagctgcatctttgtctctctcaataagacgaaacagcagaaggaggagatcacccttaaatagctgcctccaaagaggagattttttagtaaaaaatggaaccattcctttgcttccagatgtttcaagccccatatagaaacttctccatgaaacacttgccttggtaactattctttgtatgcagggtagtgtcccgagagatacccagcatagcctagtagaattgagcaaaaggccattggaagaacaaatgcaacagatcttccagaatatgagcagaacaaagaacacaattaagatcgcaattgggtggcgcacaatgtttgtgatctaggtattcagtctattcatcagcagcaaccaaccaaagactttaactttagaagtagttttgcacttccataaccaaaggaaatgagagggtggttgtaaagctctgaagttaagggcataaaatttctgagaagaatatttcagattacccaaaatgtaaacccaaacatcattatcctgagaaagattgacactctccaaaagagttaacaagggttgcaactcctgaaaagcttgcgcaaaaagaggcagatgaaaattttcctccaaatcaaaaatttctgactgatatctttgcattagcaacataagagaataatctttacatatggaaagacaaaggaggtttatcactcaaacatcttcccaaaaatagcaagcgacaccatcacccaccatacatctagcaatgcccatggaaagatccatcagtttgcaaacatctttccaccaaaagtaacctttgagattgctcactccattcccataataagggttccaaattaaattaacccaaggtagatttttttctattatagaacttgtccaggtatttcaagagaagtgcctgattctgtatagaaaggtttataacccccaagccacccttattttttggtatgcaaaccttgcccgatacagccaaagattttcggttacagttcacatcagaacccctctatatgtaataccttcttgccctatcaatactagtaatatgcatgtgctaaacgctacagtgcaattatattcatctttaataaaaccttagaatggattcggatgtcacgaatagaaaaatatatagagtataagaaaatatattttccgcatgtcacaaattctaatgttctcttaggtcaattccattcattttttctttttgtgttatgtacttaaaaaaatattgattttttctatttgtcacacaaggcacacgcctgttgcagcccattgatgataacatgagggtgtgaatataaacccaaataacagtttgaataatttcacaatgtacaacaatataacaattgttggtcatctcattaacgtcttctttcaagatctatatggaatgactactaaaattaatcgatggcaaaagtgcatatttagagagacacaagtgttaacatattatcagcatggtgcaaactgactcatgtagaacacgatggtgtgaagaagataatcatgcaatattccacctgaggtgatggcgtgctgtacaaaacaagaggatgtcgatgagtaacatttcgatcagcaatttactatcttctagaatatgtttttgaattaattttgatcatgcgagcctacctttgctcaccagttaagaacgtttttatacacgatattcctagtgctcttccctgtggggtcgacttctttttttgactttgccaaaattcttgttgtttgccttgacacacctcctgacagtacgcatttatccttgttgtttgcgcatttatccttgttgtttgccttgcccttgacacacctcttgacaatgcacatttatccttgttgtttgccttgacacgggggttcctaaggggggcacttgcgccggctgcttaactcgtgcagccgtgcgccctcccccacgcccgcgcgtgattagcgcatcccgctaattaccatcattaacattaattaccctaattagtattattattttagtacgcgaaaaattgggataattacggagagttcaacgtaggtttgaaaacctttaagtaaagatttgaaacattcaaatcaagattttttgaaatttttaagtcggatttgaaaaatttcaagtcaagatttaaaaactttcaactcggatttaaaaacattcaactcggatttgaaaactttcaactcggatttgaaaactttcagttcagacttgaaaactttcaacttggattcgaaaactttcatatcaaaattaaaaaaattcaagtcaagatttgaaaagttaactcatgtttgaaaacttttaactcaaatttaaaaactctcacctcgaaattcaaaatatttgatttaaatttaaaaactttcatttcaaaattcaaaacattcaactttaatttaagaaactttcaaatcaaattcaaaactctcaaactgatattgaaggtgaaagattcagtttataaaagtcgcaacaaaaatcacgcgcgcgtgtagagaaaaaaaggatagatttcccaaaaaaaaacaaaaactagcgcctattttcccaaaaaaaggagaaaaaaagagaaagaaacacgtgccacggccgttggcagcgtttgcgacacacgggccgtgtgggtcggaagtgcgtgccacacctcttgatacacctcatatgataattgccagaatcaaatgaggaaacatcagaatcaaatggctgaagataaaaaaatattcttccaccttcatcccgtcaccacttaacagaattttttggaagtgcagcaactttcgaaaaaaatccccttgcttctggcaacaattctatttctaaatccatgcacagtaaagctaaaaaataaattgataaatgcgcttcagtgatgtataacacatctaatgaatcttttgttttcatataattaattgaaaaaagagggggtaaaggatgaaatgttaattttgctctctgaatcattcaattgagcccacataaatccatacactcaagcgcatttattatcaaggtactatactttagatgtcaagattaaccaaatttctccatattaaccaagactatgccaaattcacaaaagcaaatgctgtggaaataaacccgcacccaacaattatccatctacatatgtagaagtgaaaatcacttgcatttttctgaatagtttgtcatctatgataatttttcatgacaaacacaaatttcatcatttcagagatgagattcataactgttagtggccatgagaaatcagtaaagataaaattaacacgaaatgatgctgaacatctgatattggagttaaagtgactgtagcatacatattgaagcccccaattacactaaacatctaatattttttttttttcataaattcactactccctctgtcccagaatataagaagttttaaagtgtgacacggttattaagaaggtaggtagaagtgaatgggagagggttgtgattggatgagtagtggaggtaggtgggaaaagtgaatggcagagggttgtgattggttaggaagagaatgttggtagagaagttgttatattttgggacaaattatgaggactaaaagttgttgtattttgggacggagggagtaataaacagaaaaaatgttcctttaggtaatacatcagttcacattactaatgcaagacattttacatatccaggtgtcatgaataaatatgtgtaaaccaaatcttatattttaataaaggaaaaaaattaccactgcacaaagcagaagttggatgttaactaaaagtttttttttcataaattcaataataatctgaaaaaaatgttcctttcaatacatcagttcacattattaatgcaagacattttccatatccaggtgtcatgaataaatatgtgtaaaccaaatcttacattttaataagggaaaaaattaccattgcacaaagcataagttggatgtcaactaaaagtacaagaagctatgtcaatttggatgatgatgtattcaatgagaaatcactctcataattttatcggtttgaccaaatccatataacaaatagataaattgcattgtactttatcgccgcaacaatataatacttaaaggtagtatacgcacactactaattttttcagcttaaaaatgcaatgaaaaatataatccaaggtaagtacttgtataaagatccagtatatgaatagctcgaactgaacaaaactacaacctaaactgcccttatcgaatcaccattgaatatctcatataggctatagctacttccgaagagtatatatatactgaacccaatgtattcctagtgcttaattgaaaaaaaaaaactatattcgtagtgtccttgttgacaatgatttcctgggcatcaaagtccagccaagcaatacacagatagggtgaatactctattgcatgacgcaaacaggtaggcaccacagaaaacaacagagggatatatttattcaaagctaaaatccctgtgatgctgaactatttataacagcgacatgatgagaaaaaaacagggatccacaaatcgacacatatttcaggggacgaacaaataggcatggtctaagatccacaaatcgacacatatttcaggggacaaacaaataggcatggtctagtttattactgaattagctagaaaaaactcctaaatggctgtgcatttggaaaatgtcatatatagctacattgctgaacatttggcaaatgtcaaaataaataaatcaaagaccagattgtaaatttagaattgttttaccaaattctggattaaatgccatctgaattccaaaataagaaaaaagaacttcagaatcaaaatcccaacaccacacataaaccaacaccattctgatctttgactccattctgatttaaaccaacaccacacattcctagtgccgaacagccccactacagaaatacaataagaagcagcagatgcacatgattaagtacacacaattcaaacatgtgtgagcatattctggttctgtttttgtcagtgattttacgaatttggatttttcttcagaatcaaggcacaacatttatacgcaaacatgcatatgaatatgctagaacagtattactatttatagtaattatgtcattcctgatcaaagcagtacagggttagtataagcaaaaatcaaaacacctgtccagtcagcaaatagttagtctatgtaaagtctagcaaaagggatcaaatatagaacaattcagagcctagcaaaagtattcaggaaatatctagttgtaacacatggatggagtttgactgcaaattaaggccagttcatgcaccaataaaccattccatgcatgaattacatcatccactattcagatacttgaagaaatacagatacttgaagaaatagggttatttgaaaagacagtgaacaatagaatcagttggaatccatctccccgtctagattgaagtagtaaatatagatatccagggatcatacctgagtggggcagcctaaccgtagaagactgtgtcgatgcagattgagcactggagcaccgtcgccgacgtggaagagataggagcgcggcataggggaggggacctaccgtcgaccggttgtgggctctgaggaagaggggcgtcgagaccttccccagctttcggctgtgggcggtggttccccggcgatagggcaacgcggttgaggaaaatgcgttgaactatgggcggtggcagaacagcttgaggggagcgacgggagaaatttgggcctgtttggttgctaccaagaatatgcttggtctgagactagtctgactcattttattccttgtttggttgccaccctgagagccattctccctagcctggcctgaaggaaccggacaagtgattagcctgagttaggtgaccaaaatcggtcacctgagctccaggtgcacgcgtgcaacagaaatcaaggataacctatcgtagagatgtcccctgtgcgcacgaggcccacacccccacacctcacagtctgcaattctgcatgcagttggagattaatttgatgcatgcttggatttggaggtctcttttctcgcgttctcctaattgtttcccctcaacaggtgtgatgagggtgttaggccccgatcttccgataggtattgataaacagtcgatttggacggagtcgcgacacaactcgatccggcttctgaacgaacacgctactgagccccgcaatcgcagcaccacgtctcctctggttatcaaccgtgccgaaacccggttgacctcgccgagaaggctaatctctgcatgcgaatcgaagaacacaagcaagaacaagatagatttcaaccaatttgcatatgaatgattaagtacacgaatttggggttccacaaaccgatctagcagcgaaactgttcttgacagaataatctgaataaactgttttcgatcagcggctaggtccatttgaagttgatgctgtcaggaggcccgaatctgaatccaaaacgtgtacaacttgttctcttgtcttctatgggccaaaagtgacgtggtgagatgaaagaagacttggagaaggtcttggtttggtccccaatcaacttattcaatcatccatgcattccttacactcgatctcttttctttagcaacgtttgttcaaatatataacaagtaaatctaatatagaacatatgcacctttggttgattaatacataaagtagccatggttatatccgagctagttgtgttctcatcatcctccccttcttgattggaaatcgtcctcgatttcaccttgtcatggagcgtattaaacttatctttatctatcacatccggtgaggaacatttcttgatggtcatatgattggatcctaaaatctttgtagtcgaaaaaccactacactccccttcttgcaaaccaacctgtaacttatttaaacaactagaggaactagatagataattacatgtgcgcatgcggtcctctagacaatacatttcatcatgaaaaggaggtatagtcaaattcgaacaaatatatactcgatgcacattatattctcctttactatcataattgccaatgacatgaaaaatcacatcagaagtacatggcaattcaaatctagcaaataatttcttctctaaatagttgagtggacaaaaatcatcaaaatgaatatatccccaagtatttaaagaacatagcaatttaagctcttcattctcccaagcaatgtgaataacatgtttaaactcaacactaggtggctctactatagaactaacatgttcattcactagttgtggcatggatataagtgaagcatcgcacaactcttctttatcacaagagacatcaagcaatttgttttgtgacaaaggtatttcaacaattgtttccactatgagttgctctaacttagcagaagtagtggacatagttggcacatcataactatgcataccttgagcagttgtagcaccattactttttttctcatcttcagaaattgtaggcacttggtcaattaaacattcctcaagcatgcgtggagctatgtataggtttttttccctcttcgtctttcttctcttcctcattaccttcgttgttcttagatcctgcaaaatattagtatccaaagcaataggcacaacattacgttcgttttgtaataactcagacttagttgaaggcatcacaatagtatctttcctggtatctctgaaaatctcattgattctatttttcttcctttcaatactatctttgaaaatttcctcgattccaatcttcattctttcaagattatcttcgaaaatttcagtaaaactcatgggtaccaatttcattttccgaccattatgtctaaatgtgtatgtattagcaacaaaattatgcgatccattattagcgtatacccatggttgaccaaacaacaaagaacatgcttgcatagggacaagatcaaaattggcagtatcatggtaatttccaatcgaaaagtttattctcacaattctatttaccttgaacttaccacaagagttgaaccatttgatgtaatatggatgaggatgcggttgtgtaggcaactcaagtttctcaaccaaatctgaactcatcaagttattgcaactctcactatcgattatagtgcgacatgctctatccttaaccacaaactttgtttcaaataattcgtggtactgccattgctctgctttctccatttgagaacttagcacttgttgcaccaaagtactgtcatcacgtgcatctgtggaaggtgatgtagcagctacggtttgtctcccatccaactttatctcatgtccataagagatgtaacctaccattgttagtagaaaagagagaacaacataacaatattgttcctattaactatagaacatggattgtagtggagactagcaaatggaagcgtcttaccaagctcttacaagtgccttaccagcaatgctaaggacggtacaaccggtggctggttcgtgacaccttgaaggacatgatgtggcgattgcaaggatcaaagcagtgctgactagaagaatatatgtggagcttgggaggcacaatatatagtagaaaaggaacgcaattatgctaataagaaaatgcaaagttgaataatagttcaaagtactagtcaatgtgctggcctagtctagactcaactctagctcaagcaagcacccgaccacactaaggactagaagcagctcaaaccacaactctgcactctagatacagctcaaaagaatcactaaattttctcttctttttttttgctgcagctttttttaagcacctttctgccttttttttcttttttttaggtgcggcgttttctttcttttttttctttgcacctttctgccttttctttctttctttagtttttcttactatattttttttaacaagaactgaccactgacctcgaacagggactcaaatgtaaatatgaatattacatggactcaaacacaaagtgcaaaattaaaattagatcaccccaaaaatggaatgctcacatcacgtaggttccgtttttataaaaatatctcaaatctacaaccaccaaaatacctaacaatctgataatcgaggaagcggcatggaagaaacttgccgtgaggtggaggtggttgtcaaccgtgagggggaggtggaagttgcggatgtggggtggggggttcagcctcagcctccacaggataagagtggccccactatttctttttatctctaacagaactaacccacagcaaccaatctcgtgctttttttttatttctttctcacggcacacataagctcgggaacacacgacaagaaccctagcaagaaagtaactctctaaccgctcgataaaaatttctccacatcataaaaacggaaaccagatgatgattagattcgatttttcgaggtcccagcaacaaccgacgagatgaaaaactggaaccaaaactgacgtacaactcacaccgacttgagtgatgaaccctagacctaagtgatgaacagatgcaatactcaaaactaaaaattaaatctaaaaactaaaccagcactcgacacgacgatgcaatctagaattcaacaaagcaaaatctaatagaacaatgcaacggctcaaatttgtctaggtaaagaataaatatttttgtgtggcaattttctagttatgggaagataaattacctaatggcaaccgtgctttgataccaactgatgagggatgttaggtcccgatcttccgataggtattgacaaacaatcgatttgcgtggagtcgcgacacaactcgatccggcttctgaacgaacacgctaccgagccccgcaatcgcagcaccacatctcctctggttatcaaccgtgccgaaacccagttgacctcgccgagaaggctaatacctgcatgcgaatcgaagaacacaagcaagaacaagatagattgcaactaatttgcatatgtatgattaagcacacaaatttggggttccacaaaccgatctatcggcgaaactgttcttgacaaaataatctaagcaaaacccaaatctaaacgatgatggctactgaattaatatgattagggacgtcctagggttgccctagggcacacaccccgttgggctaagcccacgacacaattacaaggcccaaaacccgagtcagattcggactggatgagatacgtggcttgttttgcagattcctggcagctcggtaggaattttgatgtgggaccaaaaccatctgaaagtagactccataagctttccaacaagtactcatgggtcccaaaattccttctagatcagcggctagtccgttgaaagttgatgctatcaggaggcccgaatctaaatccaaaacgtgtacaacttgatctcttgtcttctatgggccaaaagtgacgtggtgagatgaaagaagacttggagaaggtcttggtttggtctccaatcaacttcttcaatcatccatgcattccttacgctcgatctcttttctttcgcccaagcaagtacctctgcaaacgaaaacacacaaaactcattgtgtagcaacgtttgttcaaatatataacaagtaaatctaatatagaacatatgcacctttggttgattaatacataaagtagccatggttatatccgagctagttgtgttctcatcaaggtgtgtgatagatttgtcatttgtaatagaaagctagatagctagcagatagatttttggtgggcgatgcagtcttgccaatattttgtatcttattccgattatcacttaacttagcaataatcatgtacagcctaatcatatttttacttctcaggcagcagttgcaaaccaaacaagcgaagcatccagctgcctgactaggcaaaaatctgaactcatcggatgcctttcaggcatgaaaaaaatcttaggcatgaaaaaatctcaggcatggtgctcaggacaccaaccaaacagacccaaagtcacggaggaggagatcgtgcaaggggatggagaagagatcccatcgtgatccatgattgggtggggcttgcgctacgggggagagagacagagagagagagagagagaggggggagggggagcgacatgaggcgttggatcttagggagaagatcctgaccaatgaggaatgagtaatgaagtctgtaacactgtgttggtgaactatagggtaaattatctattacta

SEQ ID NO: 28456 - DNA, 1954 bp, Oryza sativa
  unsure (1)..(1954): unsure at all n locations
cccttcacaatgtaagccattctagcatttcccacattcatattgatgttcatgaatttgtctagatttatgaacatcaatatgaatgtgggaaatgctagaatgacttacattgtgaaacggaggaagtaggtaggcagtgaagaaaatactgaattcagcaaggtaagcctatctccataagataaaaaggttgaattagcagatagttttctatcaattctaacagaggcaaaccaagatatgtgaaaggaagtgagccaacttgacaacaaaaactcctgccaatatttgtgctttttcctcatctatattaattggtatgaggcatgatttatgataattcactttgagaactgtcctctgtgcaaaaaattacagtaaagctttcaaagtgaataattcctttccactggctttgacatacaaaagatttcaaagtgaataattcctttccactggctttgacatacaaaagagtattatcagcatattgcacaattggaaaatctagatcattctcattagggataggttttgacaacaagccaagagtataggccttgttaataataacctgaagcaattctgcaccaagcacaaaaagcaaaggagatagtggatcaccttgcctgacggttgttaacgattagtttcgcccgtcaatattactaaaataaaggaaaactagttatgcttgcaatgcatattatgttagaatgagaaatattccactagtactaggattctaatggagaagaaccgacagcaaaatagacgattggttaatcagacgctgtcgagaagtagacttatggatggatgggccaagaacactaaattgacacgaccaaaacagccccaaaatttacaagtctacagaaaggagcaagcgaggaggccacctgctgaaaatgggctaggaaggcccagcccatggttcggccgaaccatgggttgggccgaaccctcccgggcgccattggatgcgaggtttcttctggatggcttggatcactccccaatgatggttggagggcatttccgaccattccaaccaccacaaccgtcattgggaggctatgtaaagccctctcatcctccactccatcacacactcaagcaagaagttctcatactctctcaagtttagtttagtgtcacaagttcaatttagaatagaatcttcatagaatcttcagttctcgacactcgtgcgggcttggaaccaactggggatgcacccggatggacccaagccccacgccacagcatcggaggttcaacctcgcagagtgccagtgagaaccggtgacaggtgcctcatcacgtacatacaatgggggaatatgaacgcccgttcctccagctcaagtggtatgcctccattctccaactagtggcgctcaatttcctctcgggacctgggtgaaatcacgaggaggttggatacccttgacatacggacgagagagatccatcacaacctcgaggaacacatagcccagatgcaagaatggcagcaaaatgctgatgctcagttcaccaacatcaacaatctgatgcagcaacaacacgctgttctccaagcgtacttctgcttccaggggttcaatccttaccaaggaccctgagcgaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28457 - DNA, 674 bp, Oryza sativa
attcctgcacccctgactacataatctatcaccctattctatttgttgacgcatgccgagacgtaaagcactctatcgacaccctggatggagccctcggattacagcttgacagacatatcctggtaacgatgaaagcaccgaccggaagaaagctaaccgagcgggcactgaggaccttgatattcttccggacacgctgctctttacccccaacctcgacgcgctgacttcacccatccacggaccataccattcaccattcaagactatcaactgatcagaactaccataatcgtgcacctatgaaatataataccccatgccgaaacggacatgtgctgcttgggtataaaatgctgacacctattagctgtgacagtcacgacgccatccaacaacaacatatcatcactcgtcatactaacaagtttaccgcgcatgcggtgacacccctccgctcaggtgaagcggccggtcagtgaagcggccggtcggtgaagacgtagacgcccaacaacggtggcataataggccagccgtgcaggcggaaacaccagtcggcggcggacgaggcggccggtcggtgaagatgtagacgcccaacaacggcggcataataggccaaccgtgcaagcggaaacaccagtcggtggcggacgaagcggccggtc

SEQ ID NO: 28458 - DNA, 18893 bp, Oryza sativa
  unsure (1)..(18893): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctaaggggtatggaacagaggaggtcatcgaattttgcgtagaatttattgaagaccttcgtccaattggggtacctgaatcgcgccatgaagggagactacggggaaagggaactctcggaaggaaagcaataatgacggtagacaacaatttattccgtaaagcctatttcacagttctgcaacaatcttcattggtagctccttacatcgaggagcacttggctctagttcgggccagaaacatcggtcagtccgatgcatggattacacggcatcacattgatactttccccgcgttgctacgacaacatctcatgggtaacgagacgatcaaccaacaactggtcttcctggcaaggggaccatctgggtcgatcgcgacattccagggatatgagatcaatgggtacacattctacacgagagcccaagacatgaagagcacgaaccaaaacagcgctgttcgtatcgatgccatgggacacgatggaacaactggcatgtattacggtgccattgaggacatatgggagcttgagtatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtcaagcaaaggaaagaagggcagagggcctgacgagccgaagcgtcacgtggttctctcaggcaaaagaaaaatcgtcggagttgaggacaagactgacgaggattacgatcagtttgatgggcaaccccctttcacggtgacgattgaccctagcatcctcctatcaaatgaagacaccccttactcacgtagcgatcacaaggaggaaacaatagtgaggagaaagtacgtgcggtcaaccgtcaccgccgatgtattgccgtaattattgtgtacacgatgtaaactattttggatgtattgattatccatataaatcaatttttgtatggcatatgttaactacgtacgattattagaggttttaacaattttaaatcatgtaattgctagttatatgcgataattagaatttttaaaagtcttaaatcatgcaggtggcatttacatatgatacttagagtttttaacaattttaaatcatgtatatgctagttatgtgccataattagaatttttaaaagttttaagtcatgcatgtggcatttacatatgttacttagagtttttaacagttttaaatcatgcatatgctagttatatgcgataattaggatttttaaaagttttaaatcatgcttgtggcatttacatatgttaattagaatttttaacaattaatttaatatcattcatatgctaattatatatgattattcaaatttttattaattttaaatcatgcatgtcgtatgtatttacatatgttaattagagtttttaacaattaatttaatatcattcatatgctaattatataagattattagaatttttattaattttaaatgatgcatgtcgtatgtatatacatatgttaattacaatttttaacaatttaatatcattcatatgctaagtatatatgattattagaatttttattaattttaaatcatatatttgcttattacgttttatcgacttaatttactacagacaacaataatttttcgaagtaattgtcattaatttttcgactttaaataattttaatgcattattttctattttagaaacacatatgtaatggaaattaatattcagtccgcttatcagtagtcccggttcctaaccttaaccgagtttaaaaagaatttggaaatagcaggaaaatatctttagtcccgattgatgagaacaacccggagtaaagatatctttattcccggttgttgagaacaaccgggactcttatctttagtcccagttgttcttaacaaccgggagtaaagatatttttatctttactcccggttgttctcatcaaccgggactaaagatctaggggtatatatattcccgatacgcgccctcatcttctccaccaacacttagaagttttttccccgatcgatctctctcggcttctccttcgccgccactgcctagggcatccccgcaccgacgccgccgtcgtatctcgccgtcgtctcgtgcgcgtcgtcgtcgccacctccgtcgccgcctccccctctctctctctctcttcgatctcgatctctctctctctcccgaaaccgccgccggccgcctcgttgccgacgccaccgcctacgtcgtcatggccgaacacgactccgccgcgccgacgatgccgaccccgaccttgatgcggctggcaccggcgacgctgtcgccctcgcagtgccgacgaagccgcgccacaacgccgcggcggcacgacacgctgggacgccacgacgccgccgcggcatggcaccgccgcgccgccacgccgccgccgcgcaacgccgccgccacgccgcgcgcgtcgccgtcgccgcgcaacgccgccgccgcgccacgcgccacgccgatgccgtgccgccacgccgccgccgctccactgccgccacgtgaacgaacgaacgtgaacaagaacgtgaacgtgaacgaacgaacgtgaacgtgaacgtgaacgagaacgtgaacgagaacgtgaatgaacgaacgaacgtgaacgaacgaacgtgaacgttaatgaacgtgaacttaacgttgtatttgaacgtacgtaaacaaacgaacgtgcgtgaacgaaaagtgaacttaacaagaacgcgaacattacttaacgtacgttaacgtggacgcacgtgaacgaacgaacgtaggtgaatgatatacgtgaacttaacaagaacgcgaacgtgaacgatcgtgaacgaaacgtgaacttaacgagaatgcgaacgtgaaatacaatatatgttacttcgcgtttatcctaatacatctttttgtatgttgcagaaaagacgttgtcgtcgtcgtccctcaagccggagtggtagctagccctcgaaggaattcgcgcaggcaagtgatgtaaatatatgattgttagatttttaatgcaattaagactattagatttaatatacgacacttagacttagcattataattagagttttaatacaatattatttgagttttaatataagattattagatttgtaattagacttagcatataagattatgtagggttctaatatatgactatttgagttttagtataagattatttgagttttaatataagattattatatttgtaattagacttagtatataattattgactagttagggtcctaatatacgtcacttaggcttggcatagttgactattacagttttaatacaatatttgagttttcgtataagattattatagttttaatataagattattagatttgtaattagacttagcatatacgacagttagacttagcatatatgacttagcatatatgattgttagcatataagattgttaaagcaaaaatgtctcatgacttagcaactatttcttgtatgaacagatggctgaccacgatgaggaatagatattgtacgatacaatcgcggagggaagcagctagtactggaacgaagaagaggggaacgaggatccaaaccagtacttgaacgaggaagggaacatggagagggatgcggaggggaaccaggaggggcacatggagagggatgtggaggggaaccaggaggaggaggctagtggaagtcaaccctccgctggatagaagaggacacgtgggcaacgaggtgccgtgaagaagcttgagggttggcacatcataacggaagtggacgaagacgaccgacctagtgtcccggcggaagcagccaagaactacgtacgtcacagcagttgggttatgcgggataacatgcctgtcagtacggtgtactggcgcagaacaaggacacgcagagatcatgagagctttgtcccagattcggagaaagagatgctatggaccacaatgctcgagacattcacccttcccatgggtacagaggacaaagtgaaaaggtggactctaaagaaaatgacagaacagtttcagagcttcaagggagatctataccagaaatacatcctgaaggggcagacaccgaacttcgacacattcccaaagctaagggatcactgggacgagttcgttgcatataagataggtcaacaagggcaggcgatcatggaaagaaacaaagaaaataccaccaagaagaagtaccatcaccacttggggtcaggcggctatagcgtcgcgatgccgaagtgggaggagatgaaggcaagcttgcttgagaggggtatcgaaccggctaccgctaattggccagatcgatcgaagttttggtactatgctcacggtggaacactcaacccagttgatggctccttggtcttcagcgatcagatacgcgaggctgcgcatcgactaacggacgcagtggaagcctcttctcagggcatgttccgacccgacagagagaaggacgagctgtcactcgccctgcagactccagagcatccaggacgaacacgagggaaaggggtgattccttggaagattgggttcaaggaggacatccacacgtacaggagtcagatgaggagcaagagagataccgaggcgaagattgcagatcttgagtacagggtatcgagctacgagctcagcatgcaagaggaggtggcaagtaaggttgatgaacgcatggccgcacatcggtcccatgatccccagccgaccattcctcctgcaatgatgagcccttcaggaaatcgtagcagctgcgcctcaacagggcaggtaggatcacaaagcatggacgccatgcaaacccaggacgaaaccacctgccccgttgatgacatcactcagcggacaccatgtgagctgcatattccctttaagaacttatcaataaaggtaggctcataatttatatatttttgatttgtccattccgcaagttgctgcttatatatgttgattactaataaataacctctcaccacgtgaaggtggcgtcgggcatggccatcccaacagacccttcaggtacttaccactgcaggccgattctagcaggatactccaaggtcgaagttgagttggtcgaaggtgcgtacgaggacctcgagttggattaccctagaggagacggcgagacgcatctacgagacacaagccacgccattatactatggcgcaagcggtacatcatcctccctaggcgacaagcggcgtctcgtgcaccatctcctccggctctgccatctcctcctcaggctcttgcaccgtctcctcctcatgctcctgcaccgtctccacctcaggctcctgcaccgactcctcctcaggttcctgcaccgactcctccttaagctcctacaccaactcctccgcatgctcctcgtccggcaccttccaagtcaagggccccccaagctccaccgcctgcccccacaagggcaacgaagaaggcgaaagttgacaccgccaagaacaaggacccggggtacgattgtacgcaagaggagcttgacgcttatgtggcattagaagtcaggagacaattgaagcctcgaagtccagaaaagaagattcctatagacccgagtgtcatgaacttcttcagggatatgtctgcacctgccaaggaggccataaagctatcggactatgagcgaacactcaagaaagcatcttctagaaagtccaaaccagtccctcagcttggagagcaaccaaatcaggagatcgagccgttggtgaccggtgaagattttggaatacaagaatttattaatgacactaggctaactacggatcaatttctacgaggcgcaccaatcgaaaaggcggaagtgaaatacatgtacgaactcggtaaattgcttatcaagcctgagcagctgcagtctctacccacacaaatgtacaagttccatcaactgtacatggagatgagcgccaccggtagagagatgatcggagcaaggatcagggacacggacttcacatatatttttgaataagatgaacggtcaaacatgtttaaaaaagtcaacgacgtcacatatttagggacgaagggagtatttcggtatgggccacgtgatctcatcggcaacaagagccatcatcaagtcaacagcatcaaatatttagggacggagggagtatttcggtatgggccacgtgatctcgtcagcagcgagagccatcatctcattgttgcgcccccaatcctttttcctcttctcatcgtttaattaactggtggtaagagctataatgggtttgccttatgtatacacaaatgaatagagagcctagctaacaacaaaatgttaataggtaaaaatcgaatgctaaaaaatagatatgtaacttcagtgaatgtctacttactatgataaacacaccttaaaaaatagggaacaatcgcaaaaagtttactttagtcgtggaagttatacaactaatttaaggcttcagttgtaaaaactgcataacaaatttaggattataatcattgtttgttatacgataaatttataaagcttctgttgtaaaaattgtatgataaatttaggattataatcattattaatggcatatattctaataagtgcgaacatgttatagtttatttataataactagcaatgatgcccgtgcgttgcaacgggtaaaggtaattttaatcatgtatactggtgggaaaaaaaataaaggaatcataataataataataatattaatgaaataaaattgcagtgacctttggtcaaaaagataaaaatatataattaattttccattaattccattagctaaaaataatataatacgaagtaggaaagttattctcaaattttagcaattttcaaaaagcttaaatagagcaaactaattatataaatgaaaacaaatttaatcacctaaataaaacaattagacctgtaattgaaaatctgttgtcagttcagttaaacatgagcctgcgggtgtgtatggtatatatctctcactcgtatgtcgtggtctttttttttgacatagaaaaaatgcccatgggttgcgacgggtaattaaaattataacaaatataaaaatattatatgattaaggtttagttttacatgatatgaggtctttaagaaaatatatttataatgaaataaaaaagttcagctgaagtgacctaaagtgaacttgttccatacggagcgtacacatggtcaatgaggcggcccaatagtgtgggcggcctaggaatagaatcggggaggaacaacttaagcgacctaaagtgaacttattccgtgtgggcggcctaggaatggcgttcggcctgacgtgggagaagccagagctgtctgatctgatagacggtcatcccgacctatataaaagttcaacagcccaaaccctaaccctaaaatcatttcccctcccccctctctctcaaaacaatgtggcggcggcccgacataccgacatccctgcgacggcggtggcggttcagcagcgacggcgacaccctccccttccggcgtcagcgttttcttagtgttcttgaatctgatattgtattcttgcagtagtgttttctttagaatttaagtccaaatttgatgcggtctctcattttttttctttcttttctttttttattttttgccatcggaaagggattaaagcgggatcaatcgcacgtgcgatagcatttctataacccataagccatacaaatttttttaattaggtatatgtagatattgaatcggactttcctttttttttcatttttttgcccttttttggttactacggatgtcagaaacatctttaattttttttaccacgtcacgtataatcagattcgatttttttcgccgatttctttttcacgctttttttcacggatggacaacggaaacactttttaatttttaagtagtagagatagagatagacatacacatagagatagagaaagagaaacggaaaacttttttcgcaacttttttttttggaatcggacagaaaaaaattttacgcttgttttttaccgcgtcgatggaatcggattcgatttgtttttttaccacgccgtgtcacatataataggattcgattttctttggaatcggacatatacttttttctttttggcccatttctttaccgcgtcgacggagtcggattcgtttattttttttccttttttcatccttatttaccgtgtagaactagtcagattagtttcttttttttcctttatttcgcccctaatcggacttattttttttctttttttttccggtttttttcccttctttcgcccgttttgatcggactttgtttttttttcacacggtttttttcgtccgcggattttttttgtttcgtccttttttttatcggacatagttttttcacccggtttttttcgcacggtttttttctcccacggttttttgacggacgatggaagcacctcttattttttaagtatatatataataataaatagagatagagatagagatagagatagagaattgttacttcatttttaaaataccgtacacttcgtcctggtgtgatgatctgtcgtagctaaattttagtgctgggtctgccagtgaagatctggaatgccaaaatcaaatattacccgacagatttgtcgaactgaaaaatagggcatgaaatctttatggcaacttgaaaattttgatcgatgaccaaacttacgtggcaacctaaaaaaatgtatgatcgatgtatgctttcattgtttctttttcattacatggaaatcttacaaaaatgtatgatcgatgtatggtttaatgaattcttttttttattgttggtatgattttaattcgatcatccacatattttggttgtttgattcagattataaaatattatcgtagtgttagtacgggcatgccactagtactacttaagtatcaaacatcagtgcccctccacggtagggcattttttttctaaaataactcaaaattattggactgttagtccaatctaccctatatttgaaccaacaccgactggggtatttcctcgcaaaaaaagaaacaccaactggtgtattaattaatcaatttttgttagggccaaacgtttctgctgggcttcatctggatatatacgtgtattttttggggattaattcgtacacgatctactgctgttgtatcaggtgacccgtatctaggggtgaaaacggtacggaaacggacggaaacaatctttatcgttttcgtttccatatttttttcggaattggaattggaatcggaaaccccggaaacgaaaacggaaacgaatattatcgaaaccgaaaacggagtgaaaacgaaccggtgcggatacggtaacgaaaatttattggaataaaaaacccctcaaactgagcttcaaacttttgtcaagtccaattctaagtctcaacaaacaacaattcatcatacaacccaattatatgaaatcgtcttaacagcaaaatatattcttctataccttcatataatttgcataacaaatattttaaaaaaattacagcaaaacagaacagcaatatattcttctataccttcatataatttgcataacacccttgtataagatatatagtatacactattattcagtgctatactgctaatctgctatgagctatcactccatcatcagtacatagttcatcaattgtttcggtcatcacagaacagcaacacacatcaatccatcagtacagtacttggatcaatcacaaaacagctacttacatttgatgattccatcataaatctgcagcacaaaagaaatcaaatcaatggtttatgatcgtcggctcgtcgctgggctgctggctgctgccgctgggctgttggctattgccgctgggctgctgctgctgctgcgactgcgaggcgaggcgtcgtcggctccttggtgtggctgtggcgtcgtcgtcagtagtggtagtggcggtgaaacggcgggacggcgccgcggccgcgaaacggcactgcgaaacggcgggacagcgtcgcgagatggcggcggtacgagacggcgaagacggtgggggcgaggtcgcgaggagccgaggacggtggaccagcggtggcgcgggcgccgggcggtgggcgctagcggtgggtggagcgcgatgctccaccgccggcttgcggtctcgcaaagtcgcgatgccgtgtggctgtctctctcctgtagggttagccgctatttggatagatgccgcgatttgggttgggcttaaaacttggggacgagttatagactattgattctatgggtctttttaacttcggaaattccgataatttttccggaatttttccgattcgattccgtttccgagaaaatatttccgttttcaattccgtttccgagacattccgaaaaaattccgaccggctgattccgtttccgaaaacaggcccagaatccggaaagtttccgtaccgttttcacccctacccgtatcggatatttaacagatcaatcactgttatatccagattaattccacgacgacccaccatacatacgtgccgcgcgccgccggccggcgcgcatgggcaaactaagacgcgtcggcggcgagggaaacgacctaatcagcgagctcaacgatgacgtcctcgactccctacccaccatggccgacgtcgtgcgcgcgggcgcggcgtcgcggcggtggcgccacctctcgacgcgcgttccttccctgcgcttcggcttcaccgaggacggcgtcgacgcgaagccgaagcggcgcgagaaattcgaccggttcgtcgccttcgtgaaccacgtcctcgacgcgcgcgccgccagcgccggcatcgagcagctggcgatctccatccaactgtatgaccgcggcgccgcgcatgccgtcgccgcgtggattcggtacgccatgcggcagcggcacgcggtgaaatctctcgctctggatcttcacctgccggaggatcccaggttcgcggacgataacaccatagatctggacgatctttcgatggtttccaggagactggagaccatgacgctgtcgttagcctatgtaagtctccggctccccgctgctgccaccgccaccgccgtggtgttcgactctcttgtggacctttcgttcaaggggatacggctcgtcggcgccggagccggagccgatagcagccgcctactcagccggctcgtgttgtccgcggctccggaagctacggctggtgagcgtagtcgggctgagatcgagcgctgtggctcgacgccgacgttcgctgcaacagttccctaggaaccgggcgtttggtgtgcttgagctcaacacgccgaatcttcgctccctcaagatgtgctgttacgcccctggaacattgagaatctcggcgccgaggctggaggagttgagatcctccaacaacgtgatagacatgaggtggcaatgcgtagagcaactcgacgttggtgacctgtcgtgcgtgcggggactcagggagatcgacctgagctctcgtgggcaccccgtccgcgacgccggcattaacgatggccccattcatctcctgcggcgttgtactgccatcgaaagtcttggtgttcgccttgtttctccagataaggtgtactccctccgtcctaaaataaaccgattcctaggacggagtggttgtcccccaaaaaatcgattcttacccagaaaacgagacacatttaatatcttgcgtggtcatgggtggtccagaaggagccagaccatcgcagcttttcctttctctctgttcagacggtaacctttcctctcccaatctccctcttttcgcttctctctccctctgcctctgtcatcctcccactcaatctctcactccagctccaccctctttccgctcctatctgcagggacagcggcaaaagccgcggcgacggatgcggcggcgacgacgcgcggcgacggatgcggcagcgacggcgtgcggcggcacatggatgcagcggcgacgacggcggtgatggatggatgcggcggtgacggcggcggcggcggcgatggatggatgcgcgacggatggatgcggcggcggcggcggatgtaggatcccgattttatttttttttcctctctattcctagttcttctttgtttttcttcttgctattttttttcctctattcctggttcttctttgttcttgctattgttcttatatgtgaattcaaaccatttctttttcttagattagagagatgttccttccttgcggcaatgcatttcgttttttcttctcctctgagtactactccttcttctctaaagtactagtagtaaattaatgtgactgcagagattgggattgttgatggatgtagttaatgagggtacttcggtaatttcacatgaatcctaaactagccttggggatccaggaatcgattttatttgagacagagtgagtatatatgtgcacactccttggtttttattcccatatgttaataactagctaggttgcctgtgcaattacgcggctagcatccaaacaaaatcatatattttttaagtttgattttacttaaaatttattaaatagctatctcattgtcttaagactttgaaagaccaaaccttatcatccagtgtttctaattatatagttttttaaagtcacatcagttgctaccccttatgtcatcttctactttatttgcttggtcgatctaccactatttctattcattctccttggaacctttaaaaattagatattatagtttttagagtttattgtaacgttgggtttcatttttataatttctagacgtctcgtcaaacgttgccattatactcctctatggcatgtccactgtctcttctctttaatgtcattgagattttaaaaatctaacataattatcgtttgggttcatttttactttcacaagtcctgccaaactcgctcgctgcctcccttctttattgtcattgagattttaaaatcgaacataattatcatttttattactttttagaagtttcgaacctttaaaaattggaccttgtagtttttagagtttattgtcttgttgagtttcattttttttataatttttagaagccttgtcaaacgatgccattatgctcctttacggcccgtccaccgcctactctttattgtcatcgtgattctaaaaatcaaacataactatcgttggaattcattttttattttctagaagtccagtcaaccatcggtggctctgcaactatactcctatacaccccgcccggtgcttctcctttttattgtcattgagagtttaaaaatcgaatatgattatcaatgcggtttattttttttactttctataagtcccagtaaccgtcttgctcatttgcttcacagcttgcttgtcgtccctccttttaattgtcgttaggattatatttggtgttttattaacagtttttatatgtcatatcaaccgccaccactctactcctttataggcatgttacttaatttatctcgtcatatgttttagatggtcttttctttcaatagtctttatttttatcacaaattttagttatttataaattgtattcttaattgaaatcttatttttctttttctaatttcataatttatttttcttcaaattttaattaatattgtattgtgttcttttaatatttttactttttatttttaatttcagttgtttcaaaattttattcctacttgaactccctattaagttttttaattttggatattatattattttttatgaatagtaattcatctcatattgggttcttatatggattcttctttcaatattgcttatttttaattccgaatttctgctaattttaaattctattcctacttgaactcttcttttattttttttcgctaattttggattttattttttattcctaattttaattaatctcgtattgggttcttatatggactcttcttttaatatttcatatttttaatttcgtatttcagctattttaaaattgtatttctacttggactatccttttcttttctaattttagattttattttatttttatttcgaattttgattaatctcatattgggttcttatatggaaacgtctttcaatattgcttatttttaatttcgaattttagctatttttaaattatatttctaatttgactctcctttttttttctaattttggattttattttgaatttcgattaatctcattcaatattgcttatttttaattccgaatttcagctatttttggattgtatttctattttaactctcatttttttttctttttctctgattaatgtgagaatttctagcccccacagcgaacgtggtgcctcctttcaaagctattttaacaatataaacatagatgcgagttatatccctcctatatgtatattatgagtacctttacgggggagtattttaactaacaatattgtcactagtagtagtcgtaatcttaagggttgatttatgagtagtacaactatatatctatagaaaaaaaatattttttactatgaatagttaacttgttgtggtagtataaataggaatgatcaattggattagaaaagactgtgaatggtataaaggggtacttatattataatgaccattgtaaaaaggggtacttatatattataatatatatccaagctataaactgtacatgcatatttttctatataggccgtgtttagttcgtgtaccaaaatttttttaaagtacacggacacacatttgatgtattaaacgtagactaataacaaaacaaattacagattccgtctgtaaactgcgagacgaatttattaagcctaattaattcatcattagcaaatgcttactataacatcacattatcaaatcatggcataattaggctcaaaagattcgtctcgcaatttacatgcaaactgtgcaattggtttttctctttttcccatttaatgccccatgcatctgtccaaacatgatgtgatgtttttggccaaaattttttggaatctaaacaaggccatatatatctttttcgaatgacattgattatcctctgtgcaggaatacgtagttatctgggatgcagaggcagaggaattgatagatgaagaggaagagaaagaagaggttgatgacatgatgaaagatgtaccacatttgcccggagtcacatctttgacaataagggattctaccctaaacgaacgtgctcttatgactggcgtaacatgtctccttgcacgatgtaactctctcagatactttcagctcaacatgaccagcccgattatggtgagttcctcttgcattctcgcattgatcgttgcgtccatttcgctcgcttagctttcttttcaggtttttaagtactgtgatgtgttaactgacaacaaaataatattagaagttatagaagttatggtatcacaacctcttagacgacagtagaaaaaaaaactttactgcatgactactctctctctgcttccataatttaacgttttggcattgtctccgaaaacatatctttgattttctattgtaacacatctataaaaagtaagtaaatatttatcttttaaaagtactttttataagactaatctgtacatcgtggtatggtgtctttaaactaaatgttctaaaagttactattaacagtcaaaatattatttcctctatcttaaaatatagttttatactgtttatgttcatgtccaatatttgatcgttcgttttatttgaagtttttttatgattagtatttttattgttattagatgataaaacatgaatattactttatgtctgactaattttttttcatatatttttcaaataagacggacgatcaaacgttgaacacgaatacctacggctacacctattttgagacggaggtagtaattgtttaataccttgtctaaacttcaagaatcatgaaacggacactataaccagagtagtacaattatttagtttcttgtctccagacatgctaagatttgctgctcctttatttaattgcatttgcacaggattccaccattgctgctggtaatcaagctagcatcatctcgcttccacatctcacggaagttgagataagtggcttccgaggacggaagtgcgaagcccgcttgatggaacggctgcatgcaagcgccactgctctcaacaagatcacattacgtttcgactggctgtttacagtagaaagtagcagagaggaacgcataaattcgctgcccctaatccctttcggtgaggttggcaagtaggcggcggcttctggtgattttgagacgttcatgtggcgcccctgcgtgaacaagacagaattctgtggtgagaggaagcaaatgtgagactaaagggagtaataaaccatggaagcgtggctagaaaatatttattggggcaggagaaattatgtcatgacatagtagtacttgaactaattaagtaccttttattgaaaaatatgaacattatcttatatatgatattcctatagcaatattataggattattataccatgaaattcatatatttgtataattttctgaggtagttctaggtttctttgattttttttccagttctccaagtacattcatatactttcaaccaaaacatgcgtatatatgaagatatacagttttgttttggatgaactccggttagaatgctctctgctaaaatcgaaagtgagatgctttgtttgaaatcggtattgatctcttggattttctatgagctttcctaagagagaatttgttttaactgtggctagaccatgatgtggaccagagtcttggaggtgtgactttgatcacaattttatattataaaaagattattaaatctaacaagttcatagattacaaaagtacttttcatacaaatctatgagacacaaatctacactttcgccaaagcgattttcgcacaacggcgaagagggaacccccctataaagatttggctaggggcgagttgaggtcatgttcgtttcgcgtggggtgtaaaaaaaaggaatacaataaggacacaagaagtatacaggttcaggctgctcagaagtgtaccctactcctgtgtttggtactatgtggatacgagagtgcacaatacaaacttgctcactgaactaggcactagtggagaaaggggctttaatcccggttgggaacccccctatagtcccggttatgcaaccgggactacgaatccgggactaaagatgcctatctttaatcccgtgtgaaataaccgggactaaaaatccatctttaataaccggggctaaagagggtgggagcagtcccggttgatttttttttctcaaatcgatctgctctctaaatatccccgatcatattcccaaatcatcctcaaataaaagtagcatcacagatctggaaagaaatacatcacatattggaaagaaatgcatcacagatcacaatacatcacatcacaaaatctccaacaaaaaatacatcacagatcctaaaagaaatacatcacatctctcagatcagatccaacatcacatacatcacacagatcaaatccaatgaatcacaaattaaaaaaaaaatcggcagcagagaggaaggcgccaccggcctcccgaccaccgtcctcgcggcctccacgccagctcggccggccggctgccgcgccagcccgcgcggcgcccgctcgcccgcccgaccaccgcacccgcccgcctgcccgcccggccgcctcgcccgctcgccgcacccagacggccggccgccgccgctcccgccgggtgccgctgctcctgcccggccgccgctcagagaggggaaggggaggaacgggaggggaaaggggagaggaaggggatgaagggggagaggaagggatggaggagtaatgagaggggaggagatcgagaggagtgcgcgcggataatatctgagttggtggcgcgcggttcggggtactctttactcccgg

SEQ ID NO: 28459 - DNA, 20095 bp, Oryza sativa
accaaccgggagtaaaaataattggggtctgtcttgaaccccacaacttcttgaaccgggactaaaaatgatctttagtcccggttgatgttaccaaccaggactaaagatcaagaagtacctctcaacttttaaaccgggactaaatatgttttttagtctcggtttttattagaaccgggactattgtggaatttggctgaccgaccaaagatggtttctccaccggtgaggattctagggttgcgtttctaagggttcccatcccaaaagacctccactatgtggcatgaccccttccttttatggtacaagcagggatttacgatgcctttatcaccgagggaatgcccatgtctagtcttgtcattatcccctctaaaacccttgaatttaatgggagaattaccatggacgattgtttttatcgtgcctcgggctccctgacaaggggcccaggacagctgggtcttgcttccctcgccacgtgctccaaactaggcttggtggacccaagccaagtcatagcacatccatcatcgtttttctcatttcttgatggtgaagtatgaaaccacctaccggtgctagcatctaactgtacatgtgtgtggccgtttagagctagcataaggtgaattactacctacctggagatttcctcccaaatggccccgttgagggtcgcttcctgcaacaccgtgtccatctcgggtcggatcgtgagcagctccagtgtatcctgccgaagccacctgttgtcagccgacgagccattctcgtcacccttcacgctggccagcctatcgtggttgagggagctcccgtggctccaccgagctgctcacctgcctgctcctgcttctgccttgttcttacagccagcgatggcgtctggggtttgagggggaggggggagggaagggggccaagcaaacggtgaaaaggcgagacagagcaacgtcaatggcatcttagagttcaaaagcgagggctgggacggtggattgggagattaggggagcgatggaggttcgaggcaacgacggcggcatcgtcaagggttaagagggggagaggacgagagtgatgctgcggggattggcaagggtggcgattgagggatggaagtatgctaggtgggaggtagaggcgatctgagacattggatctaacgtagatgggccgttggatttgacgaatgaggtgcgcaggagtgtagttagtgaactatatggtagatacctgtcgaaacaaattttcggcaatatgaaaagggggtagcgcacgagacctaaaagtggatggatgcggagacaaaggatttagacaggttcaggccctctcgatgagaggtaataccctactcctgtttggggatttgaatccaccgggtgtatattgatctgacgatcagtttgtgtcatgccccctagagggcctcctgtccaccttatataggatggggggcaggattacaagatagaaaccttaaccaatacggtatcggtttcctaaatctattttacaatattatcaaatcaggactttaggccgcttcataatataaaaggaaacgtaatacccaagtcatgatcggttaaatattccatagatataagctatcccctatgactagtcggataaccatgccgtgtgggtatggggtacccataatctccacagtagcccctgagaccttcacagtcggaaagataatcttctctcgaactagattactccaaagccgtgtgcttcaatcatcctcgccatgatctcccgagtacttttaccaaatatgaagactgtggagggctgaaaaataaagtcaggtgcatcgagtagatgtacctaatagatgcaccaactgagtggttttgataatcgtagtcaaacaagtaacttaatattaatatatagcatatgcggtatgaatccctgaataacatgatccgagtgatataccgacttatgatgcgtgcaacctaaagctgactacattattgaatacacatagcaaaacagctataaagaagcttgtatgttgtgaataaataactttccaaagtattgggcatacaccatgcgcacactgctttaacagatgtgcttgagtccctaaaagacacatggtttcactacacctgaaaatatatggcatatgtggtataaaatccgagtaaataaactcataaggatttatcaatcgtctgaaaaatgaccaaaatatataatcagcctaagccataatattggtcaataaaaatacacacttacgtggcaaaaagcaatgatgttgtatccaatcaattgcttgataaacccaaacagcgccatgactatataaaaaagtcagcggggcagctatataaagctttactgtttgacaccttttaagatgcattgtaccaactcctaaaaagttgagtaactgcggtataaaaggattttaaggtattggacactagatcacgcgcacttttgcctaagcaaaaagatgcctaagtccctaaaagaacgtgacatgccacacctgaaaatatgggctgcagacatattaggcctaggccaaaaaatatgccttcgacaccctttaaaggatgacgcatgtaacatgctcccgagtaataaatcttttcgggtgatatagaccaagtgtagctcatatgaataacttctgatctcagtgattatcctttatgggatactccaaaatagatataacaattgaattccgactggcgcaagtattcggttgataacccttacggggaataataaatagtccagtctttaagcataaaaaatagacccatgatcatcaaattcatgttgcatgtatccggaacaagtccaaattgaaggtatgacacttgtgtttgaggtagtaagcccctgagcatatagcgtgtccttttgttgtagtcacaattgtccattgatggtagctgacgcagttggcatagagacaagacgaccaatatagagagaatattgcccaccagaggtggcaaaaatattggtggtagtgaagatagtgataccaatcaaaagtgatgaagttgcacaaccgtgaaggcaaagaaaccagtcggcagcagtcaggtcagccagcaatgaagatgaaggcgcccagcgataaagttgtgtagccatggcagcgaaataatcagtcggtgacagacgatgcagttggtgaagaagatgaagatgcccattagtggcgacataataagccatccataaaggcgaggataccggtcggtggtgacgaaagcaagccgacggtgaagatgtagacacgcatcaaaggcgatgacgaaatccaccaatcatgaagatgaagaaaatagtcggcggcgacaaacgcaaccgatagtaatgatgataagcagcaatcatagatgatcaaatataatgacgaagttgcccatcaatagcagtagagtgggctatgttgaagaggctatgttgaatagggatattgatgaagatgacgatgtcgatgatccagtcaatagcagtgtagcaaccgatgataatgacgaagacgctcatcagcgtttgcatagtaggtcaaccgtgaaggcgaaataacaagtcggcaatgacggaagcaattggagacgaagacatagtcatccattagcaacagcagagatgtcagggccgatgaattagaggtgctggtgatgaagtcaatgacaataatccatcaaactgttgagaagatatcgaagctcgagtagtttccttggcgcgagagtgtgtataacgaagattgatgcaaagctccttgatttataaagatggcagtagaatttggtgttatagctgttgcagattcttcacttggaggaaagtagatgctcttgcccaactcatcaaaactgaacttattggttgataactccaaactcccgaacatgtagattaaatttcaaaattgatactggaaatatttggagtagattgtgacggcgtgaagaagccaaaattgccggtgtaataattggagtcgctgaaattaaatgacggttctgaagcgtagacgaagataataactccccgaattgactcgttgattgattgattgcttaatcttgacataaagcttgtcgaattttgatagtcttgtatttgtgtagcccccgactctttggttagttgagaaacaactgaacatagagtcgagaactgtagcttcttgtagtcgaatagtcattgcttgagtaaagatgcatgttgaagatgtccgagtagaaatattgaagattggaacaccacttgttgtaataatataacacggcatcatatttggtgacgcatgccgagatgtcgaagctcctgtagacgtcgtggttggtgaagtaggaaagcggtagtgaagacatataattgtgaagataaaagcaccagccggcggcggcataaccagtcggcgacggaagacgatgatgtccatcagtagtggtagctgtataaaccagacgtagaggcgagggcattagtcaacagcagacgagacgaccgacgataaagacgataaagccaatcaacactagcagaatcatgcagccatgaaagtgaataaaccagtcggcagcagacgtaggcagcttgtgttgaagatgctgacgcctattagcggtgacggcgatgtagccagccgtgaagaagatagcatcagttggcgtcataacaggctagccgtgcaggcggtgacaccagtcggcggcggatgaggcggccggtcagtgaagcggccggtcggtgaagacgtagacgcccaacaacggtggcataataggccagccgtgcaggcggaaacaccagtcggcggcggacgaggcggccggtcggtgaagatgtagacgcccaacaacggcggcataataggccaaccgtgcaggcggaaacaccagtcggtggcggacgaggcggccggtcggtgaagacatagaagcccaacaacggcggcataataggccagccgtgcaggcggaaacaccagtcaacggcggacgaggcggccggtcggtgaagacttagacgcccaacaacggcggcataaagcccagccgtgcaggtagaaacaccagtcagcggcggacgaggcggccggtcggtgaagacgtagacgcccaacaacggtgttgtgaccaaccaaccgtatagacgaagacaccagtcggcggcggcgacggcaagccagtggtgatgttctgactgatccattcctggggcgtaagagataagcttaaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgatttcccctagcagatgactcattatgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttacgttattcggtccatccaacaagcccccaggtgctaggaatcggcccaaaggcaactatccattggcaaaccaaacggaaagcataggaagatggaactccataactcgataggcacttttgtattcagaatatgtcgcaagcaatcaagataaatattatgaaaattgtttaaaaaatatgatataacatctatagccccccgactcactagtcaacggcgaaccagttgatgtagtgaggcaaaggaaaaggcaaaatatcatataaagaataaaataaatgatgacttagctttgtcatattccccttgattatggcagaggtggccaatgtgggaacaaagtcgtccatcaataataatgaagacacccgtcggcggcgacgaaggcgatcgacggtgaaagtgtggacgcccatgaacggtggtgtggccgaccagccgtataggcgaggacaccagtcggcagcgacggaggcaggccggcggtgaagtcgtagaagcccaacaacagcggcataataggccagccgtgcaggcagaaacgctagtcggcggcggcgaaggccagccggtcggtgaagatgtggacgcccatgaacggtggtgtgaccaaccaaccgtataggcgaggacaccagtcggcggcgacggaggcaagccgccggtgaagtcgtagacgcccaacaacggcggcataataggccaaccgtgcaggcggaaacaccagtcggcggtggcaaaggccagccagtcagtgatgaagtacaagcgatgatacatgcaaagacaagaaattgcacatcaacctgtggttagatatttgtaaaaaaaaaataactgatataataatcaatagatccaaacacatggcttgattggcacttgatagagaggcctgcataaccataagcacaaaagcgcatgcacgattgcatgtggttcattggctcctcgttctgtccggcagctgccgtccctgtacaggacttgtataaccatcgacttgttcagcgagtagttcgacgtacaactgcatggtcaaaggactcggccgaatcgacgacaggaaatatatacagataatagattgatctgtaaaaaaataaataaatcaaagattaattttaataatctatgaattggaacagctaacccgatatctgaacaatttaataggggtgtgatctgcccggtcgacaatgacggatatggccgtcagtgggtatggtcgacaatccaatccagtcatcggtgttagatccattgatgagcgcgtgaggccgcaattggtggagatcatgacaccatgcgaacgtgcgacggccgtatagagtaacgtgacgtccaaaatgcatggatcaagacatgcagccggcgagttgcgcagcgacttgtgtcctgtactccgcttcagcctcgatatgatcatcaccgtgatagcatgatggcagtatgacatcaccacgcactcagcagtacatgcatgaaatcaaggagagaaaacaacgtagagtaacatgtgattagggatcaatctaaataaaattaaagtggaaagccaaaccaggtaatagttgcatagatcgatatatgtgatgatgccaaatattatggccacgagctagccggttgatcttgatctcaagcttctttatcgttccaccggtctgcatgcacactcatgattggttgccctggcaagcagtcggcggcttcacggcgtgcagcacgcacacacatcttgtgagcgagaatccagggaccagtgcatccatgcatgccaagatgatcatcagcgctgaacgtgcaaacgcccggcgacgttgctaattggatcgacattgatcttttttctttctgaagttgatttccatcgcactcgttgataggaaactcggcgtcacccctacctggcgcgccaactgtcgaaacaaattttcggcaatatgaaaagagggtagcatacgagacctaaaagtggatggatgcggagacaaaggatttagacaggttcaggccctttcgatgagaggtaataccctactcctgtttggggatttgaattcgccgggtgtatattgatctgacgatcagtttgtgtcatgccccctagagggcctcctgcccaccttatataggatggggggcaggattacaagatagaaaccttaaccaatacggtatcggtttcctaaatctattttacaatattattaaatcaggattttaggccgctccataatataaaaggaaacgtaaaacccaagtcatgatcggttacatattccatagatataagctatcccctatgactagtcggataaccatgccgtgttggtatggggtcattgtgttgttgataagcaggattcacaacatgaaggacctgtacattcaaagggtggaaatcttgtaccttcatatttttattgtgctcagatgtggagcttctgtagcaaggactgggatggccagccccagtgatatggccaaagtgatgacggccaacccaactgaaagtaacctgctgcaaaaacccaagtcagcagcacgtttttaggaggtgttgaggtgatgtcatatttttgaaacttaaagtagtgcgatctctaggaaatacaacacaactacaagatcctctttggccgaccaagagtcaatttctctaatttgaaatatatgccatcaagtcttacaatactgataattagtgggcagaattatccattagttagcaatatggtgcccaagtccaacaagatagttcccttgtcatatttcttctacgtgtactgaactgtggatttttcatgttcaataaagaataaactctgatgaacaatttcaatgtactgaaagtatcagacgtccatactcagtagagatttaggatatgtagtagatatcgtttatataggtgacagtaactgcattgtaccattagttagtcatattttttcgacatacactgatcttcagattctgctgttacactcaataaacactaatcactaatgaataatttcaatattatgcagcatcatagatatatatatatatatatatatacttcagttgaggcatcagacatgtaaatattgttcatgtagaagacaataacaatgttgtgcagctaccttactactctgatttcttcgggcatctccaatttaacaaaaacagaggcttgtgcaaaactagaaagatgtgaattactaaaagatgatgggcaattttcttttttggccaatggaatatgtcaaaagcatgtttatcccatagtaaaggtctgacgttggtacttatctctacatcataagggctaacattctgttactaactatagctctaaaagaatatcgcaaagagaaggatatccctaattctggcataagctaaaccattaaaaaccataaaagtctgattccttaaatttgcccaaaaaaaacaatagttgtttcagctccagacatgcaaagacgtgaaaagattgtctatagaataacatacaagattaacatcttttgagttaaaagatgatattaatgatccatgaccacattagaaatttctgtggagggcaacaatttgtaggtggaatccaagctcaaaggaaataatttcagaagagttagcaacaaaaaaaaaaagctatgttagctactatttggaaattaggttcatggaaagttcagtggttattcattagtcacaaatgactatatgtacctcagatgtcaggatcacgagagataagtggggcaaactgtttagaccaaaatatgcaccttcgttaattaagtcctcataataatggcacagaatgtcactgaattcttgaccgccttgcaaaatgtttgccacgctgtggaataatattatattttccagctcctctccaatggtctctgttggccaacaaaaaggttctgaactccttttcaagttttggatcagaagcaaagccattttccttcatttcatcataatactctaaagctctttgcatgcatccgtgtttgatcaaaccttgcacaactgacatatagtgtgaataagaaggtctgatgtcatatcttttcatttcattccagagcttcaaagcatgtccaggttcattcaattgaaaaaatctatcaataagcatgagaaatgtatcactcttaggaccacagccatcatccttcatttttttcaagaacttcagggtttcatcaatgttttcttgtctcagaaatgtatggtatgtcaaaatggttggaacaattcccttcagcatcatgtcctccaacaccatccgtgcttcatcaagcttgcgactttcgcaaagcggaactatcatactgttgtaagttttgacgtttggttggaggccttcatcgataattctagtgaatatattctgtacatccttcatgcaattctcttttgtcaggacatagataagagaattataaacagcaatactaggagtccaacccctctttttcatctcatcgtaaaccctcagggtatcaaaaaggtttccaacttttgcaaaacaactgaccatgagggtataagatgtgccatcaggagtaatgcagtaatttgacatttctctccaaattctctttgcttcagctatatcagtgattacattgcaccaaccatctagaataatattgaaaccttctgcagtaagtgggaagaatttctttctcacgagaagcaattcctcagcatcctctatgtttttatttttgcaaagagcacgaagaagggagtaaaatacagtttgatctgcttccgttttaaacttctccattgcatcaaatgtcttgattgctttgttcacttcattggcagctgcatacctgaaatagccatgtccttacagtgagatgaccgtcgaccattatgcaacaaataaaaacaactcaactaaaaaaaaacaaaaaaagaagtgctactacaatatggactgctgcaaagcaggcattatgatgtccccctcacagcaagacgacaaatggacccgtatatatttttcatccaatgcataagttcaacaagattaaaggagccaaatcccagaattaccactagttaaaacactaacaacacaggaaatggtaacttacggacttgcaacagctttatattcccaaacactaatccattcaataaatcgatccaaccatgaatatttgttgaccatcatagacaatagcacagttataacataatattcaagtggatcctggatccatagaagctgcttgtttgcaacagttttacttcctaatatgattgtgcaagctgataactgcttgttcaccaaatcaatatgatgtacaagtcccttgagggaggcgcacattcagtggcagtaccaatcagtaaggcggaccaaatcattcaaaatgcaggcatacatcaccataaacaagtagcaaacacataattctgacaagccaatcaacaacagttgaatactgcccaagcaatcaaatacttatgccatagcagtagcactatcacaaagctgtttcttatctcaacatggaaagctatatactcctctgtacagaaaaatggagacagattacgaagaggagagaacccacctctccatcacgatgaccatggcgcggctggtgagcaccccgcggcgcagcatgcggcgcacgaccgcccacgcgaggtcgaaccgccgcgccttccccgcggcccatatggtcaggtgccacgcctcggcaggcggcgggggagggggcggtggccccgcgcgctccccggcggcggcgcacccctcctccccccaccggagcgcgagggccgccgcgtccgggtcgcggcggagctcccagagcgcgcggacgaggaggtcgcggcgggaggcaggaggtaggcccggggagggcggcgaggacaggagaagcgacagcgcgtgcttcggggaggacgcggcggtggaggcgtcggagaggcggtggaggaaggcggcgagctcgccgtcgccgtcgggggcccgggggagggggtggtcgggaggctcgaagtcgctgtcgtcggagggggagggggagtgggcggcgaggaggcagaggtgccgagattgggggaggagggcgcgtaggacgtggcggcggagggcggcggcggcgagcggcggcggcgccatgcgaggtgggaggcgaggcaacggcgagtgggaaatgaggtgcggtgcggagagaggggggtgttttggggaagattttttggtcatgcgggttcaatctcgaggcgtcgtcgtctgtcgtcgattggtgtcatatcgtccgtttgatcacgagaaacatcatggaaaatgacaatccagtccaagctcttctctctttgcattgatccagtgcaatcatcgcaaacaacaactgtggcggcagctcgagctgaaatcaagcacaacgttaattcctttcatattattatgtttttcttatcttatgtttttccaatccgcaaataagcctttatatttttagaaaaaaaaattcaaaggtataggggttgttttgttctcccaaacttgctaaaggttgtcaccccttatgtctaacaagttcaattaataagttagtctattgattcatagtcacgcttgtgataaaattccatttaatttttctggtttcatatgtcaccaactcaaaataatatgttacaatttagataagcaattcaaaaaaagtatgataaatgttggtatccaagcaacctattagtatagcaacctacttgtcgacgggtgatacccgtagaccggatatagagggtattggggtacgttggtacaaggatctacgtagtacaacatcaagcaaacaaaagacaagaattatactggttcaggccctttgataggtaataaccctaatccagttgatgtgggattatatggtagaaaatacaggttacaaagggaacaagggaacttgtcggatccggcgagattgtagtcgagttgtttcgactagctcccgatgacttggctcctcgtaggctccggcttcgtaggctgtgttggttgtgttggccctgagattcaatgccctaaaccttccccggggggtcccttttatattacagatctggaggtctccacgtagaactcggaggtatcagaccctatacgatacgccaacgacccagttctgcccgagtatgattcttctcgtctgtagattccgtgaaaggtttctttataatatacaggaaatatccgcatgcgcgtgggtatgccatatcgatatgtaacgtatatcgaagggtaaagggtatgcgtaacccgtaaccctgacagtagcccccaacttctgcttaaaataaactcgtgcaaccatttgcaacttcgggtgtcgagattgttgttattcccggtgcgaggaccgcggagatagaccgtagtcgagcacgccatttgaagcccaacggtcacgagcgaattttaaactaaagtccagaaaaccgccgcgcgtaacggacccagaaatttccgacgggcatctctctctgttccctggaattcgcaccgtcgatagtgcgcctatttaaaggaattttgggagtccattttgaagtccgccaaacctgttaaacacacaccacctccaagcactctttgccttctccgccgccgcaagaaaccctagttcatcaacctaggctcgtttttcggcgaccttcgatcagcaatggacctcggcaaatcggcttccaccagtgcaacgttgaagaaactccaggaggatggcgctcttcctggtcgtggaaccatggagagggaagcaggaggtactaatcctcagcccatcttgggtcgcatgattgcgatcgaagattatgttctctccggttttctccctccaccttccgaatttcttctcctggttttgaatttctatggtcttaggttgacatgtggagtgcgcatgtcaacggtgcagccttcctatcttttccaggctagcgcttacacatgttttatagttgcaaaacctaattataataatccgcaaatctccatataacaacattaaactttggatcaccatgtcttggtcatacaaaatctgaatcgacccgttcaagtctcctaatatttgttataacctaaagaaccttgtgcctttctttttatgtattgttattgcttctttataggcttgtagctttgcttgtgtgcttcgcgtagcttctgtcgttctggaggttcccgaagcgtggtttgcggtcgtcgccgaaggttcggaaggccgttctctctgagcaaggcaagtcacatcatccttgatcatattgaatcccagtttataaaattattttgatttaaattaatgcattatcgctttatttaaattcccgcgttatcactgttttatttagccatgcctatttatctttgttatgaccttatcgttgttgttattgttattattaccttgttcaccctaggaaaataaaaccccaactagtgggtactctattcatggttccactagtaggaatttaggtagatgcttcgccgattaattaggcaacattaggtggttttataactttagactttgggaattctcatatcatttagacactatggaatggttggcttatgttggaattggacacacacctccccctctattcaaaacccccaaaatggttttaggctgggctcgaggtgcatggttgggttttgttagtcgtacctcgggtactataaggattaagctcgggcctctgttgcaaagcactaccgtacttccacatgtctagtgggtaaggcttagtttgtggctcagtctggttataaacaaaggtacacggatggagatggacgaagtcgggggtcgatggacatctctaggacaaatgaaggctacacgagctgcggcccggtagtcgagatgtcatggcacagggttggtgtccttctgctaggggctcaatcctgtctgcctgtcccggaggttccggccgtaggtggggttgggtcggtactcttgtttatggctaggatgggttgggaactatgtcacatcttccgtccgtatgccgtggtggtatgtggcacgtggttacacgtgaggaagatgtgtcttgtgggtaaagatgtacaccactgatcagagtataacctattcgaatagctgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggatcgtgtttaccaaatcgctttgggaaactaagtgacttttaaatgctgtttactgcaaaacttaacccctatattataactcccttgtactcccttgcatttattctgcacttgtgggtgtgtcttgttgagtacggtggttgtactcagtctcgctcaatttttcccaaacccagaagaggagttcctggaagatgaaggctttggtgtctagctcgtgcctgccgtcaagcgcctgtggttgtcgcgctagtcttccgctgtttttcgtttgtcttcttgtgtgctgggccttcaccgcccatgtaataaattatctatttacgcttccgcttgttaaactctgaattgtatcaacttttggtgtaccttgcctcctgggacaaggaataatacacgcacgtaaggaacgcccattgggttatttccggtcgtgacacgatctctaacaccggatttgaaggcgcgaattacaaaagcgtcggtgatttcaggaattgtgtttctgccctcgttgaaacgtcgaacatattccctcaatgattcacccgagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacgcggttggtaaatagttcgctaacgcgttgtcatctgctccggcaacatagagtactgtggagtagacttgaaggaactcctctgggtcggtgctcccatcatacttttctattgctccgggtcggaatctctcaggccatcggacatcacgtagggaacgaccgaaagctctacacccagcgttgggggcggtgggttgtcggcggtcgtgtgtgcttcgtggatgtctgtctgacgatgaggaggacgcggatgatgacgatgacgatgggtcgcttggttccagcgtacgattacgaggatgacggcctggatctcgggaatcctgtcgtcgtcttccgctgttgtctcggcgccgatctccatcgtcgtcatcgatacggcggcggccatgaccagtattgtctggcacccgtcgttcgcgatcgttgtgatcgtggtggttgtcgtggtcccggtcctcgtttgagtggtctcctcgatttccgttatcatggcgccgtgaagagacatgacgccgagagcgattcacgttgtctcatgtgcgtcgtgcttctcggtggccgttgatttaatctcgaagatcgccagtgccgcgaggtggaggggtagctcgttgaggtgattccctccgttccggatcttcaccattggcctcgctagttggtggctgctcctggtgtgctgcggtagcggcttcttcaaacgcgttgctgaggttagtcaccgattcccgtagttgttctgtccaacgctcgaggtcaacattcagaacgggatcgtaaggagtttccctcagtatcgcttgaacggccctgatgtgctgggctggagtagtcgattgattccccacttctgtgttggtgtgcgctgacgtgccaacgtcatcgatagccaatacctcccgcggcgcgctcgttgtcgatgacccatagtcctcaaggagatgtaagaccgatggtttgtgaggatcgatatcgattaccccaacgaatcgatttgaagttggagtcactctttgttacttgctgttatccctgatggggacatatgacttaggagatagagctttcatggcgccgagaaagactttgcagctcgagaggtcgtgattctttgtcttgtgaataggacaatagacatcccgagttggagaagtacgctgaattccacgttctttgcaggcgcgaatttcagcacagacgttgaggaaaacccagcaatcttgcagagtgtgtttcttggttttgtggataggacaccaagaccttgtggcttcggaagtcatctttgtcggctcgtggttcatgtcggaaggacaaagtttggccgtatcagaatccttctcgagcttggatgtcgtcgatattccgttctccgtctcgatgggaggatatttcgacatggaatcgccttggttcgtagccactgcgttctcgtctccggtcattggaggaccggttgagatcggcgtcgtggtgtaaaccgggaagacgatttcaccgacttgagtccataccagcattgttgaagtagtgagtacttggctgaggctggtgctgacgttgttgtcgacgaagctggatgacatagtagtagaaccttgagtaccaaggccccctacctggcgtaccactgtcgacgggtgatacccgtagaccggatatagagggtattggggtacgttggtacaaggatctacgtagtacgacatcaagcaaacaaaagacaagaattatactggttcaggccccttgacaggtaataaccctaatccagttgatgtgggattatatggtagaaaacacaggttacaaagggaacaagggaacttgtcggatccggcgagattgtagtcgagttgtttcgactagctcccgatgatttggctccttgtaggttccggcttcgtaggctgtgtaggttgtgttggccctgagattcaatgccctaaaccttccccgggggtcccttttatatcgcagatctagaggtcttcacgtagaactcgcatgtatcagaccctatacgatacgccaacgacccagttctgtccgagtaggactcttctcgtctttagactccgtgaaaggtttccttagaatatacaggaaatatccgcatgcgcgtgggtatgccatatcgatatgtaacgtatatcgaagggtaaagggtatgcctaacccgtaaccctgacactactatattctgagacgaaaggagtattaatttctagttttagcatcagctctaggctctagaataatcttgaattcatctatttatcaaaaaacagaaacatgtaatgcatttgctttacttttcttacatattatataaccaaataacacttttaaatatttcacactttcactggaaaaaaaacatttatgtcctatttcgcagaggaaaagtttcattttttgcacacagttgtcatttcatcgcttctccctatgactaatttgcctacaatcaaatttcctttgcgaattaactccaaactaaaaggggtacctataaaacattcgacagaatggaaaactttcaattgtaaatactatataattacattgtaactatattttataactatattgtaactgctatgtaactgcaatataagtaatatgtaactcatatataactctgaaaaattggatggatcaattggttagttgaatgagcatgcaagctacaggtctcgggttcgatccttgctgtgcagcacaaatctcaaagcatatcgtatggttaaaaattttacagttttcacccttttccatttttctctccacagcacaaatctcaaagcatatcgtatggttaaaaatttgacagttttcacccctaaaaactgttgacagtataatagcaaatccgaactaaaaaaaaataacaaaaataaaccttaataaaataagataaatccgatctcaactctaatcggatgtaaaaaaaaaatcataaaatagacgaaagcagcaactacgcacgtgcagccgtggaggcgtggactcactcgcaatcgcacaaaaacgaactacggcggcggcggcgatgggaggcgagaccaccggtgttagcggcggcggattccgcaggcggttggagtactacctgtacagcggcgagaagaagcacgtcgtcgccggcatcgccatcttcgccgccatcttcggcgttccctggtacttcatgagccgaggtacccctgatcatcactgccctcggcctgctctttatcattccgattttcttcgaatcaggcggtggagtcgttagattcacctaggccggagtcctgttccgcgttcaaatttgatccgcagccgtttaggggagctagggttcttggtaatctcagccttagcacagttcgtcgtgttgcttccccctttctggttgctggattggggcttcgaggtagtactagtagtaaggttgttaaggcgaaggttccattttgctcttgtagtgttaatggtatttggtaggacggagcagtgtgcaaaatagttcaatatgaggatttttggtttgagtattctctgtttctttttcatgatttgagaccattttttaggggaattgcgtgaaatgtatttggatcgtatgaactgctatggatttaaggttctatgtttcgtgcaaaacttgagacatttgaccggatagaaaatgcaagcattttatgtggaacgtattaacttcacaaaaatcataatagtagtagactattacaggccttcgttactacatcgtgttcagatcttctttaccattgtggttgcaatgttctaagattgccatggtcagtaagaagtataagatgagataacaaaagttggaagtaaatcgaacatgaaaagttgctattagtggataatgaattataagagacgtatgctcccctgttgattgatacacataacactatatgatgctctgaattttgtaaatttcttttgcttgacagcttcatttgacagctttagaatgaaagaagcatatgcatgtgcactgggtgaggagaattatagcttaaggcttcttgcaaccctgaattagcaacattttgcagtttagcatttgttgtgtcattaccttgatattcttatgaaccaaacagagcacacattaattccaaaccatgtagtattggatttcaatttgttatacactttctatatccttctattgaaattgataccccaacttaatatatggttacaggtgttctactcaaagtctcaaaccattcagcatttagttatggcttctgttaacttataggacacaatgtatagctttatcagtaagctata

SEQ ID NO: 28460 - DNA, 702 bp, Oryza sativa
ttttggtttaggtggggtctatgtggggtgtgttttagttaggtggagtatgattaagtcttttatgtgttgtaatctgattgggttatgtgttatattgctgattttaaatggttgttaaatttatatatgtggtctgttttgggtttgtgagtacttgatggaaagcttttgaagtcttctttttaatggattcagctttattttggaaatctattttgtttggctgcaatcataaaagcaaggtgttgtgtctcctgtattgggtcaatgggtttgtaattttgtttgggaccttggtccatgtggggcccatgtggggtgtgccccaatctggtggagcatgacccttggacccttttggtcatcctcccacctctataaatagttaggtaccccttcagggtttcttgggtttttgatagattaaagtttagccattgctacttgcttgcagcgcgcgtgtcggctagaccatccgtctgcttgttctttggaaccccaacttatcatttgtattaaattcctatttgcaatatcagattgcttttatcttgttcttgcttgtttcttcgatttgcttgcaggaatagggtttatctgcaccggcaagatcagcaacccacggagaggtgtatcgatcgctaaggcgcaacacaacgtctcgtacggttgtagtcggatcgtcaacgtttctcccaa

SEQ ID NO: 28461 - DNA, 511 bp, Oryza sativa
cccacgtaaccaagtgactgttaggggcaccccctgtgctgagagggaaagaacatcataggaggaggaggaggaggaaatgaggcatacggaccaggaggagggggtagacaccggtgccacctatggcgatgatgacagggcaagctaaaggtagtgggcagcgatggtgatgatggaggggatcttgatggtaatggaggaggaggctatccggtggccaccatatttgcttggggggacagtggtggagcatgtggagctccgtgcataggaagctgaggagattgctggcgccactgggtcatcacctagccttaccttcattgttgcatctctacctccatcgagagccaccactacttctagctacactgagcattgttgtcgctggcttgaactcctcatccttctccatcgagttgcatccccagacaaaatgcaagtaaacatggaccaaaagtgatattggtgagacggataggtgaccggccttccattcaccatgtgt

SEQ ID NO: 28462 - DNA, 569 bp, Oryza sativa
agccatacgactgtaggaaaagacgaaaaggcgccccaccccttttctaatttggccaaggagaaattcccatttagtaatactttcaaaaataaaaacgctatgtttacaaaactcggtacgattttcatcttactcttaactattttctttacaaaacaagttttactctcaactgactttgggtttttcttaaaattagatggcagatccggattcacccgctacctgggagttgagcttacctcaatcagaggggtatgtcattgagctgcatcggatgttgaggcgtctgcgatactctgggttcccgtcataccgagtgagacagtgtggctcagtttgggaggctcgggtcgaggttcacccctgagtcccttccgagttggactacagctttcagacacgtcaccaccgagacctgccagagaccgcgatgcaggatgcagcccgggaggccttcctccgactcagctctatccaccgagctgagttagcgagtaccgagtttgctcatcacccgttccgggaggagagcaactcagtttgcacagttcaggacacgccct

SEQ ID NO: 28463 - DNA, 654 bp, Oryza sativa
cgggaaggccgcgcttgtcgccctctgaccccgaggtcgtcggcacagaagccgagtgcgccccgcgcggcctctcggacgaagagcaccctgtatcgactcgacccgggagagagcagggaggagaggccccgagccgaacggcggcccaaggcccccgacgaccggagctggccctctgcccgcttgttcgacggtgccaggagcccccgacccccaggatggccccggggccactgcgggaaggccgcgcctgtcgccctccgaccccgaggtcgtcgacacagaagccgagtgcgcctcgcgcggcctctcggacgaaaagcaccctggagatgcggctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttccaggcgcatcgggtcacagtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgt

SEQ ID NO: 28464 - DNA, 960 bp, Oryza sativa
tttcaactactcaactaccaggagaatcagcatattctcactagggcactacaaacagaggatcagatccaggaaggacatgatcagagcttcagactatgttaggaatattactcagaacaaatcaagggagaaagaagaataaatcaagaaaccttgtgaggaacaaagaacagatccatgccctcctgcttctccttgccgccgcaatagcacgaggtcacgagcgcaagaaaccctaacactggaagaggaggctaggggagatgggaagggaatgaactcaccggggagaaggtggccaccggaggagagagcgtgccgttgccgtcacgtcgtagtcgcgccgcgccgtgcagccgtccccgccgcagcgccccctctcattgcgtcgctgcgtcgagaggattttttcctcgccaccagagaagctgaatatttcccggccgatgacgaggggaaaacactggggtgggccgggataaaatctcgcctggacttaaccgaacgcctatacttgcatgggctggtatcctttccacgccgggattttccacggggattagaccccgatcccagccgggaacggcccaaccgaacaagccctaacggggaaacttaggctggctggccacagcatggacctcactcatctacagtaaaaatggtcggagacaaaaggaaatcaaccgaagctggccaatacaaacaatctattctcagggatgcatgcatggttgtgaagataactgagaatagaaggcaaaatatagaatctaacaactagcttgagttcatacggtgtgcttgaggtgaagtaaatacatgtttaaatgtcacaaataatttaagaagaatattaatggaaagaaacggcaacgtaatggagagaatacaaatcacggatagactttacaattgctcttacatgcatgaaggatatttaaagttgaatgtgcc

SEQ ID NO: 28465 - DNA, 433 bp, Oryza sativa
gaagcattgtgagcgcataggatatctatacatggtgccactagcatcactccttttgagctggtttatggtcaagaagccgtttaaccggttgaggtaaatcttggttctcttagatatatcaagcaagatgatttgtcaagtgaagattacaagacattgatgggagacatccttgatgaagtcatcgacaaacgcttgaaggctttggaagagatagagaaagagaagaagagggtggccaaggcgtaccacaaaagggtgaaagtgaagttgtttcaagttggagacttggtttggaagacagttttgccttgggtactcgatccagggagttcggtaagtggtctcctagttgggaaggtccttatcgattatgcggcattgttcgagggaacgtgtattttttggagacacttcaaggggagcgttt

SEQ ID NO: 28466 - DNA, 401 bp, Oryza sativa
tccccatcgctcccgcgccgtgcacccactcgccgccgcctttcccgccgctccggccgccgctagtcgccgctaggctcgccgccgcaccgcgccgttgccgccgtcgggttcgcaaggatgaactccaccccgtccgcctttcctccgtcaggattcgtcgccggaattcgcatcccctcgcgctacggtgagttctacctctaccgccgccttcggccatggatgccggccgccgtggttcatcttcctctctctaatctctctctcctccttccttagggcaccccgaagcccgtccgctggttgtcgtcgtcctcccgtggcttgccgtcgccgttcgccatcgtcttcctccgcgccggccaccttcggtgaggcgtcctctcccctctactccc

SEQ ID NO: 28467 - DNA, 311 bp, Oryza sativa
cgggtctcccgcgcccatttccccctcctccggccgccctctctcactcccaaccctatataaaccctccccgagctccccaccatcgtttccgccactcaccgccctctctcccgccggaatcgagctcgcgccgtcgctctctctctccgccgtcgctgccgagctccggtccgccgccgtcgtcgccccggaccacctcccacctcggcgccgcctccttcggcttcgccacatcctcgccgacctcgtccacctctccgtttcgatcgctgaccgccggagcacagtcgaccccgtccacccgagcc

SEQ ID NO: 28468 - DNA, 543 bp, Oryza sativa
tgaggaaatgcttcacatgcataacttggcgcatgatcttgctagatcagttgctggtgaagatatccttgttattttagatgctgagaatgagcgcaatgccagatattgtgattaccgttatgcacaggtgtctgcttctagtttagagtcaatcgatcgcaaggcatggccttccaaggcaaggtcactaattttcaagaatagtggtgcagactttgagcatgtcagtgaagttctttcagtgaacaaatacttgcgtgttttggatctcagtggatgctgtgttcaagatattccatctcctatctttcagctgaaacaactgagatacctcgacgtttcatctttatctattacagcactccctctgcaaattagtagctttcataagttacaaatgttggatctttcagaaactgaacttacagagttgccaccctttataagcaacttaaaagggctgaattatttgaatctccaaggttgccagaaacttcaacgattgaatagccttcatttgttgcatgatctacattacct

SEQ ID NO: 28469 - DNA, 649 bp, Oryza sativa
atggatggatcagcaggcagggaggccaggccgagcaggcccaagacaagacgacggcccacggcattggcaccatgcgcgggcaagcgcgggagatcgcgcgaggcacgcgcgcgcagtggacacgcggcggcaaggaattcggcgcgtgcgggcgtggggtccacgctgtttcaagtggctcggaggcgggagttgtactgggacccacgcgcgatttcgcgagcatgcgcgggagcagctcggcgggacgcgtggaggctttggactggatgcgcgcaggtgagcgtgggatccacgcggtggagcgcgcgctctcgcatgctgaggcgtgacgtggcggctcgtcactggtttggagagggagcacgcggatcagtgcggcgtggagagtttggatcaacgacgtggcaagcatccaggaggcttccttcggttctaaggaagaatgggtggaccagatccattctgagttagggtttcgccctaggggtatttgagacaatgtcttatgggtcttagcctataaatagagagatggatgcaagggtggaggttgcttctttggaatccttttgagatgctcggtgagagagtttcagtttgagtttggagtgtgtttgcccgagaggctttcggggctgcagga

SEQ ID NO: 28470 - DNA, 722 bp, Oryza sativa
tcctgcagcccaggaagtctgagaggatggtggttcagatacagagtgaatgagccaaacatgtacaagatgatggctttttgcaggagcaacaaatgttgatctctgaaccattgtatattgctgatgtaaccatttggtctgggagtcctggtgtggcagctcacatttatttttatagctcaagtgaatcatgacatagtttcatctttttctttttttattgtcaaatttcactactatgactgtatttagttgtctctgtattgtcaagtgacctcaagctttgttgggtgatgcctccttgccttaaaccggatacaggccttgatgatactgcaatatttttgttttaatgattaatcaatgtgattttcgcgtaattgatgaggttactgcaatatttttttactgaagtgaatttcatcatgttgcacttttcacttatacaaaaatatcggtttgcaatatttttttgctattctaagctgccaacctgaaaatcaattttgctattctaaactcaatggacagcgtgcaacgttgaagcaggaaagcaccagtactccttctgttgttgctgttgcctattgctgccttgacacgggatttaagcaggcgcacaaagccaaaaccgaacaaacgttttgaagacagggattaggaaaatcaagggaattcatcccacagggattaagtgacatgggagggatccactcaat

SEQ ID NO: 28471 - DNA, 1418 bp, Oryza sativa
cagccagagagatctaagaatcgaagtgcatggagactgcataagtagtcagcatcctcactgactccggggcagtatgataagttgagatattctagtctcttgagatccccaagtgttctgggcaagttccgaagtttctcacatctctgaaggttcaaatatgttagcttctgataagatccaatgaatgatggcagctcctcaaggtgtgattctgagaaatccaaagcctcaaggttttgtaagctactcatctggtttggtaatttacgaattcttaagccaaaaccagcaagatacctgagaagcttcaaatagccaatggatgctggcaattctagatcataacaacaggtaagatccaagatccgcagatgattcaatcttaagaatgcatctgcaagaagacagtttttgaatgatattgccctggccccggtgagaacatctttctgaagggttgagtgtcctgtgtgatttatcagcacagcgtaagtggaagagaccttttcagctgaagggccccttgatagctctctaccatcagaaattacaatgtcactaccagcaacatattttgcaaaagcatgcaccaagctattcacctggagtaatgtacgacgattggtaggactgattccagtggcctaaaaaacaaacatatcaatctcacaatttgctccaaaacaacatggttcaatttggactaaatgttgaaatgcttagcagtaagcactgacagagacaggcttctgcacaggaagctgcgtgtttgaatatcttccgcatttagctagcacatcaaaggtaattagtttaaacacccaaaaaaaatgtttctttctatgaaaaaaattagcaatatttgtttctcagcacattgagacaagtactaccaatttgcaatcacattaaaatatagtaacaaaatcatgatctgctatcatgtttaccatgtgaactgctatagtcatcaatcatcattagcaaactacagaagtatatataaaaacattcacatcattcatagtaaagactattactaaatgagcagagttagatagagtgatttactcgtagctacatgtttcagttacagaaggcccatagatgatgctgtaacgtcttatttttaaaggaaattagcacataatttacatgcagtgccttactttctgaccacacaccatgagcaaacataaaatgggaaaaacataaatgacaggataactaggataccatactgcatcagcaacatcgcaaagtttaactatgttaatgcttactaaatgtcaatttattggaaatataaatctccccttttttgtacagaataggtaatgtatttcacgaggggtctctgcctctgtaaatttactccaatgtaattagtattctgcctgacagaaggggtt

SEQ ID NO: 28472 - DNA, 733 bp, Oryza sativa
atgcatatgttgtaggccccggccaaccctgcacgcccgagggggtgcggggttggcccgagcccaaaacctgacacccgaccccccttcaggggtagaaccgacaaaggtgttcgatgtccacgggttaggcagctcattgccgtcgcccgtggccagccgtatggagcccggccggggacgccgaccactcgatacggaccctcccacattggtgaaaacttgctcaatccaacacgcgtttggacgcggcgtatgacgaggtcgtcgacgcagagtgatcgggcccggacgtggcgctgatggtagcgccgcatgctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcatttccccggttgctcggcttggtgtagttcggtttgcccagagcaccgctggcaactcctcgatccatgaatcgccatacttcttgactatgttgaaggtcttggttttaaggcctttgaagatttccgcattggcgcgctccacttggccattgcttctggggtgggcaggtgaagcgaaacagaactttgatgcccatgtcttctcaatagtcgcccaaaagttcactagtgaat

SEQ ID NO: 28473 - DNA, 427 bp, Oryza sativa
tttaattcggattcgtttttcccaacctttccatcccggcgccggtcgccgggggccttcggcggcggctcttggccctttaaaagcacccccggtgtctccgctacccgccgcctctctcgccttcgcccgccgtcgtgtgtagcgccctagcctcgtgagcttttgcgccgccgtcgccgccgttcgttctgccgtgcgccgccgtcgctacggtcgtcgtcgtcactcgggaaggccaccgtcgggatcgccaagtcgccgccgtccccgtccactgtttcgcccccgccgaagaccgccggagcaccgtcgccgccgtcgacccgatctccgccgccgctttttcctcgtcgccggcgccgtccgttgcttttccgccgccgttttggtcaccggtgagttcgccgcgttgcgctctacccgt

SEQ ID NO: 28474 - DNA, 1088 bp, Oryza sativa
cgcccactccgccctcattgccgtcctgagcgccggtggctgtgagcgccctattcgccgccgcccactccgccctcaccaccgtcctgagcgccgtggctgcgggagccctttcgccgcctcccacttcgccctcaccgccgtcccaagcgctggtggctgtgggccccttcttcgccgccgcccactccgcctgccatcgtcccgagttctactgcccccttcatcgccccgagctctgctcgttgtcatcctcgaggtaagggagggagaagagagaggattttggagagaaatagagaggtgagggtaaaagagtgtgagagactgacatgtggggcccactgatttaaaatgaaaagaattgttaactggactgtcacgtagaccaaaaccgcttgcaaagctgctcgagggctttttcatccggtatcgatagttgagagtgaaaaatgactagttttcaggtttagggtgtaattcatactcattcaatactccatgggggtaattcgtacttttttttcttttactgttaacttaattaactaattaaaagacatagtaatcctctctagccaatttattctagactgttgtccttggattgaatgctgattatagatcgttcctcgtgttcgatacccttagaatactctaaggggaagtgctataacggtgtggttaagtacttatctgtgatcttaagactaccaacaatacctaccctcattaactaactatatttatttctcaggccaatccaagtatgtacggattcactatgtggtccaacaatgccagtccgaattatcatggccaaaaaataactaaggctaaaacacacaaatagagtacatgcgaatgaagcagcaggaaatttcaatacgcgctgaagaacatagaaggggctggtaggcaagatcaggctcgagttgtcgtacagatatactcgtatcgttcatctatgagacattttagctctattatcatatccttctaatggtttctgctactgtatgggtcatgaatagaaaactaatgtatctattcattttccctcaattacctaatataatgatgtgatg

SEQ ID NO: 28475 - DNA, 395 bp, Oryza sativa
tctggaaggcgcccgcgccgagagggccgcactggatcagcgggccactgagctcgaggcgcgggtgaaagagctggacgcgagggcgcgcagcggcggggcggccgcgggcgacggcgacctagccgcccgcctcgcagctgccgaacacaccatcgccgatctgcagggcgtgttggactcgtccgccggggaggtcgaggccctccgcttggcaggcgaggtagggcccggcatgcttcgggacgccgtctcccgtctagaccgcgccgggcggcaggcgggcctctggggcgggcggactgcgaagtatgccgccaaccaggggggcctcgcccagcgcctctcagagatggccgggaccctccagcggctccccgaggagctcgaggaga

SEQ ID NO: 28476 - DNA, 3341 bp, Oryza sativa
  unsure (1)..(3341): unsure at all n locations
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagcaaggaaaaacagaacaagctaggaaagatttgggtgagaattcttatctatattatgtccacctcttcccttcttttggtgttccttgttggttgtagttacttatgtatttatatcgcatgcgacctatgagcgttcattaaatctggttcagtatacctatagaaacagacactgtaacaaaggaaaatagcttaacatgctagcatgatgtacaaaatttagtatcagtaacaatggataaatcagggccctttaacccagttgatatctttaatcagatataaacatcagtgggtttagatttgacatcttactggacattggatagtactgattcagtaccgatactagcattatactaaaaaaacaagttatatgtggacaaatcctacaattcttgcatatttttcagccgacttcactgatcttatggatgaagtttttgcgtcttgtttaatgatttttaaccaaaaatcttcttgtattctttctgaacttcgacctgaaaatttactaatgcaatcctcttagatgtctcacaatggtgcaaatgttttccttttactcttcaagataattgtctttctagaacaaagaagattctattttatatgtgagacgcacatctaccatttaatgtcagattcagtcagaactgtccatttgacattattatatatctttgtagaattggcattgtatattttttttgggtgcgttcaatattgaagaattacctgtgaattgccaacagccatgaccctttataattttgcaaatgcagaacgtcttgctttaataagacaacaaagagctgatgctgcaaagaaacgtgaagaggagaaagctggtacatctcccttgctatttgtatattgcttcatggttttggttttcttgtgtcattcagaattggttgcagacatatcatatatgaaaacatattgtttgatcatagcatcatggagtgtatattcaattgcttgtgaaattttgatgcctttgtttactagttttgataacattatgggtgcattttgcaggtaactaagtgtttagcactgagatgaagtgatgctcattttacacattcagttagtaacatgttttcttagattgcaatatgtatactgatgttaattttattcttggcagccaaagaacagaggaaggctgaagcacgcaaataactgcggcaaccatgtggacaatgaaggcgtgagctgcgtcggctggatatttatttcttatatatatgcccctagtatcttttaaactcggtctcgatttcgatatttccataaaattatgcattgactaactgtagtattgtcgacgtggcttgatgtaaacttgagcttggcagggtgcatatgtagtatgatcagtttatgcaaaatttgcgtttacttacgttgatatataaatcaagaacgttgtgaatactggagataatccatggtcatgctgcttaacattaagataacctagctatcttctttaggagaaaaataagactaatcatcattgagaacctgaaatttctcaattatgcccaacatcaagaagtcagctagtgtccatacattttgggctttgatctttgacaaggcaagacctgtaggtcgtagattcatactgagggggttgatcgtaggctcgttgcagtcactccatgctttcattcaaagatcgtaggctcgtagcagtcacttcaagctttcactcaaaattgcctatgcgcaagctgaagtagtgacatcctgtgattgctgattttgaatgatatgtagcgtcgtgcacttctggagttcttcatgggaattaatgagatattaaatttaaacccaatgactgattgatggacatgagaaagcaagcaaaaaaggaaaggaaaggaaaaaaaaggtaaggactcctttgaaacacaaatgcaaacagaaacataaggataggaaaatcgtagtatttaagtgccatgtcaccttaaatttatagatggaaaaacacatgaaaacaatagaaatgatcgttttgatagagtgcgggaaaaacacgggaatcagaaggaaaatgatcgtttggatggagcacagtaaaaacacatgaatgaagaaaaatggatgcaaatgaattttttaaagaggtagaacctcatgttaggaagtctccaatatttcagaatcctctaaaattttctatgtttggaggcaatcctgatgaatttggtgaggccatttctatatttcaaatgaattcttttcataggaatccaaccctccaaaattcctttgctcgaaaggagccttacataaaatttggttgcgattaattgagaaaagtaagtagataggagtatattttatgacaatttgaactccataaatagctactccctctgtttcaaaataaaatacaagcatttcacatttgatgacgcttaccttagttctaagagaatacatacttatcacatcaatcttcttttttttcttcaatttccctccacctccaccaagtattttctcctcaaccttattccaccgtctcttatttaatatgcgacacaaaagtcgtttctcctcaaccttattcactgctataacaacttggaaatacttatattaatattatgtaatagtaagaatattttaaaaaggggaagggagtatgttgtgtattaaaaaaataaatttcacaaagtcatatatattttaaccaaactattacaaaattacatatttaaatcagtgtatcacaaaactatagaattaacaatacagttattacgaaattatagatttaagacaaagtattgtaaaattgcatatacaaacttatctaaagcttgaatctaactttagtgccaagggtttaaattttaaaatatatagttttgtgataacaatcaataatattgtatgttttgtgataacaatcaatattgcaccagtagtttcatgatatttggtattaaatctaaatctatagttttgtgaaaaaatggtgctaaatactccctccgtcccataata

SEQ ID NO: 28477 - DNA, 19660 bp, Oryza sativa
aagttgtgcttaaagtattttggataataaaacaagtaaaaaaaactaaataataattctaaattttttttgaataagacgagtgatcaaagagtgcaaacaaaaacgcaaaatcccttatattatgggacggagggagtatacagttttgcaatataatgtcttacatcataggtagatcaaactatatgtagttttgtaaaatttagctaaaaaaactaggaaactctacaaactcatgtcaacctgtcaacgattttatatctcagaaaaatatacgacgtaccaacgagcggtttcatgatttcatcagaaagcgaaatgttcgaatatacggcattacgtgtaaaacaatgctcatgacgaccttctgtacttctgtcttagttcatgcatcatagcgtttcaaatgatttcctttcatctctcagtaacacatgcccatacaaatgtgaacaaaaacaaccagcatcaaaagagactatagctgtcattttttcagcactcaactagaaaagaatactatgaccttcaagggcaatatctatggtcgttccaacaattactgtaaaaaggctatcaaaaggtataatcgccttccagaggtaatccatgttaccagcccacccaccctgttctgtatttctgttatagcagtagctccaatcacgggcttattcgttcttagcatgccgtgaatcattatcatcccacggctgaataaaattttcatgctgggtcatggtgaggaacgctggcagcacttgaaaaagctatccgccaacctatacataaataggatgcatctgcgccttttggattattatagactaatgtagcagcactcacaaaacttcgtttagtgtcactgaagcttcaatccattggtttgtttttcatcatcttacgtttcgtggcatccagatatttcttccgaagccgaatgaccttgggagtaacctgatgaagctcaaatgtcaatatgaaactccaggagcaaactggaataggagttggaacagttaagcttaaatcaagcaagaagattattttcttttggtaaaagattgggagtaatattccacaaaataagattattttcttaggataatctgcacttctaataaacaaaaaaaagctagcagcatgtagagtaacttaaatttggatttgaatgtggactaacatgcatatattgtagcatgcattttgttttgtaggctgcattcctacattccaacccatgcacagagaacacatctctaatttagatttctgataatcctttacaaatgctagtagcaaactatatagcagaaactgcaggtggatgcttattgattgctttctttgtttggttcttaatattgtttgtaacatgccattgtattatatggtagaaataacaatgcacccattcattagcctgcagaatctccgtctggcagaggatttttttctgaaatgtaagtggttttatacattggcaatagtcgtcaacaagtcatttcaaaatccaaaaaaaaaaccaggattttttttttatttctagagctaaaagtaacaagccaaaaaagaatcggaataagaatcgggaaaaatggaaagctcatctctatgcgctgcttgtgccacttagtcctcacacaagtacaagtagaatcatcaatagcaaatacagaaaacttgcctcaataagctcatctgcagcaacatatccaattgcctcttccaaactcatctgcatgattcagtgcctttagttaagattatgtaacaatcatttccgaggaagctaaaggaaggaagcaaatgacatttttcagcaaagaatgcacataatctagatttatggtctcctcagttcccaaaacccaagggagagtgtgacgcgaatattataaagcttgcaaggcttccgttggtattaagttgttaactagtgtttaaagcagcaccatttagtctgtagggtgataaagtgatatctcctgaatgctgatgtcttggtaaaagttaaaacacaacataccaatcgtggtggagaaagcctgacattttcatcctttcctggagctcgaatgtttgtaagttctttagttctcacaggattgatctgaacaacagaagagttatttagtttgtgtattagaagagaaacctaattcattgataagcatataatcaacttacatcaagatcactgtcacgtgagtgctctccaacaatcatgccttcgtacgccttaaagaaaggagaaagaaagaggaataaggaaaccccctactcttagatggtagatcatagtaacaaaatgaataaatgtcgatacctccatcccaggagaaacaaacagaataccacgagcttctaaactcataagtgcatgtgaagtgataagtcccttgccgacagatacctacatatacacataagagcacttacatttgtcatgttgagttgagcagaataaggtgcagttcatcaaatcctgcttacatttaatgacatattccttcttttatttcatttgcttaattcttggtttaaaaattcattgctgtctattattgcaaaataatgtaaaacttgtttggtatgaagacagataagagtaaacagaagaaattatgaaactgaaggaattggcattaccagaactccttttctaacattgcccagctgacctctgtatttagcatatgctgcaatcatagagaaaccaaggtcaaatactctcaataaaatctagttggtggcatcaatggcgtggtttacttcaaaaaaatgcataggcgagttaaggaaatcatctaggacttaataagaaatagcataccctggaaagcgcgatgcataaacccagttccacgtgtaaagctgctgaatattcctttgaatcccaccaaacccctgcatacataatgcatcatttcgtatcataaaaaattgagaaccagactgaaatacatggcaaaagacaatcgagtccaaaattggcatcaactataatatgcttttgaaggtgacacatcatgcagctggtaattatatgcactaatcacctagatgggcaggtcaaaaagatccgagttctcccagttgtccctggaacagggcccatgtccattacttcacccttcctgtgtgtcagggtttccatgacaaatccaacatgctcctcgtctacctacaatatgttcaaacattaacagtttatgaatacaagtttagaacaaagtaaacaactaaaaacaaagaagttcaaacaaggttccatatttctacctcaacagttacttcttcaataggctctaacctttctccacggtctgttctatacctatttcaattaatacataaattagttaatagtgggaacagtgctgccaaattgctcagatacagagttcgatatcagtggaaagtgtatttccacagaacagggaatataactacttcagggtgaaacaaagtaatagaacaaaatatctagctacaaacggttagcttctctaatactgttggaaagaaaattgaactaaagaacttcaggctgaagtgaaaacgtaagcatacaaagagtataatatgtggaatattggtgctcacatcacttttgggggtgaaactgaaagctcaaatccttcgcggcgcatattctcaatcaagattcctggaagttatgcagatcatcaaatgctatagttggcaggaaacttttcattatattgtacacgaggttgacgtatgaagtgctctcaaataaatcaagaaaaaaaagcagttaaatagcatatatcagaaaaagaagggatttcatcagtggtacatatacttacctaactgaagttctccccttccttgaacttcataagattctgataatggtccaggaagaacattaattgccaggttcgtttctgcttctgccattaggcggttgcctattttcgctccagttagctacaaaattttagatggacctcagaaaaagagggcagctattattgcttgatttattgaatacaaatttatattactatagcaccatacagattggtaattaggctctttccagactatgtgtagtcagcataggcaacctatgaagttgatttagaatagctgtggttggatctatctatgtcattcaaacaaaggagatcgaacgctggtgtgttttacttagaggcaccaaggcttccatactttgcatcgttatatcctaatttaaatttgaccgcaccattcctcagaaacaaatgacataaaacttcacattaaataaaagtatgtacatactgcccaaaaaccagcctggatagcattgcaaaaacacctaggaggctagtaccataccttggatttagacctccaagactaatggtgttagcttcttagtccttactctcacctaccaatttaaaacttcattcagaggactagctccaccgatagatttaggaaaacctatgcgctagtaactgaattcagatgattaaaaatgtatggtatgtttgccttctgattattttgacaggaaaattatgatctagtagtatcatgctcagcaagtcaacatttgatatctacccattatttgtagttcaagacttcaagtagtgactatgaacaagatctagtgatacaagttatattgcagtgagcaaatgttatattctctttttcttaaaaaggaaaaggtaaaataactaatatatttcagtctgcaacaaattttcagatccaatatgaattaactagttccttaaattttagaatcctgcatatgacatccccaaatccagagcaacatagtgcgtggaagttataacaccatctgattatcatggttccattaacatattagcagctcctacaggaatctgaaatctatcttaaaacaataacctaactttaagcaaaaaaacaaaataggaacatgaaaagcaaaataagaacactttgatgtataggaaaacaaaacaaatatgcatgaattttcatcaaaagcaaaaaggacaatgaaaacaatatgaggaataaataggaacactttgatgtctaggttaattgtttgctacttacatgagtgccatcgcggccagacagtggtgaatcattcacaccaaaagtcatagatattgtgggagggtccaactcaattgtaggaagggcagtcaaaatctatattgtacaaccattattagtacaaggaatatctgacaatagaaacacgttcagcagcacgaattagcaacctacatctgaatttgacacagtatgcccaattgctggagcagccaatccagccattgaaattatgtcgccagctcctgcagcctctactattaccatacttgttcctttctttttcatgagcttgacaacctgaatttgtttcagtagtttgcaaaggtccttaaggcatttaatgaatacaataatttaaacatattgaatgagaaaaaagtgtcttcagcgtttaagcattgccgagaagaagtgcaagaaattcagttaaacctttccatcttcgatcttctgaacaccatcatctgtgctacgaagaccatgcactttgtcaccaacacggacaaccccagatcttactcgtccagtcagtattcgtcctagataaaaatcgcgttccatcatggaaacctgtagaagactatgaattactggctccgcttaagaattaccagtacaaccttacataaatatcttcagaagaggtaaatttaagataaattctagggtggggaattagagaaaacttgcctgcaaaagttaaataacacacatttcggaacaagaagaagtgtgtgaagtcttaaattctgaaaaggaggtggaatcttacaaatagctattgactaagagtggagaaaacttggccaaaaacgaaggcatcattttgttttggttgctaaatcaagtggaactctattacaaataaacaaatcgccataatacttagtcgttcactcattctaataaacatgtcattagagatggatggagaattacaaaagaaatagcaagttttccctcgtctaaataaaatatccatttcagatgctgtgcaatacactaaccaacatttggaatggagcctcaaggtcagcttttggagaaggcacatgctgtaaaatggaatcaagcaatgcagacatatttttcgcattatcaggagggctcttggtgaattctagagaagcccagccttctttagccgatgcataaagaactgggaagtctaactgttcttctgcaaaacccgaataaaatagtgtcacatatttatgaaaaaacttccaaggcaccaaattgaagtactagaaatgcacctgtagcaccaagatttgcaaatagatcaaacaccaagctctctacttcattgcaggtctcttccgaaactgttggagtataattggttagttaaagagctatagcaaacataatatactagggatatatatatatgccaaaaataatgaatataatgctttatctatttctgagctggtgtatcccactgcagttggccatttttactttgtgggaagtgaatatatcgcagtagctcatctttcaaacaaaattattgctaacgctaaaaaacattcaatgctaataacaggctactcaaaaggaaaggccttctaactaaaaattacatgactggatatttctctttttctgtaaacatagaaaacaaaaggtagcctaattttgtgacgggaaatggaatattgtgtcattttggataaaaattattgtgtatttacccccaaagtatatgtttctgtttatctgcttaaactaaattacacatcaaaacttcatacttgctcagcttaagatcgtagcttgattcatatctaagacaattgaatcactttgttatgtacatgccatccattgctcacaaaatactgccatagtgagcagagcatctgagaataagcaaacctgatggcctgtcaaccttgttgagaaggagaattgggcgcaagccatacttcaaagcctttgaaagtacaaacttggtctgcgctaaaggtccctccccagcatcaacaaccaagaccgccccttcaaccattccaacaactctctcgacctgtcacataattggtgaggatcatgtcagataccatagaaaaatcatcatttcttcttgttcttaactgtatgaaattataaaagagtgctgagtgtgtacttcgccaccaaaatcagcgtgaccaggtgtatcaaccatgttgagttcgttctccttccaagagacagaagtgacctacacaaatagccgagacgaaaaaagtgagatgccacataaaaagttaccatactgaatgctatgcagctattggaccatcaatgaagaagtttcaacaaaaaaaaaaatcagaaggatgagataatgattatctcagcagatcagatttcgggagtgatttattgaactacaatagatgtgcaggctttacggagtacagaatgagcagagcagttgaaccataagtgacataaatcctcccagaaatttacttacgcactgaaatctgccaaggtgctcagcgatgtataacagggaaaacagtagcgcaagtttgagaatggcctttgaagcagatctcacttccttccccaagccaacattctaatccctcacgtgatgcacgcagtatgttcgacggaatggacatttaacctctcgtgtgccctcactaaccacgcggcgcgcgcgagtggtggaaggtgggttaccttggaggcaatggtgatgccgcgctcgcgctcgaggctgatggagtccatggcgcgctcgtgtgggatgtcggcgccgcactgccgcaggagccggtccatcagcgtcgtcttcccgtggtcgacgtgggctatcaccgccacgttgcggatgcgggacgggtcgagggcgcctccgggccccagggccggggaggcggctgccgacgcggcggcggccgagtagaggcggcggaggagcggcgagacgtagggcgccggggacgaggcggaggtcgggaagacagggctcgtccggctcgccgccgagcggaggccgcggagcagcatgcccgtggccatggcgttcgcggcggcggcggcggcggtggcgtgatatttcgcgcggccgggagaaagggaggcggctgcggccaagggttttattcgggcgtgtcactgcgacagtttaccaaatgtataaaagcccatctgaccacaggcctgggtagtttgtcctgggcttctttcggcccaatctctctcccgtcgagccggccgcctccgccgctggggcgttccacttcccgacgggcgcaggcggccggcgtcgactctctcctgtccaacaccatagttgtggcggccgatgctatcgttaaggatcgcggccgcctcgcgcctgcgagggctgctgggcggcggcgcagcgaccggggcgcgcacacgcgccttctcctatgggagggtggtggatgccgctgcccgggacggcgagctccgagttttcgtggtcgccggtgaggtctcaggcgactcgctcgcctcgcgcctcatggcgtctctcagggcgctctcaccggtccccgtccgttttgctggtgttggcgggtctggtatccctccctttccccccattttcgtttcagtacttctgtggaatcgatgtactagggcattataacttgagtttgtacattattttaggttgctcttaaatcggaccagcatttgtccaactttttgtttgatttgatttttcatgtcaattttcataggtccattgcgtgcttatagattgtttcgtttcacatgaacataaacaaaacttccattgttgctatgcttggcatgctcacacagtcaaagaaagacttattttggaaccgcttacttaaagtttttttctgaatgttgttggaaattaaattctaattgtattgtacgtagagctagattcatcgatgcacacttgaaatgctcaaatttgcatatggagagcaagacagagtttcagccaataccttgagacttgagcaaggtgtctagcatttagtggagagacaagcaacagatttttcattgtaattcttgttacaatagtatgtgatgctcttctctcttgtagtaggtttattaggttgtagcacattgaagaaacagtaaatttttattctaagcaatcctcaatgcttggcatataagattggaaaagatgaagagaaaagaaagaaaattgggagcaaaatggaattccagagttaggggattggattgttagatgctgacctatataagggtattcggcaagtctcttggatctaagcaacaaagatcaatctataatattccccctagttcatcaactcatcctacattccgcttctcatccctagcagccgatgccgcccggctatccttctggtggtgtttaatgcaattacaccttgcccataacagtgtgtatccatctgtttaattatgaagaaagttaactttttgtgtggtcaacattcccatgtaataattaattcagcatcattgcatcatttcacttctccatctatctgagttaatccaaacccaatttcaagttggattccatggttttactgcaagtatgatccttgagtttcttgcctcttaaatggagctcaatccagactcaatttcaagttggatcccatggctttacttcaactctgatccttgagtttcttacctcttaaatggagctatggactcttttctttgatgtagggaattaatgcgcaataaaggcttgcagtcactttttcccatggaggaaatttccataatgggattgtgggaactgctgccacacatatataatatcaaggtgcaatgttgttctgtctcatactctcatgctttgctttttgttcatgttctctggacttgtattttaattatgctcattttggttttacagaggaagattgaggatactgcagatgctgctgtattgtttcagcctcatgctgtagttactgttgattcaaaggggttctcttttcgcctcctgaagcaattgaaatgtaagtctattagcataagcattttttacaataccattcctaatttctcgtgagcaaatatgataaacactttctgttgtctaggtagatacaatcaagttgcccgtcctctacatgtccactatgttgcaccatcattctgggcctggaaagatggtgaaagaaggcttgcaaagttgcataattttgtggaccatttgttgtgtatccttccatttgaggaagaaatttgcagattaaatgggttgcctgctacatatgtgggccatccattattggatgatgctattggcttgaatatggtatggacttacgtgctttgtttcaacatcagtgccatcagcctaatatatttttgttgaattttaagacattgctgtccaaatctctcaacagttttactgcactttcttaagtgtcttctctatccagttatctcgttaagatttctttgcataaatgctttgcactacacaatgaatgcaccatctactacatagaatggcaatttaatgtaccagaatgtttctctctataaccagtagctattaaattactactgccgatgcatagcagcagtataagagaataaaggtaaggttttgtcatttattcattttataaagtgatcattctcattgatgtatagctactagtagcttcttttctagttcagttgttaagatatgtgcacaagcatctagtgtcttcatgggaatgagatgaagatgattgtgcgaaggatgtactattgtctttctactctgttaggaaaaatgttggcacggatggaataactagtaatggctgtcttatcgcaggtgatttaaatatttcacgtgatcttttatcaactaagcattttgatctggatactattgtctttctactttgtttcgaaaactgatgacatggatggaataactagtaatggttgtcttgtattgtagatgaaatatttcacattttcatttataaactaagcattttgatctggtaatctggagatgctcatggcatgtatataaattgctagtgctaatccactgacttgacttacatattctttatgcttgccaaaataatataggagaaggaactatcttctgtcaattccatgcatcaacgaagtggtgaagattttcgacaggagcatgaaatttccccaggtagattgtatgtgtaattatttgggtgtgcttcttttagtggtaatgcttatgttttgtttttgttttctgcttgtatttatcagttctatgaattatatatctgttatgtggtttatccatttctatgaacttagccgaggagacagacagcatcacagttacatgttatctgttaacagtgcaacttcaaatctgcaaactattcggcagttgcaactgccatttaattttgggcacacttgcacaccatcacttgtcaagtgctactatactatctttctgggtaatgtagtatggtataagtgaaaactcatggctgctgcatcaaggtttaataattcctatataattcggtgctgttagagtagtcgttgcaaagtaatctattttttgtagcaagttctaagtagcttactcataatatggtgctacaatcagatcagctttcaataatgagatgcaaagcattttttttacgggaaatgcaaagcatatattacacagatatttcaactttcttgtgaattgcatttatcataattttcacatgcaactctggtaaaacatatagttaaacctgaaagctacatgtataactgagcacatattgttttctttttatacactgcaaatctgcaggactatgcctggacctggatccttgcatttatcatgttatcttgtgcatctaggcattcactgaaatcatatctggatatactgctccaaattacatgttatcttgtgcatcaatagctagttagttctcctctatgaagctgcatcaatttttttttcataggcttaatcttatttgcatttttactctgtgttatttatatgtgcttgttttctaatgagaaaatccacttttgctagattccacaatcataaccatactgcctggaagcaggatgcaggaggtagcccgtatgcttcccatcttcttgcaaactgtgcaacacctaagtcatacatttaatgaactgtcactggtcatcccagttgctcctcatcgggatgtgagggtatatgttgataatgttgttcgatcagggccatttccagtggtactgataactggggaaacactaaaagaaagatatgatgcattcaatgtaagctcacatgattttagttctcgagtgccaattcaatttttgggtactattattttgaaatttggttatgtttcaaagtatcttatctccccaatgcttatatcatggacttttgtttttttacggaaggtttcatatcatgcactgcacctgtaccctgtgcttgctccagaacagtgttaatttgacaaagttccctgaattgctaagtctgtatctgaagtacattttcttgttgcaatatgcagacaaaaagttatctaatctagaacactgttgattactgcagctagtagattgtcccatgcatgttgttttaacatattctgtccctttcactcaggcagtatatgaaacaattccttaaccacagtaagattcagcattattatgaatgattagactagttatacacataagaaagattgtgtcagtactagttctttgttttctagagaaaaacatatttatttcttgtgaggtaccatatttttgttaaggtgcatctgttacgtcttttttttctcaaacacgtatctgctacacctcaagccaacatatcttatagtagttatttctattaatgaaagagaaacatgaaatttatatgatgtaattgatagttaatatgtgagacagatagcaacctaggtgggcttcttgtgccagcagcccagtactcgtcatgaaatttcattggtaatgtaattgcgtgctaaataccgcaggtctgcagtcgatttcttgcagtttccagaattcatgtgagtaaactgaagagtgttgtttcgtcttgcaggctagtagagcagcattatgcacttcaggaacagctgtcatggagctgatgttagcaaagctaccctgcgtggtagcttaccgggctcatttcatcacggaatgtttgattcatctgaggaaaaagatagactttatttctctacccaacattcttttaaactctccaattgtccctgagatcctttttggggcttgcacagcggaaaatctagctgcaaaactaaggtaatgtcccccacccaaagaaaaaactcatagatatgaacatagttatctcccatggatagcatccatatgggtataggtagcagtattcatatagattcatatgccttgacatgcctgttagttaacacaattgcttaacgtgcttccattgcttctttttttctgaatgatgttcattcttcattattgagaaatagtatgtatgtattcgacacttggacctgatcatatttcatcccattttgatctgaccagtgaggtcatttgtaatgatgaagcccgtcagctccaagttgaatcagctgaacagttactggagatgctttatgaacctatcaagcaacgaggtggcctatttcaagaggagctgcacaactcgagcctgccgtcaaatatctactccccaagcacgattgcagcattgacagtgctttatacagataaccatcaacaagcggtgcaccagaattgagtggatgtcctcagtagcagacaaatatttttatcagccgtgatggtcgctattgcgtgcaatctcatcttctccgtctgctgttcgtgatgaagagtgtactttctgcagatcctattggctgccctaggcccacaattggagaggcaaaacgagtttttaggtaaaaaaggcttttcagttcttggtttctgattctgaagtgccgcatgaagtcaggtcagcatcgtattatcattatggaggatgggaacgcatgtgttctggtgggtttagtgcgggtcctggtcatcattctgcgatgatgcgtttggcgcaagattcttccatggttagaatttcctggagtgaacagttggcagttgatatgtgagaacaattacaagagatttttcggatggttttgatactttcatggtcatcgaaattacgagatgaagtatgaacggatgcacagtaacgtcatcaggtctgggcttgcttgatggctgctctagccatagaggatcctcggtcagtgagaaagcatagattcccacgtagccggcgatcacgtcacggctgagctcatctaggtggtggcccatgcacgagacggcgaatcttccatggaaaatatttcgaaaattgttgcttcggttttaattacaagttgccggcattgccagtgttccacttgggaatatctaacgcttttcttataacgattttacctgccaactgcagcatggcatggggaaaagtcttgagccatcgtgtacttaaattgtgtaatcatctggtgccactagctatccgtgaacttcaggagtaagttgatctagaatggtgactggtcaatggaggccttgtaattgtaatttgtaaaacaatctaatgatgtaacatctcaaggcattgccagtgtggtcgcggtgcatggattcgtttccctggcatctcggtaagaaacagtaatatttcagtatttcacagtgataagtgattattagcattggacccggtcactcggattctgttcttttcaagagttcatacataggtcatttttttaatgtaggtttttaaaggttgtttatgaaaatggtcttaaaagtattccttttttatgaacttggctttacacaggctaaactgtcatcaatctagaacgctgcactttgatgatatcttggacatatcgccatgttacaatattttcttcgtgcttggaaagcacgattgatgccttcaagtgaaactttgctcacggaattggtatcacaccacgaaagatatcataaaaaatgtgagcactaagcacagagtaacaaactacatgacatgctcttggtaccactgtaccatcaataaggcagaacattaccacactaacactcaggccaagtgcctactgcaaattaaccctgggttttgatcctcatcctacgcgctgtacatgtcaaactgatcttcatttcatatcacgcactcaccgtcgctcatgccgacctgcttcgcggccgcggcggcgccgcgacgggcgccgtcaccggcgacagccggcgggaagttgagcagcgccttggcgccccgcatgcggaacgcggcgcggtcgtacgccgcggcggcctcctcggccgtgccgaaggtgccgagccacagccgcgcgccgtgccgcgtcgggtcacggatctccgcggcgtacttcccccacggccgccgcctcacaccgcggtagtgccgcccgccagcggcgccgcccctcgccgccgctcccctgcctccgcctccgccgccgccacccttgcgcccggcggggtggccggcgaccaccggcgccgtcgtccgcgcgcccagctccggcgacgacgacgacgacgacgacagcgccgccaccgcggaggcctcgcggaggacgtcgaagaggaccatgtccagcgagtcgttctcgttgagcgggaggtacgacgacggctgcccgttggccgcgcgcgccagcgacagagacacgtccacgcgtggcggcagagcaccggcggcctggagcgcgggcgcggcggcgaggcgatcggcaccgacgccggcgccggcgctaaaccccaaggagagagacatgcggggctgtacgcgcggggcgcgctagctcatgagacgatcgagagaggtggatggatggagagaccgagagagtggtttgcagtgtggtgtgtcaggtaggaggcgatgcgtgatgttgtcgcgctatttgaacccgaggaagagctagcactggaagtctggaactctggaaatggaaggattaattatttttaactaaagtggggccatcatgtgtcatgcaaaatgtgatttcgcaacctcctcgggtgcaaatcatgtggttcggttcatgcatgctttggcctttggccaattactcccatttttctacgtagttttgctgatgaaatcggccaatcggggtaggcccatccatccaccgttggagcagccagctagcgagcagtagcagatattctgtacggagaggcacacggcgagcaaagctaggcttttcatgtgtagctaaattgtaatatcccagttggattccttgcatctcacgtaggcaaagatgtaatatagcgctctgtttattaatgcacggatatgcatgtatggttacctactctagtgaccaatagaagaagatcctcctctaaggctgtgtttggctctcagggttgggaacacatatactgcacacgaaaatggaacggtgcattagcgcgtgattaattaagtattatgtatttttttttaaaaaaaagatcaatatgattttttaagcaactttcgtataaaaactttttgaaaaaacgtttagcaatttgaaaagcgtacacgaggaactcaagggtatcgaacacagcctaacttaacttcgcatgcaattgagtcactgatatataagtcccactttgttatgttccacatgtcagtggttcaattacatagtagttagagcacctgcaatggtaaattaaggtgctctctataaaacatgtacatctcaacaataaactagattaatagtaaaccatctcaatagtatgtctacatgggtatctatagctctctaatctattgcctcgtttttctatatagactatctccaggttagtatatagctttgctctctctattcatttaatttctttcaagtaagaaaatatgctgatatgaatattttgtagagagactataaataaccattatgggtgttcttaagttagaggatccctttataagggtccaagggatgggaggggttaatagcagttgatttcgagtcggctcatgctgtctcgctactactccagcttttaactttcttttcctccattattttttctttcatttcattgattcattctttattttttcagtagcgcttaatagctttctcgtgggggcattgacaggatgtggagactgcgtggacgctttttagcgccatatggtacacacacgtctgaattcttgggcagaaaagcaatacaactaattcttggccatatactccaaaagagaagaccagagaaagaacttgggaaaattcactgcagagccgtggcgtgatttggcacgtcttccttttcagatcggctaattattctggatcttctgtgaccgatcgaggccatcgacgtcgtgccggtgcggcattacgtacgcgcgcaaacgtaaacgagagtgagagtggccgaagcgacgacgagaggataggggcagcgatcgattgggccaggccagtggaaccttccaaagccacgtacggagacagcggtcgtcgtcagctcgtgttgttcgcgaagggccaagagcgttttctaatggctactacttctagacacagcgggcagacttgagctacccgctccctcgacgatatcggtcaaggcctcaagggtcaaaggagcattattgatccatccgtttcataaaagcaacgtcgtaatatagagtgcaacccattattcaaatttatagtagtagaatatgttatagcccgtgttttatttttaagagtgaaggagatatatttgactgtcattaccggatcgatgtggctctctctaataatcacccatcataaatgcatctaacaaggttatttgtgcatcgttgcattctcaagaacgtggcaactcgttagattaaatttaaggttatatatatgtgtcgcactatcaaacccagtggagcgcgcaatcggtaataggctcttccctgtcggcctgttagaccattaacattgggagcatcgatagttcgattcctgatcaaaagaacaaaagggaaggggaaaaggaaaaagaaaaaaaacacgtagattgcgcgaccgttgacgatcttcggcaagggtatagcacaatggtgttttggaaagagcgattcatcgaggtagcagtgtatgcttaagtataagttgtcatctccgtgacacatgctttatttttctaagatcggatggagaggcaagagggggatgtgagggagggaagacttgtattcgattctatcggccgacaagttatgctcgtgcgggagtagtcatccatttcattgcgagttccgtcttttgtgtactttctttatcacaaaatttaaaggatttatagattcgtattaggatgtatctatctcatgtatttaacatctctatatgttaaagctcacttgtgataatcccttagggtgtgtttggttggtgggatatatccggataagacatggctgccactttttggaaggtgtttggatgctgggcgagagtgggatagggcggcccagaagggaatattccctccagatgctggatagagggatccggctgatttggccggatgcaaccgctcgaggctcgggtgagccgagcaagcgagttgcgtgactcgcgtcactcctcaccaccacgacgcgagcgaggcgacgagcgcggcagccggcgagaggggcgacgagctcggcggccggcgagagaggcgacgagcgcggtggccggcgagagtggcgacgagctcggggcggcggcaggaggaggcgagctgcgcggtgggaggaggcggccggcggcgggaggaagccggtgggaggaggctgccagcggcgtcggcgagcccagatctggcgctgcttttttttcttttttcttttttctatgtgtatttataatggaatgtgtatttataatggagtgtgtatttataatggaatgtgtattatgtattaatttgatgaggtatattcaccatctcaagtgagaggtgaccacacctacaaatccaccgtacttcctccaaccaaacaaaaaattggatcaccagatccacctttgttcctacaaccaaacaaaaaattggatcgccatattcacacaaccaaacaaaaaactagaccgccatatccagcaaaatatggaccgccgtatcccatccaatcttgaccaggaaccaaacacacccttaatttttcagtgggtatggttgacttgacggacgtactactccatactaagtcgcttaggacaatgtttaagtcaaatcttgggaatataaatcatgaataaccctcaagttgttgagtttgaaaatataaaaattatatgaatagatttgtcttgaaaaatacttttataaaagtatacatatatcacttttcaataaatatttttatagaaaaaaaaatcaaagttatgttttggagaccgtgtcgttgtccaaaacgacttcctttacgagt

SEQ ID NO: 28478 - DNA, 22273 bp, Oryza sativa
tccttgagatcagcacacccgggcggactgcgagcgcatccaacggcagatgacgacccaaccaccaagtcgtcgccaagtctcctcctccgctcccgccactctcatcctcctccacctcctcgccggcgccgccggcgccgcaccaccgctcgtcggcgtttctcctcaaggtgacggcagagccgcatacctaggcgttcgctccttcatatcttttccttactcgacctgaccaaatagcctctgcagacgaggcgtacttcgcgccggcggtcatcgcctgcagggacggctcgggatccttcccgaagcgccgcctcaacgacgggtactgcgactgctccgatggaaccgacgagccaggtctcccaccgcctcgatctctgtttccgattcggcccgaccttaactgcgaaatgcgaacttcggggtcttggggatctggtcgatttcgcgtgtgtgacgagatctgatggaatattgcgttggatgttaaaattggtgtgatgggaatatttatcttgttatggatttattacttgcgatagtacaatcctttttttcccaattcaccaaggagaaaaatgtgcgattttgttagtaaaaaaggatgtgatcttgatctttcagaggacatgaggaatgtgcgatttttacagtgctttcgaggattgcttttgctgtgttttacgccaactccgtgctaatgcaaatcatagattactaacatatttagctgccagctacattaaatcaagtttattgatagtattgtggcctgccgttcgtgtacactccctccgggctggtttattttgggacggagggagtacagctgaggtgagccagtgaccggccacaccgccacagcattcatttgtgacgttctgaatgctaacatagaaaattcttccacatctatgtgtttatctgttgcttcatagtagttgataatagcaccaatgcaaaagatgttcactaatataatgctgtccctcacattatttgtgtcatccaggtacttcggcttgtccagatggcaggttttactgtagaaatgctggagacacccctcgtttgttgttctcgtctgttgtgaatgataaaatatgtggtatgctattgcttttttcacaaaacaatgttaatatcaagagaatacagttttttttatcctatgttcaagttctctgtttcaaaaaatccgcttccatttactttcatcaatagcaaattttttttactgtgttttgttatgctcttatagattgttgtgatggaagtgatgagtatgaaagtggcatccgttgtccgaacacttgtaggaacataaatgatgttagaaaggatgatgatgttggtataaacagaaagggtgttatgaaggatgacggcgttggtatgaacataaaggatgttgcagaggatgatcatcatgataggaaacgtactctagatatagaagatctcatccaaaagctaaaaggtattatctctgttcagcatgccacttagatgtagccattccaatggatgtgcattttgttaaatgtgattttaattgtcctgtttgcaggattaaaaatggctgtagtcattgagataggtcttgttatatgtacatttgcagtctgcttcgctcggcgccgtaccagaacacggaggagacattatattttgaaacgtaagaaaacatcgcccccccctgcatattaaatcattttgtcttgtctagtaggaattctgtagatatcattttttgaagtaaagggcaggagcgctgccaaagtgccattcaatggaagaatatgattacaatagcgacacaccaatgcctgccacagaagggcctgaccacttaggccagtggcaaaactatgattacactagctagataagctcattttgtaaacatcatattctataacctaatttacttggtctataattcataagatctttacttgccaacgaacttatgatttttgaaattttattggcatgtctatttccttggcgtttaacccagtgagatgaccctctgtgtttaacctgtccgtttctgataacataaatgggagagggttcacctctctttctcaaaaagaaagaaaatcagtgtgtatttattgatagtgttatttgtgtaatattcctactatgaccagatttctttgccgcataagtatatggtaaaagtgtagttttacaaattaacctttcaggaccatcagtagctttatcaccatgtgaagctgctgtgaacacatagcccaatttattttcagtttgtgatgaagtattctcggaaacagtataaactcaccatagaatttgtgttttattttcaggataggtgagctgtcactcagaaagtccaaagattgatatggagtacaatgatactcatttgcaatcctcgaagtctccaactctccaaggatgacgggaaactggagatagaagaagggatttacacgcttgctcatcgagacgtctggaacatcaagtcgaggaaaaaaggcatcacgttgtatgagtacgattatgtgttatttttgcccgtattttaggtctcctcagcagagttgctggttgaccaaggccaggagatgatgaaatccatgtagagatgtaggataaactacgtgaatatggcatcagctggcgacgcattattgcgaggccttcctaaacttctctgtaactgtgattctgtgaagtgcactgcaatgattttaagttttaaacagctaataacatagatataaaaattttattcataaattaattttcgttgctttcttcattttattgtggcttatcaacaaggctcctcaaattgcacatgctaaactgctgctcccttgttctcgccataagctaatactaagggcctgtgggagagtttttgcagctgcaacttctctcaaaattagaaactcctaccacagtctagttttttattcagattgtaagaagtggttgtagaatccaaaaaatgaattataaactagaagaatccaaatccagaaataaattataagctagaagaatccaaaaaataaactataagacagaagctaaaatctcagcttctccatattcttacaagatctcagcttctccatattcatagaaggggttaccaaacagctatttttcaaaatcttaacattacaaacctcaagaagctcagtgtcgcatcagtttgactgcatttggcccgtttggggttattacatatgggcttcggcccatgatggaaagtccagcccatattcaaccattccggccgattagggttttacaccacctctctccgtgctcctcctctccacactcgcctcccctataaaagtcctggacgccgcaaaaccttccgcgccgccgccatctcggaccaccgtagcacgccgcctccccgcccagcgacctcggcaactccggcgaagatgggcgccttcagggttagcaccatctctcccgcttcctcccctccacttcgagggctggtttgatctcgcgagatctgatctgacgtttgcttcgttcttggtttttgcgcggcgcagttccaccagtaccaggtggtggggaggggcctgccgacgccgaccgacgagcaccccaagatctaccgcatgaagctctgggctaccaacgaggtccgcgccaagtccaagttctggtgagggttcggatccccctcgcgaatgcgccattgtttctcgcttggtttaggtgcttggatgtcgttcactgacgttactttgtctgcgtgcaggtacttcctccgcaagctgaagaaggtgaagaagagcaacgggcagatccttgccatcaacgaggtgatctattctttcccaccttaccttagtctcatgcgtgcatctcggtgctttcctttctgcagagtataatggcgtattaatatcaatgttgagcgaactacttagttctgcacttttgactctatatagtgtgttcttaatcggtgaaacgaaatgtactagtcatttcatgtgccatacaatgttattgctaatttttacacgaatgctagtctatttcactgatgtctttttttccatgctcggtgttagatttgattgcctactgctagacttattgtcgttttttttcctgatgtacaactgtgtatacttgtattatgacttattctgattcttctgctgtacatttaccccttggagattttatgataaattatgattgtggatacacaatgatttaaattggctgagttagttcacgcttagtttattatcagctttttcaatagtttacctgataatatttccttttgttgttttatctgcagatttttgagaagaacccaacaactatcaagaactatggcatctggctgcgttaccagagtaggactggctaccacaacatgtacaaggagtaccgtgataccaccctcaatggtgccgttgagcagatgtacactgagatggcttcccgccaccgtgtcagattcccttgcattcagatcatcaagactgctactgtccactttaaactctgcaagcgtgacaacactaagcagttccacaagtcagatatcaagttcccactggtgtacaggaaggtcaggccccctaccaggaagctgaagacaaccttcaaagcttcaaggccaaacttgtttatgtgatccaagtcgccttccatgttctgtaagatctgccagtatggtgtagtcgtagttcagaacttaagatgaatcttatccatatgaagcctgtttttgaaaagttctggtaggtccatgctgcggtctctctaggttctcgtatcgtatcctggtatccttttcttttgctttgtgatcatctgatgcctcatactgacaattcccagtttgcgttgatattggtttactgaaatattataacgttgctattttgctcactgcttatggtagcccaattgaataatccgtaaaatcatagtctgattgaactgtgtttcaattttcttgctgtatatgctaatcttagtgacttgcatcaattgggtgttatgtgcttattacgtaattctgtaaaacgaaaaatacaagttaattcttcatgattgttttttgtttcatgctttcatatttcattggttatttgtttggcacaaccgcacaaagctttagctatctattttggctgatattgggtatgcatcattttactgatagggatattgattgatgctggataaaaatgtttttcttgcatcacattcaaacttttgagtagttaggatggcaactttgccgaggttaccaacagttaatttggttccctttttttccctgttgccaatatctgattaactcttgggtgctctctcttttccataaacctagtggtttattggataagcatcctagctaacatcagctgctaaaataaagtagttttactttttaagttctcttactagtcgcattgtgaggttttgttaggcaactttgccgaggttaccaacagttaatttggttacctttttttccctgttgccaatatctgattagctgttaggtgctattctttccataaacctagtggtttaatggatgagcatcttagctaacatcagctgctaaaataacgatgtacttttaagttctgatcattctttcgttttgttttcataatctaattcaatgttctgtgactccataaatcattttttttacttgggctttatatctcttcctaatgcaagacggtatgcaaattttggtcatttcaattatgtacaaactcatcccagttgcatttgctacctgtgaagttgttaggcaactttgccgaggttaccaagacatgtttggtttcctttttttccctgttgcctatatcattagttgcttggttgcttgaactccattgacctatttggttttttgggtatgcatccatgccaacatataatattttccatcattctttttacacttagcactgcccaaatgttggtttggttcgtggactgagattctcgggaggcttttatgttttttgatcgaatggttcgtggtttctttgctggtttgtggttattttatcttcttggagtatatgtttgtcgagataattgttgatgtaaatgcagtcgtaaagctcttaaacgaactctaccaacagctcttattccgaaaaagtagctaaactgaaggatgaagaactctggttgggcggccgagcacctgcagcatcggccactgccttacgagtacttttcgtctgtgaggtcgactcgacatcaacccttgtaattccgtctgtgtggtacacaggatttgttatttagtaattgtaaccattcaaattatctactgctattcatttaaagttttcaacttacctagaagtgttttttgtcgctcgtcaatcgtcatgataacgaatgctcatacaacaaactgaaccagacgatacggacgaaactgcatgaagctagaatagctgtgtgttctagcagtgttgtctcgtagtaatactgtacgtaccagatcgtccagtacattcaaaattttcaccaagtgaagaactgagttctggaatcgttaagtgaagaactgagttctcgaatcgtgtgtgatttgtatagttccgagattagtactccctccgattaagggtttaatacgttgttagtaaaaaaaaggctttaatacgttttaattttaggtaaagttaaagttaaactgttttaagtgtgactaaatttatagacaaatataataatatttataatactaaattagtttcatcaaatcaataattaaatatatttttataataaatttattaattgaatatattttcataataaattgtctggggttaaaaatgttactatttttttatacaaacttggttaaacttaaatcagtttgactttgattaaactcaaaacgtcttataatctaaaacagagggagtactctctctgtctcattttaagtgcaactatgattatccgtatccaactttgattttccgttttatttgaaaattttttaaaattagtatttttactgttatgaaatgataaaatatggatagtaatttatacgtgacttatattttagttttttttaaataagacgaaaaatcaaagtcacacttaaaaggaaatggggcggcggagggaggactagtccactgataagtgataacgcatcattcaaaatgatcccgaagtgaaaaccgataaattctcaaagaggtgtgaattagaagtcaaactgcatcgacccagctgtccatggtcttcttccgttcgccctcgctttcttcccgcaccaaccccgcctaccgctccaccactactactacaccatcccctccaccggctccccctcaccaaacttccctccacgcctgcttcgcccaactcgttctcttggagcacctaactcgagctgagctcccttcccgcggaattcgggtccctccctgatggcggagccggagcagcagcagcagcaggcgaatcccgacgaggtaccgatcagccccacgcgaacgaggccattttcttctctcttgtagtatgtggtgtggtgagagtgagaacgcgcggcgccgtttctttgtgcaggtggtgctcgggcaggagaccggcggcgcgagggtggcgatcctcaaccggccgcgccagctgaacgtcatctccgatagagtggtgcgatttctttcgcttcgtgcattttccgatcttatgccggaagcagcagctggaagctgtaattggctgggccgtgctcggtttctggttgcaggtgtatctcctcgcccagttcttggagagctgggagaaagatgaggatgccaagctggtcatcttcaaggtgcgcgcactgctgccctcttagcaccctgcattgataaagctctagggcagaacataactaattataattcagacaaggataggttttagcctagtgatgtcatgcgtgatttgtttccaggagacagctcaaacaaatcatttaccttactctagtttgtttcttcaaagtccttgcaatgcatggagcacttggctagtagtacaaactatgtagagaaacgtgttgcttgtttaaggattcggtaaggtgtgcctggtcaacatttggactttactcagtagttagtactgatacataaggtaacgttttgatatggataagtttggcaataagacagcgatgaaatgaggcgtatcatgtcacaaatgaaactttttgttatgactttgtatgatacccatcgattggcccaagcatatgaatgtatggtctgctgatgaacagggggctggacgtgcattttccgctggtggggatctaaagatgttctatgaaggaaaatcaggtatggatatgatatgaatgtttcagtgtagcagtggtaccacatcacatgaccttactgtataatttgatttccatccccaagactcacatttgcgcacacttgatggcatttaaacctattaacagaactcctttgcagatgactcctgtctcgaggttgtttacaggatgtattggctttgctaccatatccacacgtataagaaaaccgcggtgatgccctcttttatgtttgtgggaggactgttttctaacttgggggcgaattctgtactcaaattctatggttttatttcaattcatgcaggtggctcttgttaatggacttgtcatgggtggtggtgcagccatggttgctccactgaagtttgcagttgtcacagagaaaacagtatgcaacactagtccatagtccagttcttttggaggctttttttattccatattgtgttatatgtttgtttgttggtttgctgtatttatctgtaaaagtgtaaatcacccctctacatgtcactatctcttcaattcagctagtattattattttggcaaaattggttatatagcatcaaaagttcacgtttttggtatgaaaaaaatagaaaggagagaacactcctattcttgaaacggacccatttggtatcatgattactctgtcttgggagtttcacggtgatgttttttgtgtgtttaggtcttcgcaacccctgaggctagtgttggattacacacagactgcagcttttcttatatccattctagactccctggatatttaggtaagtactgaattgcattttccattcagaggtcaaaccatcaccttactacaggcgtattgtctcttgagatgtaatgagaaatctgatagtgacttgtgtgacaaattaaacatatcttaggacaatatggttctgtaatgtatcacttgacatagatatttgtgccaatatgcttattctctttgaataattcttaggggagtacctggctttgaccggtgcaaggttgaatgcaaaggaaatgattgctgccggtcttgctactcattttgttccttctgaagtaaggcattcagcatttaccattcatattcacgatggttccggtgcatgatttcctcgattgttctacatgtagctcgacaaatcaaaatgtttgttgatatattgtctttctgtggttggactaaccaaaaatgattataatgtgaatggcagaaattggaagaacttgaaaaatgcctgctgaatttaaacacaggagatgagtctgctgttcgagctgctattgaagagttctcaactgatgttcaacctgatgaagatagtattttaaacaagttaagaactgatgtccttttccaaatgtaacttgctgcgcatgcatttattattctattattgaaataaattgacactggaatgacaatcttacttcgataggctcccaactatcaacaaatgtttctctgctgagactatcgaggacatcataaaagcttttgtaaggattcttcaattacttgcttgaaaaagtgttaagtcctccaactaaaaaaaatttattttgggttccatgctccaaaatattttaaccaccaataagtggacagtattcatcttatgcccaaaatatatcatcgtcaaccaatagcttctggaaaaactagacacagtacactcaccaatcaccaccagtcttcactgtcctataacaaggcaatcaactttttcctgcaaatcataagtagcgtcttttgttgttgttgttgtttgtaggaatcagaagggagcattgatggaaaccaatggatcgctacagtactgaagggcatgcgaagatcatctcctacttcactgaagatgactcttcgatcggtacaaactctgacatcgtttctaatgctgatgattttgtctcgtcttaataatatttgtgtgcttcttatgtatggtgaatgcttaaaagctatagtagctgtccgcttctccttggttaacaatttatttatatgttgtgcagtgtactaatttttgacatcttgttatgtattgtggtgcatttacagctcctttttgcacaaggcaagaatgtattcttaatattaatggttgttttaattcttcagatcagagaaggtcggaagcagagcctgccggaatgtttgaagaaggaattccgacttacaatgaacactctccgatctgtagttactggcgatgtctatgaggtactgtgatttgccactatatgaataagtaacggtgattcttgatacaggcaagactaagatgtcattcatcataatatttgcacctaaaacttggcagggaattagagctctcagcatcgacaaagacaatgcccctaaggttctctcatacacactcttaaacatgtctagaaatttttatttttcatactgttttttaatttttgttgcgatacagtggagtcctgctacccttgaggaggtcaagaacgaggacatcgaccgtcttttcgaaccattcagttcagaaaaggagctccaagtcccatctgacgattccaacaggtgaacaattgctccaaaatccatttcttttctctgcccttcacacaaacaacagtgtatcctaatcatctgcactatttccaattttgacatggacaatgcacagatggagtggcaaatttgagcacacagtctatggcagaacttcagagtaattggcagcagaaatagatgttcatcatcctcacaagcatgttttaagtactcgtaaccccatgtattctcatacttccctgtataacattgtaacacaaaaaattgaaaattacataacgcacgaagcaataaagcatctcaaatgttttgttacatcctgaagccaatgaataagaacttttccggcgtgtgatctctgtaaagagaattgcaacctaagggttaaagtctagggagtgaatgtatgtccaagagagaccagtcatgtagcgacttgagagccctatgagcagttgggctccacaggatactctaactccaagtagtattgtttgtacttggtagttttcttctgagtgggggctttcctcactgacaaaattctcttcccagcagcttttggtctttcggaacttccaccgccatcttcttcaggttcgttgcttgagttacagaaagataaagagttctttatggtcccgttgaggcctgaatcaaaaaaacttgagctgctccaaactcttagttaggcatgataactttgaaagcctctcctcatgatcagcaaaatttggcaatgcagtgtcgtcttttgcatcaacagcctaagcatgaatggcaggtagataaattagtggtaaacttactgatgaaactcaatatagtaaagatgctaatgtgaatgcaagagtgaatgggtgatattgcataccgaaagagtcaactgttgcaggttggggcaactctcaagcagcttcagaaggaagatgagttctctttcatttgagaaatccaagctcactgacagtattctcaagtcttcaaattgtacagccaagtttggagtgtctttatattcagatgacaacaactacaaaataagacaaagataaatgaccttctgaaagagcaagagttacacatgtgttagaccatattcacattccgatgttcagttgtgtgatttacactccagctatctgtgctataagcatataatgttgacatataaattatcgcttcatgttaatatctatcaaaaacgcattttatcaacaccgtgtcatttgaacagtgcttaaacatcaatgcaacattgcaaataggagaatacgagtattactaacctactacaaagctcaatgtctgaaagttatacagaacaacacatttcctgattagcggtttcactatggccctgtccagagaaaagcaaattattcatgacagtgcgaagcattgccaaggaatatttggcctagataactcctacattaaatcattctattatggatgtaatctaagaactgttttacattaatcacaacttaaagcacatcacaaacagttccctatttcatcagaactacataaactaacatttgtgtgaaacacatcagagcagctaattaaccataggatgcaagcaaaacatatacaagggagagcgcaccttgatggccatgcccctgagcgtgaggcaggtcaaccccgtgccagcatccaagaacggccgtatcctgaactgcagtttgacgcgcggcctggcgatgtgcaggtatgccttcctgatttccggtgcaggatccagccgaaccgactgcaccttggggcgcgtgtacagcgtgatcgtcctcagacccgccattttcaccgtgacctcacgctgctccagagccgacttaaacaggaggttcctcaccgtggaggactccatactgcagctgccggcgaatcccatgcagtacaccatctccagcgtctcgagcacgggcgcggccttgaggatgacgctgatcatccgctgcgggatggcaacgtggtggagcttgagcgtgcggaggccagggcacgcggcggggcaccatcgcgggagcgcgcaggagtcgagggagaccacggtgagggagcggatggagaggaggttctggggaaggaacgcgctgcggggcaggcggacggcgagctcggagaggccgcggtcggcggcggcgtcgaggaggcggccgaacgcggaggaggagaaccggcgggtctggggggcgaaggagaggcggcggatgaaggacggccgcgcggggagcgacgggagcggcagggccgggtcggcgacgagcgcggagtcgacgcggccgaactgggacgggaggacgcggaagcggcgggagagggcggagagcgtgacggcctggcgggtcgtgaggcgggagaggatggcgaggatgacgtcgtcggggaggccggagaggtagtcgtggccccctccgccgcggcggcggcggcgcttgcgtggggttcgtgccatcggtgcggcgcggtggaatcggagggggaggagattttcgtggatggatccggaggggaggggaggggaggggggcaaaagagtcaggagcttctgatttccgaaccggtcgggcctcaagtagaggaaaccggtcgcacgcgcgataggttttctggtttctcctctctttctgtgtgtgtgtttatttacacgcacaaggcaagtttgactacacgtgagacccacaggagtccaccggtgatacgagccctattggttcagtgagggagggaggtgatacgagttaacaggaggaacaacgagatatgagatcttttacggtgctttgaaaggtaccctaggtatctccttaacgaattgttatccacagttaatctttaaagggtaatttaggaacacaaatttttattaacaagggtagcttagtaattgctcaaatcccacccgtcacccaatcaaccaagccgtcgcaccgttgattcaagattaaccctaatcaaccaagccagcccgtgcgacggtggcaaccggctggcgcgacgggctcgtcggcggtgacggcgacctactgctgcgtacgtcagctgcgaccggtgggcgctatgggcgcgtgcgtcggcggcggcgacggtgtccagctgctgctttcgtaggcgcgtacggcggcagcgagcggcgggcgtgtgaggcctcggcaagcggcggccttttacgacagcgacaaccagcagatcatgtaggttcctctcgcacgcgagcgttctaattcttcctctcgtttttttttcttcctcctgctgaaacgtttgttgcttctctcaaaagttctgaatttgtaagaatacgcttttgccctttaccgaaaaaaatttaataaaaaacaattaccattttaccctcccaccttccatacctggctcacccttttaatacattttttcaggtaccttctctttctgtccgttagatcattgcagatcaatggtcctaattaattccaagcattgaagaagatctaacgagatatttgaaatctcttaaccacaaaaccaaaaatatgtatctttaaatttacataaaccatacactcaaggtccaacaacagtataatggatggtttcgctgacatggcatcctagtcagaaaaaaaattaaaaaaagtacatggagcccacatgtcagttacaaatcattttccttctccttctcttctcttttctctcttctctcttctcttcttcagtgagggaggccggcgaactccccatccctcccaagcctctctgctcgccacccgccgaccgctgtcgcgctcacatgccgcccgcatctgcgctcgcccatcgctggcctccctcactgaagaagagaagagagaagagagaaaagagaagagaaggtgaagaacagagaagaaaaaagatgtgcagctgacatgtgggcctcacatttttttttaactaggataccagcgaaaccacccatatatactgctataggatcttgagtgcatgatttatgtgagtttagggatatacatttctggttttgtggttaaggaacctcaacaaatctcgttgttaagttgagagacctccagaacatattcctgcagggagtgacaaggcccattgtgcgtttcgatcctttttccatagtgaggcccacacaaaataggccctaataatgagtagagcaatctcttgagtctttgacacagttctccctcacgagtaaaatcatctctatgtgctgaatgaaggaagtctcagggcactcacagtgcaagcaccagagcccatgtcttagcccaaaaaaagacccaaagacactctttcccacagtgcaaggattctattttacgtaacctaattgaatggagatactgtggaaggaaaagaatcccacaatgggcgttaccctacgcgcgtgggacacgtgagccgaacgcagtttatttcctcacctacccttctctcctcactgctcctcctccttctctccttctaccgccacgcctctttcacctcgcctcccacgccgctcctccttccggtccgccgccgcgcctcctcgcctcccacgctgcggcggcacgccggggacgcctcgcgctcctcccccacctcccctcgcgccttcgctccttctccgcgagctcaagaagctcgcaggaagccatggcgagtctcgcatccggccccccatggatgacgtcgtcaccaacgcgtcgcggcttcttcctggacgacctcgacaacttcatcgctccactaacgcatcgcggcttctcccctgcgacgcctcctcatctcccccaccagggcggcgtggaggcagggaggggtcggcgtggccaggggcgtggcggcgctagccccgccctagagtgtggtggacgggctcggcgatctcggcggcggccgggaggagggcgcactcctccttggcgttcttggcggcgacgttcttgattttttttgtgtgattttgtgtgactcttgattttcttgtgtgattttgtgtgactcttgtgtgattcttctggtaatcaccgtgacgatctgtgttcttgattttgcttgctaattttgaggattcttggcgcgggagcagaggaattggtggcggcagagggaaatcggtatggcgggaatgggttttgggagggtgaatcggggatttcgcgctacggtttcgacgcgagggcgaggctacgccgcccacaacgcgcgctacccgggtcttctcctcgctgcgcgtcctggatttcgcgaggttttgcgtcgctcacctaggggacgaggaacctagtttaggcgcgggtccaagtgacacggcggcaaaaatccaacgtggcgcgacgaggtcccggtccagctcaccacactgtgagagcactgtgagaggcctcatgtcgtgcatacacaagtactgtctagagtttgtcttcttggagaagacccagaaaaaccaacctttgtatacaaaaatgcttaatagacatagtataagacacccttggatactatcccatcgtcatgtgaagtagcaaactatgttatgatccccttgatcttgtttacgcctttggatttaagatatgtacttaactttttagattagatagttttacctttgtgttactttggataccataactctttatcaagtaatattgattacatcggctatcgcacaccaatgacctcaaaaagtaatatgtagatcacacattcaatatagggtaagttgtatgtgaatggataatagagttggaataattcatagtactagtatgtatcgctccataagttattttgttgtaaatgctcacttacctaacttaggtactatttgtttcagcttaagattattgtaatctcttattaaatcagattactctaaactagattataataagctgacatagaataagctgccaattgtttggtttctctggattattagaggcatctaaggccttgtttctttcagcttggaattattataatccagattattgggagtaagctgaaagaaacatacaacttattgaagtagcttattataatctggtgcccagcttattataatatgataaactcatttaggtgagctttttccagattattgggtgaaaaattacccaccatgccaccccactccctctttagacttgcaaacccaataatctaggctctaataatctaggaaagaaacaactaaccgcttattctactacagattataacaatctagtttatagtaatctgactcaataatctagaatataataatcttaagctgaaagaaacagggcctaagagtagtgggtctttagccactcaataatttggaaaaagctcctctagtgaagattattggattatactaatctagtttatagatttgttaacaaccaaatttggtaatatcggcatcgggaaagaagattagatcgaagcaaagtcggaggtggagatcgagttcggaaacagagcaggaatcggctagagtccagatcggttatgattaggatcggctgggtctgagttgggctaggtaagccgatgcagccgattccgacaatgcaactcgatgtatgacatcgggttgaattgaggtgcttcaaggtgattgccgcacatggatagagtcctgagaagtcaattgtatctattaattaggatgttttatataatttccttagagatatgcttgggcaaaagtctgccgcaaagacttatggtatcttggagtttgttagagatagttgtcgtgtctgttatggacatatcttgtaattttcgggtataaatagacccgagcactatgtatcttttaacacacacgttcaatacaatctcggtgcatcgccaccttttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtaattcgtcgagttatcatatatcctacataatccttggcaatatcgatatccaacctacaatcggctaacatccgtcaatagaaggcagccgattaggttaaataccgatgttgacttagattatataggatatcatttatagatttaactgcggtttctttgcttctatttcttgttgattacaggatcaaatcaactggcacgctcatacattcgaaggtgagctttggacctgcactggagttaagaagacggctcggctcagctgagtaacaaaggtgctaccgacagctctctaggaaatcaaggtgacaattctcaaggagtccatggagtgcaaggtgacggggtgcatggagttcaaggtggtggtgcccaggggttgcaaggaggagatcttaatcagaatagtgatacggcacaagattttttcagtaatttccaagatcgggttgactacgctgtgcatcatgctttgatcaatcaatctggggtgttagtcaataccttatcaaacatgatgaagtccatagccgatggttcaatagctgagcatcaggttgtaggcccggtttatttgcaaggaggtgtctttccaaattatcggtctttgattaccgatgttcagccatcaactcaggcggttccctctgttgcaccaacatctcagccgacggcactggcatcaactcccctacctgctccatcagcaatggcgccaggccagccagtgaaccctcggttgttaatgagagagcagccacaacatggcgggcaggttgcgaatcggttgacccaagatcaggttgctgccatgtcacgtcccaaaatgaccctaaaatatatcctttaaattatgcttagaataattaaaatccttgtgaaagcctccaaaaattaaaatgtgcaaagttaaaagtcaaataaggcttggaggatttttgtatatttcctaaaagcctaaaatatgtaaataaattttagtggaattttcagagcacaaataataattgttaagaaataaacaaagttgaaaaggttttataaaaagaaaaacaataaaaccctccctccctctcttgggccggctcggcccacttccctccccatctctcctcttcccccgtggcccactcggcccctccccgcgcgcgcgccgctgatgggcgggcccgcccgccaccctcgctgacgggtggggcccacccgtcatctccttcctcccgccgctcccgccgcctcacccgcgcctagcgccgccgccgccgcgaatcccgccgcctcccgccgtccccgcgtgcaataaagtggggggaatcattccccgtgatcccctctccctttccccccatttctccctctttctctctcgcattcaaacgggcggatttgctcccgcaaatctcgccggcaccattgatggcggccggacctcccggccggtttccttcctctcccggccgccctctcccccttccaaccctatttaaaccctccccgcacctccttcgcccgtttccaccctttgccgcaccgtctcctcgccggaatcgagctcgtgccgtcgccctctctctcctccgtcgctgacgacctccggccggccttctcagctcgccgggaccgtctcctgtcccggcgtcgcctcgtccggcttcgccgcaccgccgtcgaccccgtccaccccctcgccgagctcgccgaccgtcggagcgccgccgaccccgttgacccgagccgtgccgccgccttcctccgctccggtcgcctttttcgtcgtcgccgtcgacctagggtgagccgtggaccgccgcctcgtttccccctttccctcccctctctcggccgccgctccgccgtgcctatggccgccgccggcgaccataggggggcgtgggcgcgccgcctcccgccgaccgcgccggcatggccgccttcgggcgcgccgagtggccgccgcgtgaggcccggccgtcagccgcccgcgccctcgggtgtggctgacgcgtgggacccacagcgccggtcgatgtgagcccgggtgcgcccggtccaccgtggaccgtgaggctgccacgtgggccccactcccgtggacccggtccgcgcgcccctccctctcggctgacgcaataaaccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatgaagtgtcacgaccggaattaacccaacgggcattccttacgtgcatgtattattccttgtcccaggaggcaaggtacatcaaaagttgatacatttcagagtttatcaagcggaagcgtaaatagttaatttattacatgggcagcgagggcccagcacacacaaagacaaacgagaaacagcagaagactagggcgacgaccacaggcgcttgacggcaggcacgagctagacaccaaagccttcatcttccagggactcctcttctgggtttggaaaaattgagcaagactgagtacaaccaccgtactcaacaagacacacccacaagtgcaggataaatgtaaaggagtacaagggggttatgatataaagggttagggtttgcagtaaacagccttaaaagacacttagttgctcaaagctattttgtaaacacgtttccagagctatacaatattattaaacaaggctgtgaacccacacgagcctgccttaacccaaggcctacgatgattcagaccgaactggcaacccgaccctgggtcccagctcgtcccaagccaacccaggccatccgttccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgccacataccaccacggtatacggacggaagacgtgacatagtttccaacccatcctagtcatagacaagagtaccgacccaaccccacctacggctggaacccccgggacaggtaggcacgactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtatggtagtgctttgcaatagaggcccgaagaccggtccttatatggccgaggtgctactatcaaaaccatgcaccccgaacccagcctaaaaccattttggggattttgaatagagggggcggtgtgaatccaattccacaataatccaaccattccatagtgtccaggtgatgagaaaatcccacagtctagagttgtaaaaccacctaatgttgcctaattaaccagcgaagcatctacctaaaatcatactagtggtaccatgagtagagtgtccactagttggggttttgtttatgctagggtgaacaaggaaataataacaataacaataagaaggtcataacaaaggtaaataggcacggctagataaaacagtgataacgcgggaatttaaataaagcgatagtgcaataatttaaatcaaaataattttataaactgggattcaatatgttcaaggatgatgtgacttgccttgctcgctttcccaaacgtcggcttcaacttccacgaagagcggatcgtccgaagctgcagcgtctacacgaccaacggaaaagaaaaggcttttactctaataaactccatataacaagctgaaacaaagcacaaaaataggttcttgacttcttaaggaaaaattagagacatgaacggtccaattccgagttcaaatggccaagttatggccatttgaagtttatatgctctttaaatgaatatttgcgaatttcttcatttaaatttttaattttaaaaagggtttattgcgtcagccgaggggaggggcgcgcggaccgggtccacgggagtggggcccacgcggcagccccacggtccacggtggaccgggtgcacccggctcacaccggccggcgccgtgggccccacgcgtcatccgcacccgagggcgcgggcggctgacggccgg

SEQ ID NO: 28479 - DNA, 17192 bp, Oryza sativa
cgtcagcggcgcgcgcgcagggagaggccggatgggccgcggggagaggagagggagggggagggagatgggccgagccggcccaagagggagtgggagggaaaagggactttttagagcttttctttttataaaaacattttaactttgtttatttcttaatgattattatttgtgctctgaaaattccactaaaatttatttacgcattttagacttttaggaaatatacaaaaattctccaagccttatttgacttttaactttgcacattttaattgttggaggctttcacacggattttaattattctaggcataatttagaggttgtattttagggtcgttttgggacgtgacatgaagtttattagagtaaaagcctttttccttcccgttggtcgtgtagacgctgcagcttcgttagatccgctcttcgtggaggttgaagccgacgtttgggaaagcgagcaaggcaagtcacatcatccttgaacatattgaatcccagtttatgaaattattttgatttaaattaatgcattatcactttatttaaattctcgcgttatcactgttttatttagccatgcctatttacctttgttatgaccttattattattgttattgttattattaccttgttcaccctagaataaacaaaactccaactagtgggtactctatttatggttccactagtatgaacttaggtagatgcttcgctggttaattatgcaacattaggtggttttacaactctaaactttgggaatgttcttatcacctggacactatggaatggttggattattgtggaattggattcacacctccccctctattcaaaatcctcaaaatggttttaggctgggctcggggtgcatggttttgatagtagcacctcggccacataaggaccggtcttcgggcctctgttgcaaagcactactgtacttccacatgtctagtgggtaaggtttagtttgtggcttagtctggttataaacaaaagtacacggatggagatggacgaagttgggggtcgatggacatctctagggcaaatgaaggctacacgagctgcagcctggtagtcgagatgtcatggcatagggctggtgtcctgctgctaggggctcagtcctgcctacttgtcccggaggttccggtcgtaggtggggttgggtcggtactcttgtctatggctaggatgggttggaaactatgtcacgtcttccgtccgtatgccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacatgcttaacaactaaaatgtggaatggttggcctgggttggcttgggacgagctgggacccagggtcgggttgccagttcggtccaaatcatcgtaggccttgggttaaggcaggttcgtgtgggttcacggccttgattaataatcttgtatagctctaggagcatatttacaaaatagctttcagcaactaagtgtcttttaatgctgtttactgcaaaccctaaccccctatattataactcccttgtactcccatgcatttattctgcacttgtgggtgtgtcttgttgagtacggtggttgtacttagtcttgctcattttttcccaaacccagaaaaggagttcctggatgatgaaggctttggtttctagctcgtgcctgccgtcaagcgcctgtggtcgtcgccctagtcttccgctgtttttcgtttgtcttcttgtgtgctgggccttcgccgcccatgtaataaattatctatttacgcttccgcttgttaaactctgaattgtatcaacttttggtgtaccttggctcctgggacaaggaataatacacgcacgtaaggaacgcccgttgggttatttccggtcgtgacatgccacgtttctgccgcctcaacctattgttgatccaatacagcagcagccgattcagcagacacccccaattcagcaggttgtgcagccaatccagcaacaggtcatgcaaccagttcagcaaacaccaccaaggcagcagcctctgcagccgattcagcagacgccgttaagacagcaaatcgttcagccggtccagcaccaaggttcaataggtgcatcggccgggtttgcaacgcctggtggtcagcctgtacaacaatttttaaatcaagttgtcccagaacacttggttcaccacgtacagccggatggcacagtaatacctcaagttgttcctgagcatttggtacgtaatatccagccgaaccttcataattaccaagggggtaacttgaattaccaatatcagccttcttccccgcaagcccaatatcagctagggggattggctcaacctcagtttgcgcctcaatatggtcagttcgagcccatgcagcaacagtcacaaggggtagctcagcagcgaccatgggccgatgtgattgctgacgtaatgagggaacagtttgggcttaaaccaaaagagactggaagcttgtatcggcagccttaccctgagtggtttgaaagagttcctcttcccaatcggttcaaagttccggacttctccaaattttcgagacaagatggtgtgtcaacttatgagtacattagccgattcttagctcagtgtggtgaagcatcggctgtggacgctctgaaggttaggttatttcggttatctttgtctggatcggcttttacttggttttcctctttgccgtattggtcgatcaatagctgggccgatttggagaatcaattccacagctatttctacagtggggttcatgagatgaaattatccgacttgacagcgattaagcagcggcatgatgaacctgtgcacgagtatattcagagattcagggagatgaggaacaaatgctttagtttgagtttaactgatgcccagttagccgatctggctttttaggatatgattgctccgattagggagaaattctcgtatgaagactttgatagcttgtcacatctgatacagaaagtaaccttgcatgagcataggtctgcggaagttaggaaaaactctaagaaggttaatcatgtttgtccgtacatgtatgggtcggatgatgacgaggacgattctgaaatagctgcagccaagtgggtgaggagtaaaaaggtcataccatgccaatgggtaaaaagttctggaaaagaggagaagtatgattttgatattactaaagttgacaagatctttgatctgctactccgagaaaagcaaattcaacttcctgctggtcatacaatcccatcggctgaggaattaggcaaaaagaggtattgcaaatggcataattctgggtcccattctactaacaattgcaaggtttttagacagcagattcaggtggccattgagggaggcaagattaggtttgatgattccagaaagccgatgaaggtcgatggtaatccttttcctgttaatatggtgcatacaactggccaaacagccgatagggcccgtgcaaggggttttcgggtgaattaggctaagattatcaacaaatatcagaagaagtatgacaagcagcaggagaagtatcatgagaaatacgatgatagttttgatcctcattggggttgtgagttcttttgattctgctggaatgaaggtatgaggttgccatctattgaaaactgccatgggtgtagtgatatcgtcgagaactcaagccgatcatataataggggcaatcggctaaggcagataagagtttatgttcatcaaagattgggtccagtaaatcaagatcatggccaaaaggacaatgtaatcaggaagaatcaatggtgtccttctggtattttcacaaagaatcagaagagaagggttcaacgattgaggaacagggagcgccttcaggaggttgaacaagaaattaatcatcggctgaagaaagcaaagccaaggcaggagtggcgtgttaagaatcaggttcctgcagctgatgatgttgcagctgatgaggcaaaatggttggcaaaagggaaaagtgttgtgacggcaccggttaacatggtatttaccctgccagccgaattcgggatcgaccaagccgatgttgacgaggtggaagaggaatcggctaagttggttctgtcaccagaacaggcagtgttcgagaaacccgaggggacagagaatcggcattttaaaccattgtatataaacggctacgtcaatgggaagccgatgtctaaaatgatggttgatcgtggggctgcggtaaatttgacgccctatgctacgttcaggaagttgggtagaaatgccgaggatctcatcaagacaaacatggtgctcaaagattttggtggcaatccatcagaaaccaaatgtgttctaaatgtggagctgacagtcggcagtaagactattcctaccacgttttttgtcatcgatgggaaaggttcttacagcttgttgcttggaagggattggattcacgccaattgttgcattccttcaactatgcatcaatgtttgattcagtggcaaggcgacaaaatagagatcgtgccagccgacaggtcagttaatgttgccagtgccgatttagctctttgggagatggatggccttgattgtttatctgaaaaagtctgggatggagattttctaaaagtgttcgattttgatatacaaccaattgaagatggagaacccaagctattattttgagggcgtcgtggagggttcaagtgtttacactacggacacggtagatgatctcgatgacaagcaaggtcaaggtttcatgtcggccaatgatttggaagaagtggacataggtctaggcgatcggccaaggccgacatttattagtaggaacttatctccaaagtttagaaccaagctaatagagctcttaaaagagtttagagattgcttcgcttgggagtattacgagatgcctggactcagctgatcgattgttgaacatcggctacctatcaaaccaggggttaggccatatcaacaacctccgaggagatgcaaggccgacatgcttgaaccggtcaaggctgagattaaaagattatatgatgctggttttatttgtccttgctgatatgctgagtgggtttttaggataggtcctgttatccaaaaaaacagcaagggcaggggaaggctttgttttccgaaatttgaataaggccagaaaatatggtctgaggatgaatcgacaaaatgtgcttttggtgtatcggctggccagtttttgggatttcttgttcatgagagggggatcgaggtaactcaaaggagtgttaatgcgatcaagaagattcagcctccagagaataagacagaattacaagagatgatccgcaagataaattttgttagaaagtttatttctaatttgtctggaaggatagaaccttttacaccattgttgagattgaaagccggtcagcagtttacttggggggcagagcagcaaaaggctttggacaatattaagaaatatcttagctctcctcctgttttgattcctccacagaaaggaataccgtctaggttatatttatcggccggtgagaagtcaatcggctcggtcttgattcaggagttggaagggaaggaacgagttgtattctatctcagtcgtcggctcttggatgctgaaactagatattcccctgtggagaagttatgcttgtgtttgtatttttcgagtacaaggttgaggcattatctactgtccaacgagtgtactgttgtatgcaaggccgatgttgtcaagtacatgctatcggctccaatattgaaaggaagggttggaaattggatattttccttaaccgagtttgatcttcggtatgagtcgccgaaggcgattaagggacaagctatagctgattttattgtggaacatcatgatgattcaatcggctcggttgaaatagtgccatggactttattctttgatggatcggtgtgtactcacggttgtggtatcggcctagttataattttccctaggggggcatgtttcgagtttgcttatactattaaaccgtatgcgactaataatcaagctgagtatgaggcagtgctcaaagggttgcaattactcaaggaagttgaaaccaatgccattgaaatcatgggggattctttgctagtaatcagtcaattggcaggagagtatgaatgcaagaatgatacgttgatggtttatatgagaagtgtcaagacctaatgaaggagtttcgactggttactttaaagcatgtctctcgagaacaaaatattgaagctaatgatttggcccaaggggcatcgggatataagccgatgatcaaagatgttaaggttgaaattgcagcaatgacagccgatgattggaggtatgatgtgcatcagtatttgcataatccgtctcaatcggcttctaagaaattgcgatataaggcattgaagtatactctgttggatgatgagctttattaccggacgattgatggagtgttacttaagtgtttgggtgccgatcaggctaaagttgcaaccggcgaagttcatgaaggaatttgtggtactcatcaatcggctcataagatgaagtggttacttcggcgtgcagggtatttttggctgacaatgctggaggattgtttcagatattatagggggtgtcaagattgtcagaaatttggggcaattcagcgagatccggcatcggctatgaatcctattattaagccatggccattccgaggttggggaattgatatgatcggtatgataaacccaccatcgagtaaatgacataagtttatattggtggcaactgattatttcaccaagtgggtggaggcgattcctttgaagaaagttgattctggggatgcaattcaattcgttcaagaacatataatctaccgatttggtattcctcaaactattataactgatcaggggtcaatcttcgtgtctgacgagtttgttcagtttgccgatagcatgggtatcaaattattgaattcttcaccttattatgcacaagctaatgggcaagccgaggcgtctaataaaagtttgatcaaattgattaagcggaaaatttctgattatcctcgacaatggcatactaggttggccgaagcattgtggtcttataggatggcttgtcatggatcgatccaagtccctccttacaaacttgtttatgggcatgaggctgttttgccatgggaggttagaattggctctcgaagaatggaattacaaaacgatttaacagctgatgagtattacaaccttatggccgatgagagggaggatctggttcagacacgattgcgagcccttgcaaaggttaccaaggataaggaacgtattgcttggcattataataagaaagtggtacctaaggatttttcggaaggagaacttgtctggaaattgattttgccgattggtactcgtgatagtaaattcggcaagtggtcgccgaattgggaaggaccgttccaaatttataaggttgtgtccaagggagcatatatgttgcaagggcttgatagtgaagtctatgggcgagcactcaatggcaagtatttgaagaaatattacccaagtgtttgggttaacgcatgatcggctagtattgccgatgcatgacagccgatgtgtttgcatcgccttgagatggccgatattgttatatcgcccttagttgtttttcatgatataatcggttgtgatttgccgatgtacaatggccgatattgttatatcgcccttagttgttttataattttatcaatgcttttgtcattgtaaaattaggggggcacatatatatcaaaatgcaatgcaaattttttgaggcaaatttttttagcgaattttaaaagtcatattaatcggcacaaaggattgttaagacagtaaagtactagagcatcttagctgattacaaaaaatttctgagtcctattacacaaagttattgagacaagtatcgctggatagccaaaatagccctttgcctgatttgttctacttcttcaatagcttgggcatcttgagcatcagttccagagatgactttcagagacttggttaagtcagcaacattcttgatagccgatttgagccttgctttttgttcttcaattgattttgggagatcggctagctttttgtgttctatatctagctcggcattgcattcctcaagttgcgccaagagctcaattttgcgagcttcgagccggtcaatattggatttgatcagaccttcagatagctgatcaagtttggttttttcttcatgcacaagctgccgattagtttggattgtggccttaatctctttgcgatcacggcgttcggctagtcttagcttggctttttccagcttgaactgatgttgctcgagataagcggctagagttaggacatcggccagatcttcgggaatcagagcttgaacttcatacagccgtgtcctaattgacccacggtcaactaccaaactgtctaaagaagaggctgctagccgatgagagatgtcttcaagtgtttttctcacatcatcggataggggagctagggctttgcttgaagtgtcttcttctgcttcatcaaggtaatctctgatgtcaaaagagaagagatcggctagagcctgcagagacaatttcggaaagaataagagctgggtaaattatagctgatctaattgttgagacaaagggaaacttactgggatagcaggagcagctggttgttcttcctcttcgatgtgatgactccccacagccgatggagtctgatcacttgacgattgctgtataggaggagaagtaggaggaggctacgaaatagacaagtgttatatataatcagttgagattgattaagtaaaagaattaaggacatcttactggtggagccgatttaacaattgctgctgttttttttcttcacagcagttttcttcttctgcaaccacaaagtctatgggtaattagccgaagagtgaggtaatttcagaagaagtcagagagaggtacttactcttgtaaaatgaacgggggcgtaaggagttggaggcgtttgcttgggtgaagccgatggtgttctttctgtgtcactcatttcggctacagcttgatcaacatcttcaccaatttcctcgtcatctaaagcttgttcaatagatggatccaaggcgggcagatcatcagtcgacatatcagttggttgtggttgagttttcttgaatttggtctttttctttggagccaaggctaaggtactcatggctgatgatctggttttccttttcttgcctgcatcggctggttctctagttaggccgtgaaggagagttgaagtcttgggggcatggtagccgatgaaagggggagatagtccacctccattcggaattagacctgaagcatattcaatgttcttgccactgttactttgatgaggaggggaggactctgttgtctgcaaaacaggagcaagaggtcagtcaagtaatgaatcggctaactggttatgcaatttagtaatgacaaagtttacctagggcatgacgtcggggaatagatctgtcatatacattgaagcggattgatgaaatagatgcagcttccattcgccccaccatctgtcaaagtttttgcttctaaatcttgccaactcaatattatcaatactgcccagagagggtcctggtaggttaaatagccgatccatcattagagtggaagtgatttgtcctcggcactgaatcttgtcggcaaagaataagccgattgggagttggcccaatccaagttgtctggccgagctcattgggtgataaaactcgtaggagacttggatgtttcttccttggtgaatgccgatagggaggatgcatgggctgattgcagctataagaatttctctggatttttggatttttttcatggttaatgtcttcaaatctaaagtctgatggaagttcaaggtctgctgagtcttcgtagggaaaccagattcgtgcatctttcttaaaaccttcgtagaaactgcagaaccagtccttgagtaactcagccgatagcttcgctccagcatcggttggtgtggatgcatattctccatatgacatgcatctgcgatgggtacgctcttctccgtcatcttccacaatcggctctggcaatgggaattcagcttctgtcacagagggccgattgacaaccttcatgactaccaggtttaaccaagtttgcagcagccaccatggtccacctgctccaactattgagccgacggctattttagccgatgcattgttcaacatctggtacagatagccgagaaggattttgcccaaaggaaattctttctttgattctaaggcttcagttacgaattgccagttggttgtagggccacaactggatccatagaagaggaatttttccagccacataagcaagaaagctacatgctctcgaggggtaacagacccttggcccatatatgccgccacatagccagaccagtcacctatgcttttggtcttgaagtcgaattggttcttggtgttcatgctcatagggttagccgatgaagttacatctaatccagtaatcatggtgatgtcgattaaagttggagtcatcggcccttggttgaataagaaagcattgatggtgttggaccagaagtaggtggcggcagccatcagaggttcatccttagcagaattggctatggtgagagtgagtgcttggccgattccaatttcatcccagtgaactttcttactagccgatacgcgttggtaccaggtggtccagctcttatcaggagtaggtttttcgagagatggccaagacttgaaggtattcttccagtgacccaggttagggttggctagtctaaaggggatccggttagtttcaccgatgatgaaatcagtggggtcgagattcgagattgccgattgggccaagaaaatagtagtttttgtgtgaaaggctgggaatcgtgactaggttggaaaggtgctgcaaatccaaaggaattgagaagcagaaaacgtgaggagaaaaggagaagtcgatttcatgcgaggaaaagggatctagctggtgaggacttacctcagcgtactcgaccgatggcgcgatagaagggctggtggaagacgacatcgccgcgggcggagatttggtcgggaacgaaatcgcctggggatcgccttgtgcgtcagggagatcgccggagagagagagagagggcaaagttggttttagtggcgaaaacggaggaggacggtgtgagatttctcgagggtaatggttagtatttaaagcatggcagtaacggtcggaaaacggcaaagtgcgaaacttgctcggagtcgatttacagcaaatccgaaatattatcaaatattctggacttggggggcatgtgttaacaaccaaatttggtaatatcggcattaggaaagaagattagatcgaagcaaagtcggaggcggagatcgagttcggaaacagagcaggaatcggctagagtccagatcggctacgattagaatcggctgggtctgagtcgggctaggtaagccgatgcagccgattctgacaatgcaactcgatgtatgacatcaggttgaattgaggtgcttcaaggtgattgccgcacatggatagagtcctaagaaggcaattgtatctattaattaggatgttttatgtaatttccttagagatattcttgggcaaaagtccgccgcaaagacttatggtatcttggagtttgttagagatagttgtcgtgtctgttatggacatatcttgtaatttttgggtataaatagacccgagccctatgtaacttttaacacacacgttcaatacaatctcgacgcatcgccaccttttttgctttagttttatttcaacgagttcttgctttcgggttgagctgcatcggtttcgatcttcaataagaggtaaaacttgttatggtggcttgcgttctcgggattagtgcttccatctttatgacactctaatcttgtttatgtaattcgtcgagttatcatatatcctacataatccttggcaatatcgatattcaacctacaatcggctaacatccgtcaatagaaggcagccgattaggttaaataccgatgttgacttagattatataggatatctaccactctatggcacatccaatggcttgattgtctagatacggcttgacttaagtttgaccttataagtcgtgattagaatctcaatctctagcccgcttcttggttgctgattagggtagtatcggagtttcagccgatcttacctaatttaactgctttttatcctatatgcttgattgacatgttaaatctgtcctttacgttaagatcttgctgcatttaaatatattaggcttgtgtttagtatattctacttgctttaatatcttaatatagagtagtatcggagtattagccgatacatgctagatctatctgatcggctatgctatgaacgtatatagtctcattattaatatatatttcgatctaagtgatttatactgtctcggcatagcgaccgatctatcccaatcacttgatttaagtacgtattgatataaagattatatattggtaatatctgcagccgatcgagtagattcagtcctttcttatttattaatgactgccgatcgatgcatatacgacatcggctgaaagataaatgatatgtcatcggcacctagccgatcggctatcatttatagatttaactgcggtttctttgcttctatttcttgttgattacaggatcaaatcaactggcacgctcatacattcgaaggtgagctttggacctgcactggagttaagcagatctccaaggcctcgtgttttctgtcaacaagattataataatctagcataataatctatttgtttgtttcagcttactcctaataattcagattataataatcctaagctgaatcaagcggggtcttagtttgttgaaaaaccacccattacgtatatgcttaactgaatcaacatgtattttaaagtgtcagcgttaatgtggtctttaccaaaattaaatacctatagtcttgatacttttttgggtaagattccacaaacaaaattactgacaagagcttaaacgttctctcattgagttttgctatatgcacaaaaaaaagttcaattaaatatgaaaataagtctaatgtaagcacttggataaggttgaataggcttagcttagcctgtggtaactctacatcagtgctaacaggttaattcagttaagcacgtacgtagtgagatggttttgcaacaaaattaagtaggggtagatatttgcataaaatgatttattatgggggtagaatgtcatatgagatgattttggaatttttctctattatattttagagcggagggacatgagatttaattaaacacatccactataaaactcataggcaacaatgagatttaattaaacacatccactaaacacatccactatcaaaagcaaaacacccaccttgtgacacaaacccaggggctactgtaaaccgatggagtagaaggcacaaccgcacaaggcagcagctgaaaattgggggaggaagaagaacaccaggaagggaaagcattacttcatcattaacccactcgcccaagcataaatccgccctccagttcatatgcccctcttgccgaacatgaccgttgggcgctgtccccttccagatcccagatatactaccacccctctctccccccgcatcgcccccacgattcgtcgcgttcgcgtgctgccaaatcctcctccccctcctccgtccccacaacattctgtcgcgccgattcgaccgttgccgcctcgcccgctccgcgcacgcgcgcacgccgctcccgttcccctcgcgcacgcgcgggccatggcgatcgacctggcgccgctggctggggagttggaggtcgcgggggcggcggttggagggaagaaagaggagggggagggggaggagggcggggtgtgcggcggggaggccgtggtggtggccgcggcggacgcggaggtggagggccacccctacgacttccacgtgtccgggccgcggaacctgccgccgcccaactggagggagatcatccgttcgagctggttggtttccggttactctctccatgtttccttgcgaaatcttagttaattagtttgatatatgcattttggcgttatggagatatcagatatggtcgtcatgggcgtgaatctgtggggatcgtttacgccgcgggcacccttggtttgttgcctcttctgattgatcggaaaagggactatgttttagggaggggattgccgtccggttgcacccggctcccaggattggaaggggagggaatatgctagatgaaaggcgatagctttgttggattgtaaacaaggaaccgaatttactgctattttcaggattttgttgcaatctgcactggcgcaagggtatagcatgcattaagattaaaatctccaatcgatcacctcacaaatgtctgcacaacatttaaactttttttcaatgtcttttctgatgatcctgcgattcggcgtgtcagctttgtgtttagttggttagtgttgcgcttgcgcgcctacaagtaataacctacaagtcaggttacagactaccatacccagagttttgcccttccttccatacactgtttcgtgaggcatgggtatggaaatgcacctaccttttcttacggattgagtattcttcttaaacaagaaagtgaagtagcagataatcagtgattgaaaccaaggtcctgtgggtggtactttcctatgggatatgtatggacttacttttgttgaagaggtgcctttctaattctcgccccttgtttttatgaccttcaataataatcaattatacagttctacactctattgctctagtttttaggctataccatttcaattggacggtacaaactctactggttgaactagagttatcactacagttcccttgcttcgtgctatagtacttggacgtagtctctaaagcatgggcgggaatgggtcacagaattggtattccgaaaaagaaatattcacagaattgcacgtttcgttctgaacattataagtgcttaggatgtcaggtcttagtaaattccaatctgtggcaagcatacaccagtattcctattaataacgtaatttcataagcggatgaaagcttttcacgacttttggtgaaaatggaacatgcaaatctgataattttagcggacaggaggtgcattaccataccaaaaaaaaaagaaataataataatatgagctatttggtttcttttgtcaaagtttgtcagttagttatgacatcaaatatatttcgatttgacctcatacatacaagaacttctggtaatgcagtatatgctttgtatgcgtaaccaggtttacttcagtgtatcacacttgttaatttgtatctgctacctttagttctaatgccatcaatgttgctttaaattgattgcaggaaggatcccaattacaaaaggatggtaatggcctgcttcattcaagcagtctacctgcttgaactggacaggcaagatgagaaaggagaagaggatggccttgctccaaaatggtggaagcccttcaaatacaaggtcacacagacattggtcgatgagagagatggttccatctatggtgccgtccttgagtgggatcgttcttctgctttgtctgaccttatcctcataagaccaagtggcgcgccaagggctgtgttagctctccgaggaacactgcttcagaagcccaccatcaagagagacctacaagatgatcttcgcttcctggtgtgggagagcttaaaaggatcagtcagatatattggcgctttagaagcactgaagacagcagttgagaggtttggtagcgctaatgtcagtgttgctgggcactccttgggagctggatttgctcttcaggtttgcaaagagctcgctaagcaaggagtcttcgtggagtgtcatctgttcaatccaccttctgtttcacttgccatgggtgtaaggagtatgagtgagaaggccagctacctgtggaaaaaagttaaggctagtctaccactgactgaagaagcattacctgacagtaccaaagaggagggaagtgcaaagaagaaattgcgtgctgacaagaaatgggtgccacatttatatgtaaacaacagtgactacatctgctgtcactacaatgcccctaattgctccaccaccaccaccactaccaccactgatggtgcttcagatgagcagcagcagcaacgaaaggcaagtgagatcgctggtgatgtggtcgcgaagctttttgtgacatcgaaaggcccacagaagtttcttgaagcgcatgggctggagcaatggtggtcggatggcatggagctgcagctagcagtgtatgacagcaagcttatatacaggcagttgaagtccctctacacagcaactgcaccgtcaccccctgcaaagtagtagaaactgctgagatcgctgtttcaactggcgttagaaatactctttctaatcagtttctgcctctattaacttgatatgtttcatcatggttgtgactgtgaactattatacagtaaaatataataaacggacatgtgctgataaatacattgatatttttcatgttccatcttctgtcagaggttttcaagactctaaattgttacaagggatataagggatactagtatgtctggataccgattagcatccatgtttatgattatgatcttttgatggtgcacttggctgatgttcgtagggtgcaactgtgaagcttttccagaatgaatgtagcatggcaaattagcatccatgtcatgatctttcgatggttcgcttagctgatgttcgttgggtgcagctctgaagctttttcca

SEQ ID NO: 28480 - DNA, 6931 bp, Oryza sativa
ccagcagtgcagtcgtcggtgagcatccattattcaggttcagcggatgcatcctctgacggcgaccagctctttatattgaggtgacagtgaagaggtcactttggaccacaaaaatttacagcctcctccttgacaacgcattgttgagcagtgcctatgccttgagttgagcgatcgagtgacctcaattatatggaagcatgttgtttgcttcccattgatgattcatgcgtccccgcagactgcagaaaccacatgacagactgacaatggcgacggaatgctagctctctcgtatgcactctctatcagtatgcagtagtagggaatcagggataccccgatgctaataaataacttttacagtggtcgctactggtagtagaaaacaattgatcaagactactacaatattttaccgcgagaccgatttctatgtgagttcagttctaataaatccgatccgtctcattgtggccttctttcctttgtcagaaactcagaaggtgattctgatttctgacgctgcagatggtaattaggaggtgacaaaattcagtgagcttcgcatgcgcagcagaaacctgcaggctgcagctagcacccaagggaagctgctgccttttctggcaacggggccttgtgtttgtgttgttgtgcatagcatagactttgctttgcttttggtatggagcccaatctttggtacatgtgtacgtaccgaatggccttgctcttgcaggaagcaatgttcctgtctcgtggacaaagctaaatagctaatgcaggctgtactggtcattaactatacacaaacccaatgatccagaacgctttatttggcaattgagttgtaataagggactaatagctgataagaaatgcagcagcgtaccgtggtttagtctaaaagataatggcctggaatgcaggatcatgactactgattaagctgctcctactaatggtcagtgtcctccttcctcttttgcctctcattttgttcgtcgatagtacatcattgcacgatctctttccctgagtaaagctgatctctttcccttcttttctggctatcattatttgtatggcaaatgctaacacttaacgccttgttgatctgaataacaataatgaaatctctacctgtcattcataattattcatccatgaaccgagaacagtcaaattcgtctatcttacaatccaattccaatcgcaaatggagtatttttttttcacaagataataggcatagggagaacaagtggcttatttaagctcagatcgagacctatcaaaagacgagaagaatcacattggtgccacgcagataaatcacaacatgaaaaatgtgaatcatgcaaattcggctaaattccacttatgttatctccttgctatgtacagattacaaaattacgtaccgactattggtcaagtcactgctgcaacaaccaatatcatcgacaatggatgcaagaaagaagagaacaaaaataaaagagagagaaaagggaaaaaaagaaaaagaaggtgaagaaaaaggaatgcacatcgctcagcattcagcaaccacaagacccggtcgagatcaaacaggcattgaaggcgatcgagtcagcggccggccggctcatgggcggcggcattggcggcgccggcggcgggcgcgggcgcgagcgcggcgtagtgcgcggcggggcggcggccgtcgtcgaagttcttggcgtagctggcggcgtcgtagccgaacgtgatgggcctggaggaggcggcgcccgacggggacgacgagctgcagatgcacctcgtctcctgcgccaggcgccggagcagccgccgccacgcgcggtggccgcaccaccccgcggcggggctgacgtcgcgcaccacgagctgcaggctccggaccacggcggagccgcgccgcctgcccgtgccgccggcgccggacagagaaggccacgaggacggcaggcagcccgatgagccgccggagacgacgttggcggcggggtggcgcgccgcggttagctctgtggtggttgtggtggtggtgcccgctcccatggtggtttggagaggcgcgcaggaaggaagaagtgggagagagctctctcgtggcggttatacctgtggttatatgggaagcgagacgaataatagcagtattaggctgttagcatgtcgagatgagaaaacaatggtggttattgggctgcggagtagacaagtggtagagtgagatgagctcatgggtttttgtggtggttacttttggagatggaatggacatgcatgggagcttgtgctatttttagacacaagaggatgagtgatccttgtgcagttgtggaatgagtagttagtggattataatttaattactgttagtatcttatattcgagggaatatgttaggaaaaatgttagtgatggatagtagcgaatgtgattttcaaggtgcatcttgtacttttttaaaaaaaaaatgtttgagccactgtaaatgtattactatctccgtttttaatagatgactccgttgattttttctcacatgttacatgtttgaccattcgtcttattcaaaaaatttacgtaattataatttattttgttatgagttattttatcactcatagtactttaagtgtgatttatatcttatacatttgcaaaaaaaattaaataagacgaatggttaaacatgtgagaaaaggtcaacggcgtcatctattaaaaaaaacggaggtagtatgagccagcatatttcctaaacagggtacctaactaaaattgcatttcaaagattctaaggacgtcaagccgtcttgttgaccataagaaacatttcaccagcacaatttttatgtgcagcttgattaggaccgtcgtccaatctacactagacattgtatgcaattattccttcagatttgtttataacgatcatgtagtggtcctctaatccaaaacgagatagtggttggttgtacccagttacccacaccacgagagatcatccagaaactgtgttctgaagccacgcatactaatcttttgagcaaatcacaccctatctcatgaaatttgatccatctgcaaaagaatatgatattatgattacctaaacagttagcctacactattcttctttgtttagattatcccggtatcccatctctaatccatttttgggccaacctccaagatcaaaagagttttaagtgccggggtatcatgtactactcatgtagtcatgtgggttgggtttgccgactgtaccaattgcatacgttgtccaaagctcctgccgatctgcgccactacaaaatgcccttgaaatcctcgattttaggttcctcccgatggatttggctgcgtctttccaccgcgatttgcaggtgcgaagccgctaacgcaccgcaccgcaccgcctaaaattgcgctctaaactcggctaaaactgctatagcacgagcaactattgattatttagtcgtgcatatctttccgatgataatggcagtttgctctcaagtggagcagtaactaacaaccgatcgactttgtttagcaactgaatgatgtagcaagctgacaggttgaagtcagcatagcgtgccatgccagctgctaggatcagaacgcccttgaaacattttatgcatgataagaacgagacagagtatcaacatggagagatcttctcaaggcaaaatctcctcatagacaagctgaaaccttactttgccagttctattaactaaaatgagttgaggaagctaatgtgacggtggggaaaatctgaatgaacagccagccaaaccatgaaaaactctcatttctatggctatttacatttgttaatccttaaagccttacccagagttaattctaatggataaacgcatactgtgcactcattggagaaccatgctacattcacaggtaattcccttcttttctgatcactaaagtttccttgaagtaggaattacatatccatctttgtaccaacaacctgtcagaaagctactagatgccagtgcacaaatgacgcattggtaaaattctagcagattaaacagactgaagtttccacatcaacggtttgtcttctggttaaatagggcttgacttgagggcctatacatcgatagattagtaaagtcagtttattagaagtatgtagaggtagaaacctatgaattttaattgaataacgtaatactgcaagtaccttgttagaggatgtaacggcagtcctccattgtggatcctgtgtaggggatggtctatccctgaacaaaataacaactcttgattgtgtgggcctttctactgtctgccgatgaggaatatctttcatgacccatagaacaaatcctgacggtatggatgatcctgcaagagtatccgaagtaaaattaacaagtggttgtgccatctctctctctaaaaaaaaaagaggcttgccaagtgctttcttgagaatggaatattatgttcgcaataaacatgagaaaatatcaacagaaaaaactattatacaacatgcattctgattccagaattattttgattgattggatgcctagtaaagagttaatttttgtgactaggcaattccactgttgcagttcaatgtgtgccgtaaatacaccatgcaactaattatttttctaaaatcattcactagtttgatggtgttgctccctacagttgagttgcacaacattcactaagtatcaggtaaggagaactaagaatccaacttcaaagtggatatcataaatataagaacaaaaagaaatgtaagttctgacatgattgcaatatatcaactagcagagtttgagtatttcaatctggtactacacatagaatcattagatctagactagcttcaccctgggggtatgagaaatgaaaggttggataaataatttatccacacctaccaccacacttactcatttcactaacttattgtattaattcccacatatggttccatgttggagcatgctcacatgcattcaccatcaggcttcgaagcatgtgcacataataagcctgatggcacaccacatcctaccatattttcccattgcaacatgaactacatttaataaaatgttatcgttcaatttaagaggagttatttctagccatagatggtggagagatacctatgaaatagtacataaacaatatgatagcattgttgatgatgtattcatctgctgagtaccaatacacaagcacctgcaacaagaagtatagcaaattgatatttagcaattcaagaaccagctagtggatatgtcagctactcagctattattgtataaatcagacttactggaacattggtaacaagtgctagtatagcggacgacgagaaacaaatcagtgacacagtagctaaacttgcaactgcagagaagcaagcattgatatagagaattacagatccgaaataatatatccttgaagattgaagaaattcggatagactgaatggtcctcgtaaaaacacatactatttttcataatttatgctactatatatgaaatactccagtatccagccaatagtagagccccgcttggcccatggtgtggtgttagtgcaactagtcccacatcgagagtttacataagttggggccagcatataaacccgtacattgcaatcataacacttctgagttgacccttttacacaaaaggggacaaaagtgtaagtgaggtgctctttatacatgggctcacttctcagaagagctgggctcatacagattattgaagcaggagtacgcatataggggcatcctgttttttgtcatctggttttataagcactatgaccatattggaatgatatcttaaagtatagaatttatcagaactgaaaccaaaagttgtatcttttgaatatatgaccatttattcaattaatttaatattgtatacgatcattattagtttgctttctcatgattttacaaaatacaatacatgcagcaaatgataaagcagtagagagatgcaatccacaaattgaatgattctgcaagagttataccttccgcttctcagatgatccagtttcagaacgcactttgctcatctttgaaaatagtattgcacctttaaatgatcataaaaaataaaagaaaagggcaagtcaagaacatgttgaatgagaggattactggtagcagatgaaggtcaaattatttagtaaggcggatgtgaaactagatataaagtgaaataggactgtgagactcattcaatatttaatctactgcgagggattagaaacaagataataagagtttatcttaggttgaaacaattgactagaaaacatcatgcctaatattgcgacataattatggtatggtatagatgagtatacataggctatgcttaccataacatgccagcgcaccaccaagtacaagaacaactactgagaatacatccaagtaaacctacaaaataaaatatttggctaaacaatcaagtcacaacacaataggtgattaaataactattgatgaaattggtgagcttgtaaatttatcaagtaaactaatgtgaaaacatgaataaaaagtgtgtgaagaacaagtaagatacaagtcataatggagacaattgtacttatagcatcaaacttatcacaaatagaacacataggattttgttactctactggaccatctctaacaaaaattcatgtttgatctgatgaatttcacattgttgtgtctacctacctaaccttgctgtgcataggtttagaatgcattggcctgaataggattgtttactctgtgcctacaaaacttagtccacaataatgacagatttgtgcaaaccacaacacatcagtgttggaact

SEQ ID NO: 28481 - DNA, 13105 bp, Oryza sativa
gcaacacctccggcgaacatcaacagcacggatgccaggtttattttttgttctatccagtaaagcctcatggtgactcctcgtatcctcttcatcttcatcgtttgtctggtgacacaggtcaaccctgtaagaccattattttagagaaatatagagtgaaaaaagcaactatgaaaaggaaaaagaaggcagaaaaacatatgcataataataacatgattcatgagaaagcaaaaaattgacaatacaaggttcatggcatatgttatctcatagaaatcgttaaatcatgaccatcatcttccccctttttgtttcaccctaacatctctaatgcaatcctctcaaacgtcgcgtggtaaaccaatgcataacactgaacttatacaggtttggtcctcaagatgagaccttactatttctgatgcaccccaccaacgatttgtggttagatacctcaagtgcaaccgttgtggcaagtgctacaagacatgttacagcttagaactgagctaaaggcagtactagtatgtcttttgcctatacaacgacaaggagtgcacaaaccaggtgtatgaagaaagggaaacaaagtcttctacagtaatgaaaaacactcttcccttgccccttcatgatttggaagactgttattaggccccattggatgcttgttggcatagaaagaccctaactcagactggggagcaatatgtgggttacgtgatcaccttccatgtaccctatcaccatggtgaagtgagcaaaagtaaaaggaaaagtgtaaaacccaaacctcattgaggggtagggcttatctccaataagtccatacatggagaagccttttcgcataataccactttgagcaaaagaacattctcttatcacactgagattgcaagcatagatcgccatcaataataaatcatatggtgatcataccaatcaatcgtggtcgtcatatggtcatccaatcaactggataatgtccataaccacgaaaaagaggtgagtaatgcggcatgtatcagagattatatgctaacgagtaatagactaatagtgtcatgtggccatcttgtattgattataagaggtcaatcttaacagggttacccagacagtaagtcagtaagatgatttaaaattattgaagtccaaagaaattataatgagaagatccatcagttttctaatcaagcatcaattaggaatgttgttttccttttatgctcagatggtttgactggtcatcatgcatgacatattgacatagcctatgctgtagttgtagaggatatttacttggtctagattagataactaagaaataagaattggtgtagtccaataaaaaaactggatatgttcgtcaagtgacaattctttcaagtggatatatgaaacagagacatagtaaacaagaacgggaattccaaacaaatctttattactctcaaaattattagcaaagctacatgagaaatgcattgtaagaaacaagtgccgactcaccagaatgacaacagcaacagaaaagaagcaagaagcaatatctgtggactagctgcaaaatattgagaatgcacaactattaggtctggtcagaaaaatagcatacaataaaaggtcatgtagataagcagggaaaaaaacaaaaggacaacagcaaagctatatatccagtaaaatatacccatgagtacaaatccacatccatggacccaacaaagccatctctcacaggtagcgatgatgtagacacgaaatacacaaggaatactgccataggattgggaaaataaaaatcagagttagtaaaatgttggtaatcataaaatatgcaaggaatactgtcaaaggaatggataatgaaagtacacatgattgacctgattcactagtagagataatacaaatactttatttagaaactagtcaacctgagaagctgttagtgaagtaacaacatttttcttcttataaagttaaacatcagtatatttgattcattaattgtgcacaaattaagacaagtgatcagcagtcatgtcatttggtgtaaattggacctatttaaggagagaactagcatgtccgtaatagaaaaattgcaaacaaaaatgagatctattttctatttcttaatcaaagcttcaaaaccagaatataaatagttcaactattccttgtgcacatggttcctcaatgtcatagtggttgcattccagcatcataaaagaggaagctcgctcaaaaacttgaattgtaacattttccaattgccattagttaaaagtttaaaacatggatagcaggaaccattcagaacaattaagacagtcattaactactgactacattatgcagaaatttccagtgcacaaaaaataataaagaaacctcaagcaaaataaagggaaaaaggtattatcatagcaatacagatctcacctaagttgcataggccaatcataaaatggaatatctgcaagaacgtaggcatataacattaaaaatctggcagctgagctcacagcacagagggaaaaaaaaagtgaggcactaattagcattatttaatatcctactcttgagctctcattcgaaaaccctacagcccacgtattgaagtaaaatgtcccataccaaggaaacttgctacttctgtcaaatagatagactataaaacacattgttgttttgataatctatagttatgtttcattcatgagaaggtcacatgattacacatcattaaaggtatgcataaatgaaataacttttgggggttaacatttgtaaatataattatataaacaaagactatattgcaattcatccgaaccttggaatcagacaaactaaataaatgcatactgaacatgatataaagtggtatgccacaaatagtaccattagtaatctaaattactaaagtgtagaaagataactgaaggatgaagacaatctactcccgtattaactataagaaaagtattatagagtagatgaggaagcctagtatgaagcttgagatatccaaaaaaaaaaaaaaaaaaaaaaaaaaaaaaaaaaaccgggataaggaggttttgcgcctggttattttttagcctccaaactgtcaatgtaagtgactagccactagatatagaggtaagcaaaagcttccaaccagagataaaaacatatggacctaaccacatagctagagcatcagccaattaagtatttatccatgataacaatagagatattatttagtgcaagcatatgaactcattgcaaaacaacatatcagacagttggacaacatgaaaaatagcacaaataggaattgtgcataccttttgccgagtccatccatgctgctgatcatgcctgtggattcttgctagctgcaaaattggaagtgcttaataccgagtaaacggatttaagagatcagattaagtaaaggatttaggtcaatttgcaacagagctcattggtaatgagtaatgacaactactacataattcaccgagtaatataagtgcactacataactatgctacacattgctccactatgaccaaaacatcgttccactgtgaccaaaacatcaccaaatagtaacattatagcaatacccagagtgcaataaccttgcaggaatccctaggtgaatagcacatgacaatttatgtggctgactgatatctaattctcgtaaagagcaaaattatcattccaaaatctggcactcccccattccccgtcccgctagcacactaccgccaacgcgcatgacatgcccgtctccccactccctgcccccgccatcagtcgcggacagagcaccaccacgagataaccagatcgaattgcccccacacacgcacctgcacgaaggcggcgactgaaatggaagcgtcgatgacagcgagcgcgacctccgccgagataacaggcatcggcaggcatcccccgccgtctccggccgcggcgccgcgggacatgccgtggcggcccatacgcccgggcaacgacgagcggcggcgaaggaggagagagaggaggaggaggaggaggaggaggagggtgaggatcagggggccagagggcggcggcgcatctcgcggcgggcaggggatggcccagggctagggtttggtgcggaggccggagcagcaggcgggagcggaggcggaggcggaggcggccggaggagggtcagggaggaattgactggaggaggccgcgcctgttggattggaaagcgccccgagacctcggttttttagtcgtggtggcctcggtttctagtcgtggtgtggtgccggggtgcgtggctgcgtgcgtatgaagtgtggtccatggtgatgcgcggggggatccccacgtgaggatgggggcgtgtaaaccgtgaatatgcgaacacgaagggcccggaataccggattgatgggctggattcacgttcaccgtcggtacaacagtaagcttacgttggcgtacacccagggggcttacgtttgttcgatgtagatgtactacaatgttgaaaaaactcggagtaccatatgaagtttgttcgattttattttgaaacggagaaagtataggatagactatttttattgtgtctattttgtttaaatttctagatagataggattagtttttcattaaactatttttattatgcagtatatgtatatctggaacttttttctatttatgttgaattatccatactcctattatataggatgttattgttagcgtcgtccttgtaagaaaagcaatctgatcgaccttagtacttataggttgtttataggctattgacaattggcctaacaattagaagacaaggagtgtggttgtgtgtggggcgcaagtggagcgggagcatggatagacggggaggggatagagcatggatagacggggaggggattgcgagggctttacgctagtacaccactagatattttctttggtcacgacttaaatcgacttttttttttgtttggatgaaacattagagtaaactagatgaaaccccacgcattgcactgggatattttgctgagattggtagttgaatttgataggctaaagtggtataaaattatttaaagaaatattgaatttgatctaaggctcttgatgtcattgactatcttgctaaagtggtcatacatatgttgctcgggcttttagcattcatcacaacaaatcactcgaattgtcccttcaagatctccacatttgactcacggacgctatcaatttagtttgtgaaaaaaaaaacgcccaacatgacatatcaattttggcttccaactggctaatttttcattattattattattattattattattattattattattattattattattattattattattattattatgcacataatggctcaagtgcatcccttatcacaccgttagagagatggaggccaaccgtaaatccctaattttaagggaaccataatttgtaagaaaaatggacagaggccctgtttagattccaacctttttattcaaacttttaacttttccgtcacatcaaactttcctacacacaaatttttaacttttccatcgcatcgttctaatctcttcaaactttcaattttggcatggaactaaacacagccagagtaatgcgcccacaaatgccacaactagatcagtagatcactcattcgcttgtgctcacattttcagaaccgtgccaaagcatgaaagggaatgatcagcgtcttgctatggacatgaggtaagctgcagcatccatctcatatcccacaaagtttctccaccaattgcagtcgacaccggtagtcaacttctcgattttctttgttccgaggttaagcgcaaaggtccagggactgcttcctttgccgagggtgaacaagagggtgcaactcttctcgcagaaccaccgcagtttactggcatccgcactcttaatcttgaactggcggcgcaattgtccgatgccacctttcctcacccattctccggcaccaccacacatgtcatctccggtggtctcaaagaccattgatgccaaaccgacatatcctgaggaattcgctgcgtcgatgaagcacagcttccgttcaggtgtgacaccaagcagacgaaactgctgaatcgtgctgataatgccgtctagcggcatgcgcacctgtgtcggctgcggcgtgtcgaggactcgaggcgtactgctagactgctagtgtcgttcttcgcagcggccagtaggcgacggcgtggagcacgatgccgtggcctagcttgccaaggtcccagtttgtgagcttggggcctggcgtcttcttcgcctccatgctccagctgccggtgtctgatgagtaggaacggaacgcggtaaacctgtcacggttgtagacgatgagcacgcggaagaagttggcggacggcggcggttggtcgatgtcggcgtcggtgagcaatgtgcatgcgtacatcctgggcctgtctttgccagacagaggcggcagcacggccacgtcccccgtcatggggttgcagacgcacaggttgagcttgccgtcgttgacatgctcctcgctctggagctcgagaacgaggcgtccgttgcgggaggccactgggcgtgagagtgatagatccaggaggccaagggcgtcggtctggacgcctaacggcagcgcgctggcggaggggaggttgtagccgaggaggcgagagccgaacgccgtcgggacgaagcacgggggcgtcgagtagtcgacgatgatggcccggcgtttccgcttgcgcgtggtggccacggcggcggcgtcctgctccttgtggaaaaagccgagggcccggccggggaagaagcggaagcgctcgtgacagagcgttggcctccttggccaccacgctggcccaccgcctgcacgtcgcggcgcagcggactacgtcggccgcgttcggcagccgggtgaaagtggccgcgagcgcgtcgtccgtgagagacgtcccgttggcgtcgtactccgccgtgtcggccccgctactccggcatcgccgtgacagccagcctccgcggtacggcgagggacgggcggcggcggcggcgcgtgctcgtccttggcgcaacggtggcatcgtgcgcgcaacagattggaatgaggtaacgatccaagggattcagcgatcccgtacttatggccggcgcgaagcgcgagtccgactcccaagcggaaaccgtcgccgcatcggaatatccgatgcacggggcttctcgcacgaccgccgtatcctctccctcctgcgccgctttttctggttgagcagcgccgccgaaaacggcgtgccgctacgctcgccccccgctcgcgttcacctgcgcctgggcacggggacgcggctaatgaacgcttatccccatccccccgcgtcttctcttcctactagaccataaattaaaaaaaagaggaaatttcacaaaactaaatattttatggtttaagttatagaaaatcacacatatattaacacttggcacttaagtacatatattttggtagtttagttttacaaaaccacactatcgatgaatagtttcacccgtgatattatgtggttgtttcatctagtctgaggacgtggtatcatattaatttcgtgcgatggctgataatagaatgtcatgtcctcgtcctaggtgaaacagccacatcatctcgcgggtgaatctatacatcgatagtgtagttttgtgaaactacataaccaaaatatatgtactttaagtaccaagtgtcaaaatgtgtgtggttttctacaacttgaaccacaaaacatgtagttttgtgaaatttactctaaaaaatatataaaaaacaaagttggaaaaaattatgtatagaaatatataaaaaaattttaattcaaattcaaatttaaaatgggtatgtaaacttttgacttataaactttgggtctataaactaatatttgaattcaaattcaaatttgaatcgggtatgtaaacttttgacttataaactttgggtctataaactttaggtgtatcaactttagatgtatagaaatactatatatataaaatatttgaattcaaattcaaatttgaatcgggtacataaacttttgacttataaactttgtgtctataaactttaggtgtataaactttagatgtatagaaatactatatataaaaaaaatatttgaattcaaattcaaatttgaattgggtatataaacttttgacttataaacattcgctgtacaaactttagatggataaactttagatgtgtaaactttaggcgtataaacttaataaaagaggaaaataaaaaaacgatcgccgccagcgatcaatcgctcattaggactttcgcctgggcacggccacgctccagcgcgagaaaattgacattttaccatcgtaaaaaggtattcgcccaaataccactatacagctgggattgaccgaaataccattctcaattaaggggctctgcccatataccattttcttccaattatctctttactctcatcattattaaccaaaatgctcctagttgaatcaatataagtatatataaatacgtagattataaagtaaatacgccaaaaatagttttacatgttattttttttttctctacaccagattacatagtatgcaacgtactatctcaaaaactcacaatgttttcaatgatataaaaattatttttatttatgatgtaaagatagtgtcttatactctataatttagtgtaaagaaaagaatatatatatatatatatatatatatatatatatatatatatatatatatatatatatatatatatatatatatatatattgcatgtcaagatatttaggtgatatatactctgtaatctacatatttgttttacttgaattaattcaattaggggcattttggtcaacaaagatgagaggaaagagagaattggaagaaaatggtgtttcggcgaagcccctcaattgagaatggtatttcagcgaatccgaactgcatagtggtatttagttaaaacctgttttgactcaggatgggaatggttaggatatggattgaaccaaacagttttaagtgagtttgttgatccatggtttaatagggtcaatccatcatgagtccattatatcactaggttatccatagatatccaaatggatcggctacattactagtagaaaaaaaaactcttatcacatcccttctttctatatagttaagacctaaagctgaattgtggttgagccacgtcacctgtaaatctcagccattgaatctaatctggactcttggtaacgcttcaatcccagcccacttctcttttatcgccatccgccctaccgatgccgccgccagatgcggtcgcgctcccttctcctgcccccgcgctcctttatcagagataacgttagactccctttatcagcctcgtgcgggcacctaaagggtttgtctgagttaatctccgacgtcaaccaagaaagtacagagcatacgactaagtcttccgtcttgctgtaatcgagaatttggattgaagtcaagaaattttatctcggcgggtacaccatctcttcattccgcattccttgtcgatatccaccaaccgttctcgagtaatcgagaaggcgcagagtctgcgacggagccttgtcaacatttgtcgtactcgccttagtcgaacttggtgtagaaccatagagacatggaaccttcgataatgtcgaatagaattttcctgaaatcaatagtcagaaaagaatattagatagaaatagcccccgagcgaacgctcaaagggtaacatgttatagaatgtatggaaaactgaaaatgaattaaacatacagaccaatgttttgtatatgagcatctactcttttactgacttcgatcagtcagtttgttgagttatacactctccctagcccccagccttgtcgtcggagaatcattctcggaagataaggctcttggacctttgacatgcctcggttaaacaagcactaatcctagcccccagccgtgaagttggaaaatccatttccgattacacgacttggttaatacgcacggcgagaactcttacacgaccagatcttacatggtctttcgtctctgaaggatccgacaaggccttatctgctctgggcgtccccagccgaagttcccttaggttcctcagaggccttgtcaagacggcataaagggacattaggataggtttcaacgctaggtatcttttgtggtaagggatctctaggtaaaacacttggcgatattgtgtacctgatatcaactttgttgaagtagaggtaataggagaatcgctacacctctggtcaagaaccaggtagtagtcgtaactcaaccactagaagtaaatgtacgagagatcgctacaattgactggttgaggaccagtgagtaggtgtctctcgatcatttgaagtcgtagtacaaggaccgctgcgttattgctgcagtcgtacctcgaccatctgaggttgcggtgcgagagattgctacgtactggttcgaggaccagtgaacgagtagaattatctctcgaacaccaatggatgttgcggtgcaggagattgctacgtactggttcgagaaccagcgagcgagtagaatcatctctcgaacaccagtggaggttgcggtgcgagagattgctacgtactggttcgaaaaccagcgagcgagtagaattatctcttggacaccaatggaagttgcggtgcgagagattgctacatactggtttgagaaccagcgagcgagtagaattatctctcaaacaccaatggaagtttgcggtgcgagagattgctacgtactggttcggaaaccagcgaacgagtagaattatctctcgaacaccaatggaagttgcggtgcgagagattgctacgtactggttcgaggaccagtgaacgtgtagagttatctctcggacaccaattgaagtgctagagttggtttattacatgtgcatctcatgtagccagcatgactcacgcacccaacttatagcatatccagatgtccgttcgcaatcatgtcgggtgatcaagccgacggcgttcgcgaggagttatccgttaacaaccttttctcgagtagtccagccatggccggtgctatgagataggtcatcggtcttcgttggtaggttaggtgcgacgactctgcatttgtcgagatcgttctcgacaatacggtgtacttgaccacaacctactcgagtgctcaatggttcctgaaaaatattttctagaaggtaagacatatagcagagaatatcgagtatgtatttgaaaaactgtatggatcttctagtattatcaggatatagcgagcagatgtaaatatcaggcattatgtaaaccgtaaacaagcatgatttatacggaagaaaatagggcgagctcccagcgttagactgtagtcggcctaacatcgggaacactcgcacgacagatattgtataaaaaacatgctctagataaacataataaattattgattgaaaatatctgaaaataggtacggtaaattgcatataaaatattgcgtacctttgtaaatacatgtcggatgtatctatgaaattagtagattaatttaaaaaaccaatctaccaattaccttgttgcgcactcgttcgacatcatacgatctaacatcttttggtacgctgcgaagcttgaggcttggatgatctcgatagaccaagttgtcgatgacgacgatagttccgatctcatcggagcatgtactctggtcgggttagatctccacagccgaagtcgtcgagtagcttggagaatccatatcttaaacccatctcgtcaaaatccagaagcaccaaaatctccctacctggtgcgccactgtcgacgtttgatgtcacgattccggtatttgcatagtatggggatcgttggtactaggatatacgcgggactgaggtaaaagagacggacacagggatttttatataggttcgggcccctgaattgtcaggcaataaccctacatcctgttggccaaagccggtattgctcttattcaccataatcacaccagtacaatatttgggatagcctatctaactgttgtcgacatggcggtctgaaggtttgactcgtagtcgacaacagggtagtcttcctcctcgagttcatgcccggcgagatcaaagacagcactagatccctacggctggcctctgtagttaccggatagggtcgatctaggcatatctctgatgtcgatatctgacgtcttatcttgacgtatgttggcttgtattggctcgtggctttgtggcgtctatgttgtctgtatcccctctcctcctagggggccttgtatttatacccataagtgtccccttgtctaagtagaactaggaaaaccaatatagatacaatccgagtagtccttgtcgtttccatataaaactctggttgtctttccttatccggaactcctcctatatccgcaggttgtttccgtataggacatggtatgtggtgggtcctgccgagatttagtcaactactattaggtatgtggtatccataaccctgacacatttactcaccaacaatgagccgtccatcaccggcgattaattccatttatttccctcttaagcctctttcagttcctctttgactaaaatttttacagggctattgctttatttttaacactacacactatactttattcactttcaatttgatgacagtgtcaagaaatccatttagttcccatccgccctaccgatgccgccgccagatgcggtcgcactcacttctcctgccccgcgctccttctccgtcccgcacagcgccgcgcgagctgcggcgcgggcccgcgctcgcttctgctctgcacccgagcgcgcgagagagagatgcgccatgaaacgctccttcccctcccccgctgccggtgcgctcgcttctctctgcccccatgcgcg

SEQ ID NO: 28482 - DNA, 20938 bp, Oryza sativa
attatcagtatcaattctgtgagttgttattcgttcttacatatatggtgaggattataatcatttggttaatccaaacttcctccgtttcgcaaatgtaagtcattctaacattttccacattcatattgatgttaatgaatctagataaatatatatgtctagatttattagcatcaatatgaatgtgggaaatgctagaatgacttaaattgtaaaacagagggagtatttatcttgcagagataaattccttaagcaattcacaattcccaactgaatggtttacataacttctttgagatagcaaattgaaggtatgcatatatgtcaaaatcacgtctttgcctcttgcgatggcatttgttttgctgtgatctttgaaggttttaatatatgcgttcgtcagtatccaaattaaatccaaacgaaatagttcataaatttgatagatttggagaaaatagttcataaatttgatagatttggagaaaatagttcataaatttgatagatttggagaaaagaatattgatgccttctgttttttagtatttctttatttctattactgatgttttcttccaagcttcacgccaacatatataggaactatgtcagtcagtcacaaaagtaccgatttggaaacaatactgcagtcagatatgcgctctccatgctgatctccttcagatttcagtagccagaattgatctgttccccttctcctaatcggctgttgagctaccgatcatctccctctaggagcaaaagcatttactcaccaacaatgagccgtccatcaccggcgattaattccatttatttccctcttaagcctctttcagttcctctttgactaaattttttacagggctattgctttatttttaacactacacgctatactttattcactttcaatttgatgacagtgtcaagaaatccatttagttcccattcatccacatgacaatgttgaaaattgagttaatttatgaactctgctaggagtcattcaagcgtattggatgtggctttctaaaaactgaggtatgtataccaaaaatttcagcatttatgtaataatttttagcttttgcattcgtcctgtgttgtttgctgcttggtcgctgtattgttgcagctgccctgttcgtgctgacctggatatgagtttgcctctctttttactccagaatttgtgtttactccaattacgagttagtatagaatagtggctatgtttttttgttattatttcgttcaaatttatgttacacaggatttaaacaagtttagatcatgagactacagatatctgatgacgttgttacaaaagttctcatcatgcatatattttagcttatgcttataatcaggttaacatgggcattatatatgtcctgatacattccattcttctgattgctatttgatttacgttttgcccaagttctgttatagaacctgtcatgaatccatttgatttgctattatcttaaaaagatattaaaagttttttgtaggctttaactttgataaactggatgcacatgcatttacttattgtcagtgcaaatacatccttgaggcatcttggatgatcccatggtgttttaattagttaggaaattttatccgctcattcctctaccgcattgatccagtcagtgctcgctcaaatttgttcattatacatacattggcacattctttgcatgaattgacaaaataccatatggaaaacactacagtgattgtgttcttgatcttgcttgctacatatctgtattatccttaatttcccgcagcaacgcgcggggtttcatctagtatatgtaaaactcggacccaaaatttttaaactcgtgttcatactataaaaacttatcgatttcagtcgaattttggtgggataatttattgcacagagaagcaactttgtgtaaattttgagcccgttatacacatggggcccacaatgcactactaaaatactaaggaaatttcattatatgtgtgtaaaactcggacccaaaaattttaaactcgcattcacatttaaaaaaacttatcaaatttagttgaattttgtaggaatgatttattatatagagaagcaactttgttcaaattttaagccatttagacatgcggggcccacgattgattactaagacccaaaaattctagttttaatgtgtgtaaaactcggaccaaaaatttttaaactcacgttcacactatgaaaacttggtaaatttagttgaattttgtaggaatggattattatatagagaagcaactttgtacaattttttgaatcattttatacatgtaaagttattttgggttgaaccccttaaacctaggttctaatggtttgatccatttatatttttggagcgacaaaaaaatccattaggacaaatttacggatagttttagtagataaatggatcgaccctatgtaagtttaagtgccttaatttggttttggtgattaatgacaaatctaattatatgagactaacgtttttatgagcctttctttgactagtcttatttggatatgaaagtaaaaatgatgggaggtatgtattaaacttcacatattctaacttggtatctcttgtggatccaaaatatagtgtgagctccctcattgatattgattgattatgtgcatatgcattccttcatatccatatgtatgcacatcttgaggggagcttattctatattttgttcattataagatctctaccttgatttgaaattatctttcatatcatctctttgtattgtttatatcggattattatctatcacaaaagagagaaaagattgaaagatcttggattaaacaatttgtgtaattgttactttggtgatagatgataaacaaatgtttatgggattaacctctcttttacataagttttcaacaaggttatttcccgataatgagatgtggtagatatgcattctttggtgatggaccttaatcatgacaaggatgaaattcatggagataaagcgatatgtatcacttcttatctcctactttttgataggttcatatatatgatttccatgttattgttatataagtgtgagactaatgtttacttgagtcttatcttatttagtctcctttacattgagaacatggagatcatgaaggtatgtgtttttttgtttatcttcatcattactacatatgccttttctatgtatataggataaacccccattggtttttctttaattatgcatacacttgtctctcttgtatatttctttgtatgcatatacttagggggagcaaatcctatatatttattgtgcatgttttagatccatgttgttcacctattatatatatcggatctttgcacttgagcttgcatacaagtatatgacacttatgatgttaatgaatactcaacaaacatatccatatctttcatatgcaaccggttggtcaccaagtggaggatgccaaccgatttgttgggactaatgttttcctttgaaccgtgcaaaggaatagatctaattgcgatgaggctaatgaatgacaccatgggttaatggtcaccaagccaaggacatcgtcatgttggcaagaataaagtcaagcttgtgatgagaataaagtcttgacaaaggatggcaaagacctcggcataaacatggttcaaccgaatggtcacaagtgttgatgttggctcaagcattgaccccaagttggatggcgcaaggctaaggtataatggagctaagaatgttttcttagtctttttcccggtcttggtgtttggtgtagaccggatttactagataggtgccgtactatcaagaggggtctatgaagcgagcatgtagatgattttgtgccatattagttcatatgcatataggtgcattttgtgggcttgtctagccaagtgtggtgagttttatcaagtcccaaacaaagagagaagtgggcacatcctataggtttgagtagcctcatgtggttatgtccggtggagtatcctttggagtgtgagccatttctccctgagaaaagttgtgtttcttggattgattgttcatgggttggatagccctttgaataagctttccatagagtccgagaacgccaaattccgagatccgagtcaaaagatatcgtcgttttactgacggttggttgtgctgaaaagtgacctgcggtctgaccgtgggccttaggtcggtctgaccagggctgttagccggtctgaccggcgtggtaaggccggtctgaccggccctattggtctgttgcactggtctggtttttggtggcgatacagagccgccagagccgcaactggtcagaccgagccgatggcggtctgaccgagccgtggacggtctgaccggccgcttcattgcggtcagaccgaccaggttgagtagtccgttacaaagtagtccggtctgaccggcagagcacagagttggggatttcgactccaacggctagttttggtggttaggggtatatatacccactctccagcagcaagggcaaggttttggcactccattgcattatcttgaacccttgcaagagctctcacacccttgtgcacttagtttatctagtaaggtgttagagagtgagttaagccaatccaagtgcattgcttcattgttatagctagtgtggcacttgatcatcctcggcaagcatcctagacttgttactcttagaggttgccgcatcttagacggcttgtagaggtgttgcccggtgacctctccgagaagattgtggaggaggcccggcgccggttgtgagtggtttggagttcaccaccttcggagtgaaggaagaactaccctagtgatcgaggctttggtagttctctccgtgggccggctcccgccttgcccaccccttgacgaagggggcgtgcggtggtttcgtggttgagcggtggagttgggctcgcctcaacggggattaggaaaccggcgagtttccgaacctcggtgaaaattccttgtctcttgtctcctttttttgtgcaaatttactttgagcaagtttacatactttgtgctattatcaccctaggcttgcaaacctcaacataggctagcttctttgtgcacttacttgagactagttgatttaggtttcgaattgtgcaaaaccattttgatttacgcttccgcatacaaaactcggttttagccaaaagtttgaaaaaccgcctattcacccccctctagtcggccttcttgatcctacaccttaaccattcccatcctgagttttgacgatggtaatatggtattatgccaattttctcctactcggctccgcgccgagccgcgcgagctgctctgctgccccacggcgcccgtgcggaggccgccgccgaccgcaccactagcagccctccccaaccatgccaagcaaggcaatcatctctcttgcggcggtgatgctcctcggagcaacgtcccggccatttgcgcctcaaccacgatgaatttgttcctctagatcatccccatgtcgtcccgtgccccacctccaccacccatcccagccaccggtcgccttcgtgtgtacttcggcgagccccaccggcgctcctagaccccgtcgtcggcctcggcttcgccggtgtgcctagttcccggagaccgtcgccgccgcacccaacctccaccggctccacacctgtccctagctaccgtggcgtcacccaagcggtggccgtggttcccctgggcatcccatcgccggccgccccccctccggttggcgcctccccgtgctcacgcgagagaagagaaaaatctgattaagtctaatggaatactctccatcccaaaatataagaatctatgatcgaatgggacattttctagcctgtctagatttgttggactaggaaatgtctcatccaatcataggttcttatatttttgggacataagtagttaagttaactaatactacctccgtcccaaaataattgtatttctatgattcaaactttgtcccaaaataattgtaattttagagtactaattgccccatcaatcatctatcattcaaatttctccctattatacccttaaccatcttcccactctcacataaacaccatttaatgaggggcaccatagtctttcttctcaaaccttaatatatgataaacaacatagaattacaattattttgggacggaggtagtaatcagttgtccctatgacatatgggccatgactactaataaaaagtgtttaatactacctccatcctaatatgtagcaacaaggatgagatgagactcatcctaggataatgtatatagacatgcctcatgtttagatacattgacccatcctaggtaattacattatgggacggagggagtacttattttgtaagtttgtgatactgacaactgggcccaccatttataaaacccgtcacatctgacctcacgccgacctccatactcgctgcctcgattgaggagggaggagatgacgagatggattagtcgggaggttgagagatagtggagagagatgggagaaaaagaagaggggaggatggacgaataagatgaatttgacggattggtcttacgtgtagatgaggaagatggatgtaactacagtgggacagttccaattttataaaattttaatggcacgacgacaaataaataaattgtaatggcattttatctgaaatgatatatttacaatggcatggatcgaattgatctatataattcatcatccccttttcgtgtaacatgtctacattgtcaatatatcacaaacgaaacgattggagtagtaatattattggattaaagaaaaacagaagcaaagatttggagcttgggctccaaatcagtgaggaaggagatatccaagattactaaataatttgttattcacaattcctaaatactcctaaaattccttcaaagaatccaagattactaaatgaaataaaaagtagaaaatatgtatttttttagtttgtttaacatgtttttgaaaaaaacaaattccaaaacaacctaacaaatttatgaaacctgtttatttattgaatgtatcactatgcaatttaaatggaaagcatggaaacattataaatgcattggctttgatcattgtttattttatttattaatcacccttatttattaaatgtaaaaacaatgtactttttcttgaaaacaccaagaggagttaatatggttagtttggataaattaccaatagtaaggcaaataaagggcctacgttgggatagaggctaactttgctataacttcatttgccataggtatgacaagtcacataaaaatgtgccaaataatttgttatccacaaccatggcaatctttagctatgacgtatgggctcatgtgctaataaagtgattttgtctaatctttgtcatgcaactagcctaagaaatcacaccacatctaaggcttggcaaacttcaacccctaaccaaataacccaaagtattctcacgtactcccgatagtttcgatagtttttggtaatttatgttgcctctcgcaagattgcgtggagctattagttgtattgcaaaattaacctatttcacccatctaaaaatatacgtattttgtgttgcaaaaattacctaacactatttcaaaatatagttatttttatatgttttatcgaaaattactgttaagatgagaaatagttgcgattgatacattgagatagggaagtaggtactccatccgtcccattttaagtacagccatgattttctgtgcccaactttgatcgtctatcttatttaaaatttttttaaaaaaattaaaaacataagtcacgcataaattactattcatgttttgtcatctaataatgataaaaatactaatctaaatttttttaaataagacggacagtcaaagttgagcacggaaactcatggccgcacttataatgggacggagggagtaaaaaaagatttatattttagtatataattggaatcccgtatatatttatatttttcaatgaaggaattctatggaatgcaaatcaattttcaagttgagatcacttaacattggtcctattaaaaaaagtccctaaatgctactccctctatctcaaaatataataagtaatctaggtctagattaaacataatttagtataataaatatttgacaaactaaattatgtctaacatggagggagtaaaaagaaaataaaaaaatactactccctctctctcaggtataagatgttttgatcttaagtttgacaatgtttatagaaaaatagtaatattttcgatccaagataaatttattataaaaatatatctaactattaatttaataaaatttatttaaaaatataaatattactgtatttatctgtaaactgggtcaaaataaaaaaatatcataaactaaaacgtactcagcactcactcatccagcgacacctaggcatctctctggaggagtcgtggtcaacatacaccacgtcactcccgcgctcctccacgcttcttctcctctgcctcgtgcacagcgccaggcatatccatgtccatgtccatgtccatgtccatgtgctggaccttggcgttccatgctttcatttacttctggatggcagcagcagcaacgtgccagtgccagcatacatcatgtgctcagctgggcgctacgtgctctcgcctttgcgcggattgcgccggccataaatgaaaaaaacggacgaggagtgcaccagcgaatgctgcaagaaacgagtcatacttaagtactgtaccctactgggaattatctaatcgaaattcaaaagtcacaagcattctagcgcaaagatcacatgaaatagcctagtttctttcctttcgatacaaacgagggaagatgatttcttagttctaaccatagtcaggcacaccaggaatttgcaagtacatcaattgcacaacggaatacgattagaatgctacactgaaactcacggcagaatcgcacaaaattcaggaaattatgagatcacttgcagaatttgaaaatttagaacttataattgctagtacatcaaaaattcagaacgggaacagcgcgatacaaaaatttttctccaggagcaaaagaaaagaggcaacagcaacaagcactccggtcaggtgcaacgtgcttggctcacaaaagaacaagaagccaaacagaactgaacaggccacgcgacggccaacgccgagaaggttacatgcgatgcgaagttgtgcgaggagatgatgatacaggcgccgccctttcaccaggcttcaggtcggactaggacgccggccgccgccgcatcgaagcagaagagcacgcagatcaggtacccatcaggtctcgtcagatgttgcagccgcagcagaggaagaagctgcagagcgcggcggagaggacgacggcctcggcggcgtagaggacgtggaagagcgcgtcgtctaggagggatacgaccaggccagccttctccccccacctccacccgtagccgccgccgccgccgccgccccctcgcgccccctgcaaactcaccatgcctcctctcgcaaattccggatccgcgcgagcagattgatggatggatggggatggctctcctcctcagctggtcccccggcccggatggagatttctttgtttgaaatcttagaagtggaagatgatgagcagcagaagggctgatgggactgaagggtttttgtacgccatttgctggacttatgggttaattaggcccacgtttttccgttgcttagattatttcctactagcccaagttgctttcacgatttcagtacggttaatatagtgattcttttgccataaaaatatagtgattctcgtcttctcgagctgctatcatgggacctagtatgtgtgtttagtgcttagtgctgaagtatttaaaaacgatctgggttattggtaaaggaaagggaaatgttcctcgagcggtgaaacctaatggaaaaatcatggtttcttctgaatagagaagtttgtgtttttcaatcgggaagatatgaggttttgcttttgggtgtaagattacttaaaccacagatttgggcttactgtagtttctgagtttaatgtttaaatagtattgcgtgagatatatactgcgaatttcacaataaggatactgttttcgactaactgacaatatgtttcagtttcttcgcctttgaccactagctactcttaaataattaaattttgcttatatttatggacactaaacacttcaacatcatgacattttactaagtatttgcaaatatgttacacgagagacaagtggtcaaagtatgaaaataaatagtgtcgtataatttattcagaagcaaagggagttgtttttttttcccacgaagggtcaaggtgatatatcaaggcactgttcatttctgattccgaattttcatttgcacgcttcttatgcttctaaacggcgtgtgcttaaaagcaaatatttataaaattttatttgaatacttttctaaatatgactttttaactctgtagtagttaatttatttatttatgtcctcagatagtataaaaatagattattcattaatcctctaatttcaattatctcagggtttgtttgacacaattctagctctaactccatctctcgtggagctgaatgttagccaaacagtttaatgtccattaaaaatagaagtaaaactagatcgagcgctctaaacaaataaatatagagatgagactagtttaggttgctccacgaaacatctttgaaatgtttaggcaaccgatcacctgcaagattgtaagcttttattgtcagctcgtaataggacgcaacagtaataggtagacaaatccattcaacacaaaatgcatagcctttcttggcactccagggcttccaaagtaatggagcaattccatgctagattgaccctaacgaagacaagagtacaaagaccagtctaaaaaagagagtagtacaaagctaaactattccgaataatctcgccaatgcaaacagttgatcaactcttcccccttagccccatctcaaattcacaatcttgtgagcgaattcagagatgcgaataggaatattttgtacgtgtgtgaatacatatgagtaagtgcgtaagtattgtgagtgtttatatagtttttttaagtattgtgagcgtatgtgtttatacagtgtttaaaaaaagatcatatgaaaacacaagtagcaaaattagtttcatctacctaatataaatccttttagttgtgagggtagaactaaaaatccatatatatcgccaaattttacaacccaaatcacaagggagaacaaattgaaattgctccacccttttggctaatgtttcttaatgtgtatgaagtgtactccctccgtcacatgaaaataaatctgtagaactatgtgcaaattcctcctgtcaatttgcttttttataggatataggaagtacataaaaactatatataactactcaaaacaacccataatgatcctccattgatttaaaatacaatgctatttatatttcctacgcatattaaaaaaattcaaacgagaattcagctgtttgcaagacgcaactgctttattttccggattaaatcttttctggattcaacaaaggcaacgtattatggaaacccgtcttcccgaagctgacacgggtttctgggtgatgtgcattcataacccgcaagtgtgagcccggaagtacgctctcgttctccgcatgcgggttgcaatcctcgcggcatccttggtaatccccaaacgccagggacagtagcgaccttgcggccgtctccccaaaccagatcggcgtcgggtctttgccccttttcacgagcccaccagcgcattctcgcagccggagagaggaggcggcggcggcggcggatcgaggagagggagcggagaagatggggggcggcatggaggtgcacaagaacaagtggatcgaggagtggaacgcaggccgcgagaacctcgagttcaacttccgctggacccgccgcagcctcgccgtcgtcggcctcttcggactcgccgtccccatcctcgtctacaagggcatcgtccgcgaattcgtaatcccctcctccgaaccccccctcctcttccttgccgtgccctcttgggttatccaggtcctaacgaagaatctctctctgtgcgtgcttgtttggttgcagcatatgcaggacgaggacgccggccggccgtacaggaagtttctgtgagtgctgcctccggtggatgcctcgagactgcgaccgggagaaggactctccgttcggtttgttctccatactgttttaattggacagggagtattttggagtgctcagactgttgcgtgggatctgtttgttgaataagctgtcatgacttgttgtcttttcaattgctgaaatcttggagattttattcggttaattcggctgaataacagtgttgcaatgttgtttgtgcgttcttcaggtactaattagaaccgtagtttgcttgtctcatttattaaaatctgaaatggattacagtgaatggttttagcatgtcgtttctctagtgtggcctacgtagtacgtgctattggattggctgaatagatgcagaaaattgatagcaccgatgcccatgaggcaaggtattgaccaagaactttcttacgattaattatggctttgggagtttgagtgcattgatgttatacgggctgtttcatagcaacccaatgtaggctctaaataaaattgtatggattggaagctgcactgaggcactgataaagtaataatgatcattattcctatgtggcttggatgagatttcatttctagtctcaaaattattgtactttaccactcttcaattatacttgttccttggccactatgccctgtgtatttgctatacatgagtaggtgtctaggaccttttcagtttttgcctataaaaacattaagttactttttcttcagcacttgctagatatgatggtctgagtctgtgaacagcctaactggttgagtagtctcagttgcctggcaaatggttcatagcttatttgcataactttactgatatactgtagtatagctagttttttttttcttccttagtattttcatgtataaaacttcatatattcacagcgtttagtatagatgaaattgttagttacaatagctgtaactcatcgactaccgaaacaacaggtaatgctatttgagcagacctggagagagaacaggatttaattgcttttctgattcatgttgatggaaatgataggtaagagtacgaacagttttctgataataagttctgtagagttagcattcttgaactgctacagcagagtatgccactcccttttttgtggaaagggccaagcttcatgttgatggaagtacagttgactttcatcttgctatattattattgtattgtctggtgaagtcttatggaacatcttgcatactgatgatccattgactccagttatccactgaacattttcagcaaagtaatagatgaaactgtgaccataggccacatggtattagatgtgttgtgttgcatacctgtccatacacttctataactgggttttgttttctattgcactgtttcaatgagatttttttactgttagtaagaaaggtagattttgtgattttcttttgttggatatgttaatgtagcgtggttggttgaaagggcatgttttttacatactaggaaactaatttagcctgttctctatggaaaagatggtatgctagcaacttcaaaatctttgctgcttatatatggagtatatatatttgcatttgatcacgcggtcgatttgctgatgcaccattatcatatcatatgtacctatagcctccttcaaactactgggtatatatgttagattagacttaataaggctagagtattgttttaaaacatcgtgtatttggatgtcaccccatgcaccaattattagaaaaccattgtaaccatctcaacttgaacatttgatatctttaatttcttttatataactaaactgtcaccgtctcatccactccaatagctactgcgttgtatgaaacttgctagttcttgtttagttttttgcttccaagatgtgttcctgcttactgctggcgtgtataatgaagtatggactcaaaaagtctatgggtgatggagtgaccaaattgctatttcaatttaccagttgtggataacttcacagtgaccgtgttttattttagtgcattttttgcttgatctttagttgtctcttcgaagttcttaagaaccttcatcattcatgggctgcctcctttattttgttctgagcttctaaaatggaattaacataactgatgtggctgggtttactctttccttctgatgttacatgcggttcttatgcttagtaccaaataatcacataaattgcttttgacatgtcagtctaggttgatatgtcatcatagtggcacccaaatgaaaataaaatctgcctcatatgtcaaaatcctgaatctctctctcatagctacgactgacgaacttccgagcagaaaaaacatgagcggacacgttgtttctgaatattgcaggttgattgctggccatacttgtctagtgatgaatggtgatacaagtatcgaagccactgcccagaaaaaaacagaggtcagcctcattttgtgtattaagctgtcaacctatatcattggctcgcaagtgctctgccggtatctgaccaggtctacctggttaatgctacacttgcataaaaaaaaaatccatgactaagttcatgtttagcggtttagtgccatttctattcctcgtggttaatgctacacttgcataaaaaaatccatgactaagttcatgattagcaagtttagtgccatttctattcctcgcacaatccaatcgaactctgactttgcacggtcaatcttatctaacactgatagctactacggcaaaagaaataagaagagtagcctagtcttttcatggatactaccaagtttcgcctgtgcgtctgttgcttacgtcgcttgaaaattgaagcaagcaagcgacacgaagatctgcacggccaaagagaaaaccacctcgtggcgaactgcgtccagctcataggtatatataagctcttgatgctctctcctcttcttgcccattagcattggacctattggtcgtttagtgatcacgctgggagctgcacgtacgttgcacttgcacgccgcgcaaccatgtccagcccgtcgccgacccctcctgctccccctaatcggcctccacagccacctccttcagcaaatccgccccaatcgccaccagctccccctgatcggcctccacagccacctccttcagcaaatccgccccaatcgccaccagctccccctgatcggcctccacagccacctccttcagcaaatccgccccaatcgtcaccaacaacacctccgccgtctactccaacaacacctccaccgtctcctccggttattccaccacaacctcctccagggaaccctccaccacctcctccggagaacccaccgccgcctcctccaggaaatcccccatctcctcctccggtgattccccccacgcctgctccagctccacgtcctccacctccggtggacccccctatgcctcctccagtatttccaccaccaccacctccaccaccttttccaccaccgcctcctccagtgattgccccagtcccagcacctggtccggcccctactccgaatccggtaccttccccaaatcctaggcctaatccgcaattcccacctcctcctcctcctcctccggtgttcccctcaccacctcctcccgtgagccctccacctcttcctcccgtgaaccctccaccaccaccaccatccagaccgaggccgagtccaacaccgtctccacctccgcctattgcaagccctccaccacccgaggtccaaaactctccacctccgccgccatcacccccaccaccacaggctgtcgaagcgccaacgacgtcaccctcaccttcatcatccaaaagcagcgggaccacagtgggtgtgggcgtggctgtcgccgcggtggtcgtgatcggtctcgcggccgggctgatctacttcttcatcggcaagaggcgccgtcgccaacagcagcctccgccgtcattgccaggtacatatgctcgtatcacctttcctgggaaacaaattccttgccttcgcgttataaaggcacggcgccatttgaaatatgaacggttggctaaacggacggcataggtatattacgatgctgtatcgacggttgaagtaggtgtgtcactgcagctggtgcttgacttgctccttcatctaacggttgagatcgccagaaactatcgtcgcagctgatagatactcccaccgtcccaaaaacaaatccattcctagcatcttaaggtagaagtagtagagatgaagaataactaaaatacccttaataattgattaaagtagtaaaaaagatatgtagataaaaggtattgaagaaataaaacttatcgttttctgtgctaaggataggtaagatgtacggagggagtacgctttacgcttaaccttatcacacgcttgcacggctgttacccacgccccagtttgtttgtggtgtgttacagtaattccatctatttacttttgattacgcgggcgtcgagaatgatcatggtcaattggacatgaccattcaaattaaaaggcacatccacaccattttgaatattttgccagtgctaaccattatcgagttagcagcggtgtggaataaatatattttacaacataaaaggacaattacatgtttctcacatgcaaccaaatacttcctacatctacttttgatagtcatatttcatcttggtacatagactaacaataagtgattctacttatcatccatttaaatatgctattagtcatttctcgtaaacaagcgattcattaatatttacatttctcaatgcccatgtagctaatcttgtgtggaagaatggagagtcacgcattaaatccaagaaagtcattaagataatactccctccgtactcataaaggaagtcgtttaggataacgacacggtctccaaaacacaacttttgacttcttgtttctataaaaaatatttattgaaaagtgatatatgtatacttttatgaaagtatttttcaagacaaatctatttgtataatttttatattttcaaactcaacaacttgagagttattcatgatttatattcccaatttttgacttaaacattgctctaaacgacttcttttataagtatggagggagtaagttgttagattgaaatatgcctatcaaaaataaattttttagatttggaaatatgactataaaagtagatgaagggactagttgccaacgattttgtgaaataatttgaatacatcgagttgaacatgccactcacatagattctcaagttcaactcgagctacagaacaaataattcggctgtgatagtgtctatgctgattatttgcacatttcggagaaatgggtagagtgcgaggacacatactatatataatcactttcttctttttttaaaagatgacgtcgttgactttttgtcactcgtttaaccatttatcttatttaaaaaattatgtaattataatttattttgttatgagttgtttaatcactcaaaatactttaggcataatttatattttatacatttgcataaaatttttaaataagatgattggtcaaatatggattcaaaagtcaacgatgtctgcatatctgccagtactaagatacttttttttatttgtgctctacaagtttgtgtgatctcatagagggattggcatacattttttaaaccaccccacccttgttttttttgtgatggtacgatccaacttcactctgttaatcgctcttttacgctatatcaaaactcaagcaccgaaggggagaccccgtggtttaaaatttaataaacttcgttattttttaattaaactaggaccatgacatgcaggttgccttcataaaacagaaatagaaagagaagaagaaataaagaagcgaaatagccatttcatagttttaaaatggtactccttcgactctgaaatataatgacatctatcatttaaaatttatcctgaaatatatcaattcttcaccaatatttttttcctaaccaaccataacctttcaccattgaaattctccacttacttcattttcttaaacaatcacaacattccccatttaaatccacatactttcttaatacccatatccaaggtaaaaattcatatattttagaaggatttagttttttgaattcaatttttcgtatacgatggcatttggtagcttcatgcaatgcctcctttattgtgtttcaagcttctggaataaaagtaatgtcttaaaaaagaggggggggggggggttgaaggattgtttacgctttggtgcaagtcatggctatcttcgttgctatacatgcttctttagttagtactccctccattttttaatagatgacgccattgactttttttcacatgtttgaccatgtcttatccaaaaaatttacgtaattataatttattttgctatgagttgttttatcactcatagtactttaagtgtgatttatatcttatacattcgcataaaatttttgaataagacgaatggtcaaacatgtgagaaaaagtcaacggcgtcatctatttaaaaacggaggtagtaccttgcaacagtttgacttatgcaacttgtcataaggaattacaattataaaaaaaaatgcaaccttctatcgtcagtaaggatattatcgggatgaaccattcatgcaagctaaagcatttggacctcggactagtagattcaatatgacgataacactatatgcgacacatgcactcacatgttaaacagattgttagataggttaagaattggtagtcgtaagagagaacgctagctaaatgcaatatttgatgaattaggtgatcacactttgagaaatgtcaattgtggcgagtataacacgtaactgtccaacttgcaatcatagtagaatatatgggaacattttttacaatatgcaagattcttctagtgaactattatgagctacaactacctttgttcttttcttcttaagcaaacgatggagctggttcctggtagtgccacaactttgaaaagcaagtattaagttaatcattcatcttgcaatatttgttcaaactagttatacaaatttctttaaaccctatctattatggtccaaattacacaaaaccacactaatattgacatatgacacataaccctgatattatcgtcctaaagtttcacaaaaccacactagtttccattttgtcttcagatctaccatattttttttatacaatcacatgtcaaatttataaatatatttattctaaattttgatataagagtgtgtcaaaatggttagcaatgttattttgtgaaactttaagaccataataattatgttatatgccacgtgtcaaaatccatgtgattttgtgcaacttggaccgtaataataggtggggttttctaaaatttactccattttattttaggcgcgcatatctagtcgaaatagtgaagacaacatttgtgctcaacctatatataagtgatgtccaacttggcttaacccacctaatgtgaacttgaacttgatttgtatatccaaattaacatagagtgtgatgcgcaatccataagatatattgtaacacctatctttcggattgcacaaattacttatggattatagttataacagttcattttaccttttttttttaaaaaaaagaaataaagtctaaattatctttaaactattgtgctagtccgatttacactatatacagttgataaattgtgcatgataattagaatgtgtttacatctgttttcgcatcttagaacgtgattgatccatttatacatagcaacagcatgcatccaaccatcccatatactagtatggaagtgatgaaatcacttgattaaacatccgtttcctggcccctcatgatacagtcaaggaaaaactgttggccttgagtttgcgaaaggcggatggattcaattaagcccaaagccccaaaccgttttcagcaaattgcccaagaaaaataatcttaccttggcttgactttagagactcgcaagcttcatactcggagcagaaaaacataccgctcctgcgctccagatcgatcaactcagaacccaggttgatcgacggcgtagcttatatcttctgagagaacacgtaccgcagtcactgctcaaggaaaaaaaaaagagtacaagaaacggcaacagcttcgttttttttttctcgccgggcagcctgagtttcatttgtatttgcggtcaagcctttgtcatttgctcattttaaacactttgcgaccgaagttggagagtgagtatgctaagctgctagccgtctgtatctgaccggttctgcttgccacgctggcatcagaatgctcacgattacgcactgcggcgggggagctatacatatgccgtcgctgtcgctcgaggcaagcaacaaaaatctcttttcttgccccctccgtacggatcataccgatacctgcaccacgttgcacttgcacgcagcgcaaccatgtccggtgcggcgccaa

SEQ ID NO: 28483 - DNA, 19239 bp, Oryza sativa
ttcaccggcgcctccgcaggcgctcattaatttatctccaccgccgtcgccgccgcagccggcgtcctcgtccgccccgtcgtcgtcctccaacgggaccgtggcagtagccgcgggcgtggtcggcgcggtcgtcctgctcggtctcgccgccgtgctgatctactgcttcgtcgccaaggggcgccgccgccgccgaagccatcaccagccatcgccgtacccggtgtttccaagtaagttacgcgccctacgtacgtacttgcgtattgacatttgacgcgcgcgcgcggccgttgcacgagacaatgctacgtcgcgggcatgtcgacgcacgtgacaaccgcgcgcgcgcacgcatcgccagcgcgagagctccagttttttgcggtgtttagccctgatgaagtcaagaggatcgacagttcgataccgaaacggcggcattgcgtacgtagcgtgcctgcgtagcgcgttcgacctggacaccgtcttgtgtctagcggcgagcggttcaaacggcacgttcgcaccattctgtacacacgttaaggctaacaatgggaacagtactttaaacaccttacgcatgtgccatcttttcttgcaaacgcttgaaatagttataaaatatcttaagaaaactaagaacgtgtaagagcgaatttgacgtccacgcaaaagaatcattttgtgaaaaaaaatgcagttgtttcatacagttaaatttgtttttctatcaccatttataaatctaatttgaccttacatatctgtagagtaataatattagaccttatgaccttagttacatttggacaagacaaagtaaaatgctagggaccaaaattactccaactcggagtaagggcatgcatgctcaaaggtatagtccgatgcaagcttgtaggtattccaagtcggaaaaatgccctttcatataactatctcttgaacagactcttcattaatacatactccctttgtcatataatataagggattttaggttgtttatattcttaaaatctcttatgttataagacagaggaaatagaaaggagtattaattaaatcgctgcatgtgtcgttaactctcgttgaacgcttggtgttatctagtcttggatgtacaatgcttggtgctatctagtctcttcacttttttttttttgctaagagtcattgttgagcaattgttaagttaaacaacgatgtttccgtcttctctcctctcccttaagagactaaggtaactattatttcaattttcaaagggattaattagctgcctcaagtcacttaccttaccttacgatggttaagtcaacttgccacaaggattatcgatccatctgtccatccttacctatatatctacactaattgggaacattgtggtcgtgggccacttattatgatcatagatatctctctgtttcatattataagtcattttaatttttcttaaaattaaaattttaaattctaatcaagttaaaacatagcatttcaacataaaacaaatatatatatatcaaaatatgttcaatgtatatcaaaatagtttatttattttggtgctgtagatgttcctatatttgtataaacttaatcaaatttaaaaagttttggctatgaaaaaaaaagttaaaatacattataatataaattggggttaataaaatatatgtgcatttcacttcacgggccacttttaaagcccatgtatgtcgaccaaaacgtcatggcctacttctaaagcccatataatctatgtgataaaaagcataccattggaaattatgtgtacctttttagcgtttttttactttaattaaaaaaaacagtactccaaacgaatgcaactcattgcttattaatttcgatttttagaatcattaaattataaagataatactaaattgagacccccacataagaccaaatttgtagtgattaacttcgaattttagaattattaaaccaaaaaaaaaagctatagttgaaaattgaaaccaagcattagctcaatatttattaattacgaattcataactattgaatcaatacgatttaattgaaactccaaactgagtacagcttgatatatttattaattataaattttaaaattatcatatcaaaaggagctaaaatttaaactccaaactgaaaacaatttgaaatttatcgattacgaatttcagaattatattgatactcatgaaaaaagatgaagttgcatcttcaaaccgagtataattaggtactgatttattccaaatactatatcgattatgtgctgtttattgttgatttttttttcttgcgcgatgattcgggaatactggtgggcatcgaaaacgtgcgtgctgatcaccccagttagttgctttcgcctaccagaacttgattgatgcatacacagcaaaaacatgcatccaacttgccaatatgtatagacagtatatagtatagaattggtcgtgacgctgtgacgtaaccaatctcttgacagccctttcccctcatgaaacagtcaaggaaaatttctggttttgcatgtgcgataggcggcggattttcttaaccaagaccacttttcggcaagttgccaaaaagaacaatattctcccctcgatggatcgggacagtcacaaaacttttatcatcaaagcagagtagtggatcaatcgtttcacaaatcagaatactctgaaggctgatctgtgtccgtacttgttctgttgtctcctgagaaaacataaaaaccgcagccactgctcagaagtagtacaactgtacaagtcggcaagtggtttgtgtgattatgtttgttacttcacgcaatgagccgtctagccttgtccttggctcgctgctcgcatgtaaccgaagttggtgaggctgctcgctgctggtgtcgcgctgtctgcctgtatctgaccaggtcgatctacctgtcaaagactcacggttgcatcgaaaatacatgattaagttcatgattagcagtttagcgccattactattcctagcacaacgaagcacaaatgcacaatccaaccgaactctgacttcagcacggtcaatcttatctaaccacccaggctagctaactaccatcatacaaaggacagaaaaagattctcgttttttttaagagaagccaagttattgctttcgcttgaaccaggcgagcaagcaagcaaagccgaagaattgttacacggccaaagtggaaaccacctcgtggtgaactgcaaccagctcatagatatcttgcacgtaatcttcctaattagctagcccattggtatttggtcgtggtcgttgaatcataccgagagcctaacgttgcacctgcgccgcgtgccaccatgtcatctcaggcgccgtcggcgccggtcacgccggcggctccaccgccgcagacgccacccgtgacgcctcctccggtgactgctcccccgccggtctcaccccctccggtgacgccaccaccggtgactcccccgccggtgtcacctcctccggtgagtcccccacctgtgacacctcccccggtgagccccccacctgttacacctcccccggtgactcctcctacaccggtggctcctccaccagtgccaccgtcaccgcctccaccgacgccgaccccaacgccggtgacgccgtccccacctccgccggtgacgccatcccctcctccgcctgtcgcaagcccgccgccgcccgatgtcccaaccgccccgccaccgagtaacaaccccccgtctccgccaccgtcccccagcaacgtcccagcctcaccaccgccaccgcgaatttctttatccccaccgccaccgcccttgacgccgacgcagtcgggtgcctcctccggctccaagtcctccaacaacgggaccgtggtggccgtcggcgtggccgtcgcggcggtggtcgtgctcggcctcgccgccggtctgatctacttcttcgttagcaagaggcgccggcgccgccaacacccgccgccgccgcaccacccgggctacccacccttcccaggtacgtaagcgcgtattcccctcctttcattggcagtgttggtcgcgcgagatcatgctacgtcgcggccacgtcgacgcgacaatgcgcgacgcggggtcccccaagcctttttcggtgttagcgcgatcccatccacgcccttcgctgcggtcgtcgcgggtgaccgatggtggtgatagcgacacatcggcatcgcgtacagtgcgacgtattccatctcgtccggctcgtgtccgcggtcttcgcggcgcacactcgttagcgtttgaccattttgtatgctatgctcgtgaaaattttctccagggatgcatcgatctgtgcgcggcgattgagttgagctgatcgaatgttttttttttccctgttttgttgccgtgccacctgcagccgaattctacgacccgcaccggccgccgtcgcagcagcagtcacacgcgctgtcgccgagcccctcgtcgacgccgccgctgctgctgcagccgcactcgttcgtgagcagcggcggggcgtccgaggcggcgtcggcggtgccggggatcgcgatgatgggcggcgcgttcgggtacgacgagctggcggcggcagcggacgggttctcggaatcgaacctgctcgggcagggcgggttcgggcaggtgtacaaggggacggtgcgcgggcaagaggtggccatcaagaagctgcggtccggcagcgggcagggcgagcgcgagttccaggccgaggtggagatcatcagccgcgtgcaccacaagaacctcgtctccctcgtcggctactgcatctacggcgagcagcgccttctcgtctacgagtacgtccccaacaagacgctcgagttccacctgcacggtaagtacttgctgccggatgatgtaccattgttgcgtgtaatgctggggcttgcttgggctgacacgagtggttggtttctgcaggtagcggccggccggcgctggactggccgcggcggtggaagatcgcggtcggctcggccaagggcctcgcgtatctgcacgaggactgtgagttccaccttgtgtttcctccgaaatctaaggtggtgtttgggaatctctaacaaaaatataagtccctatgagagagacttgtgcttttgttaaaaggattaaagtttagtcctttcttcctaaacaccacataaatatatgcggaatctgtgaaactgtggttctgataagatggcatgctttgactgttgtcaggtcatcctaagattattcatagagacatcaaggcagccaacatcctgctggactacaccttcgaaccaaaggtaaatcgcgaaaatttggaacctgcaataattgacgttatacgcgtatttatcgcgaaggtgcacacatgtttgtacaggttgcagattttgggttggccaagtaccaagccactgagcagaccgctgtttcgacgcgcgtaatgggaacttttgggtaaacacatcaccatcacaaccacaacaatcaattacacttgcactcgtacgtcaaaagttcctcagtgcacgcaccacgcggactaaactttgtgctgtcaacaacttgtatctccagatatttagctccagagtatgctgccacgggcaaagtgaacgaccgttccgacgtcttctcattcggcgtgatgctcctggagctgatcaccgggaagaagcctatcatggtgtctcacggtgaccagcctgacacattggtttcttgggtgagtgggcttccgagtcttgaaccgaacacgtagatttccatttgccacggccggtgaaagtagtcatctctgtgtgtgtccaacaggcgagacccctgctggtgagagctgtggaggaggagaacttcgaggagctggttgacccgaggctggagaacaactacgacgcgtacgacatggggcggctgatcgcctgcgcggccgccgccgtgcgccacaccgcgcggtctcgcccgcggatgagccaggttcttgccaaaactcctcacaccttcactgaacaaacacaaacacacagcacacaccgcacggcttctggtttcagcaactccgtagcttgtacactgaaaatgtggacactcgaatggtcagatcgtgcgttacctggagggcgagctggcggcggaggacctgaacgctggcgtgacgcccgggcagagcgcgatgcagcggacgagcggcggcacgacggaccagatgaagcggctcaggaagatggcgttcggctcggccaccggtacgggcaccgtcagcgagtacacgagcagcgagttcagcgagccaactagcgagtacgggctgaacccgtccaccgagtacaccaccagcgcagccggcggcgacaccggggaggtgacggtggacgtgcagatgacggccggcgccagcggcgaggcggccggcacggagaggctgagcaggcggaccaccgctagacgtggcgggcgggtgtgacagtgcgacaccggaatttcggtgccccgcccggcgagcccggcgacttttacccgtacgtgatcgtcaaggttgcgatcgaatgaattaaatcattttgttcgtgtatatatacacgtaatgctgtcactgtaaattaaactacattccaaatcccgcggttgtttctttggttttcgaattcatgcaatttttgttggagtggaagtttgtaaattgtacctaccttcactaaccacccaggttaataaacatcaaagatgagatttgtttggaagctggaatgattcgtcttctccttcccgccctgaatatatgtactaaagattctgacatgctacaagttgactgaaagtttcatgttatgttcagatccacaatcgtgccatcctattatcttttcgtttttgaaaactaagctagattatgctggtgctatatcatgtgcaggttgcaacttggaatgaaatgctcgcttgagagcctatgtcgcctgacacagtcgatgggccgaccgatgttgtgggtgcctgggtggcaaacggacccaaagatcataagcctattgttaagtttttttttaataggttccgttaaaaaaaagttgtttttaataggccaagccatagcaaccatcagtacgcagtccctcgtacccgtttagtgtcatatatggatctctattcatttgtgaccatatcaatcgccctttcagtgtggaagattttttacgccccttttttattgaatataggatgagaaaaaatgtgcaaaagtcaaaactttacagaaagagaaaaaactatgggatgatctgtgctaggtatttcactcctatcagagcttaaagttttggcagcctctcacgtgggttagtgttgagaattctttgtgttgaaacactatcaggttcctttctttctatatctcccatatgctcagtaagagaagaatgcggattcctttcctgggcgtcccaggttgctagccatcgttgtccaccagctatggactaatgtggcggcgttctagctggtcggcttgctatactcctgtgccatccaattcgttaggatgccccaaattatccaggtgtatctgtactccatgaggagatgaaccgccgtctcaagggtgcgtctctgcacaagtgcagtatgctatccccaagtcgtaggcctgtttgaagttcagactctattttggatagccagccaagcgaaaattttacatttgtttggtccccatggcttctagatgttcgcattgtagttcgtgttgatggcttcgaggaactatgctttctaggctgagcctaccatgtactctccgggacttgtgagtttccaggtgatttcatctaccacatctagggttagctacacactatccactgttgtctagagggtcactagctagtctagaagctcggttatcattgctcctaggatcaagaggtataggtcttgcgactaggtatcatctgcaatcgcctctcttaaggttctgttctttcttttggagatagcgtaaacctgtggcaacacgtcctttggttggcgtccacacttccaggttgactcccagaagcgtgctattgcgccatccccaatggttattcgtgtcgctgtcggtgacatgggaccgggagtatcatgactagaggcttgggcagccgcggtcacccacgtggcctgaccccctcggggggtcgggcccgagggggacgtgcccaccccctcctctgtctccccgaggggtcgagccgctcctgtttcggccccgagggctggggcgccctgaccccctgtggtattggcgccacgggtgtgggttaggtgggcacagcggcgctcaccaaaccacttttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcggaatgatgagagcctcttgacactcgtccctagctggagccggcgtggtaactcctggagttagcacgtcagtcccgactcgattcatgccaggcttcatcgcaaccattgcaaggaagtcactgtatgaagaagggcagatgtgcggcatgctaaactgacgcgtggtggagaagaatgactggtctgtgactggactgatgccggtcacgtcatcggcagacaaccgtgctcccacgttgcatctgcttccggcggagtggaggtaggtatgacccatcccatcggagggtcattcagacagcggccattgcagatctcctcctattaatgaagaaatgacagggtgatcccctgtgtccgacgagcgacggcgctgggcatcactcaaggacaagcggtgatttagcttccaggcggaggcgtgagtcaagatttggtcaagatagggtgggtccccacctagaagaagagtaggtagaagtagtgcatgtggtatccccttgagatataaaaggaggaccttgcccacctaaaaaggggggaggagatcgagagtaaaaaagaacgagaagagaaggaaaaatgggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcccccggccgaaccggcaaaggggggcctgcgcggtctcccggtgaggagcttgccacccgcgtcggtacactcttgggaggatttgtgccagcagttcaccatgaacttccagggcacatatccgcgccaaggtgaagaagcggacttgcatgcggtacagcgaggggacgatgagtctcttcgctcgtaaattcagcggttctgtcaagtccgcaataccataccgtgtatccccgcacacgcggtgatctacgcgttcagggggggcgtgcggcacaatcgcatgctcgaaaagatcgcctccaaggagccctagaccaccgtggagctttttcagcttgcggaccgtgtggctcgcaaggaggaggcctggacctggaacttctctggttccggtgtggcagctccggccgcccccgggtccgccgctcggtcagggcggcgggacaggaggaggaagaagaggtcggcctatttcgacgacgaggggcacgtcctcgccgtcgagggcgcttcgcgggccacccgaaaggggaggcctgcgagcgacagaaagaaggaggccggtgctcccagcagggagcgcccgaccggcaagtggtgctccgtgcacaacacctccctccacgacctcgcggactgccgcgcggtcaaaagtttggctgagcggacgaggaagtaggaggaggagaggaggcagaagcgccgtgagggcaaggtcccggcggcccccgccggcaaccagcgaggtgaggccaagcagaaggcccccgccgaggacgtcgacgatggcgacgataacctggggttccaggagcctcaggctactgtcgccaccgtcgatgggggagcgtgcgctcatgcttctcgccggagcctcaaggccgtgaagcgagagcttctggccgcggcccctacccatgaggcgacgcggcgggcgcgatggtcggaggtggccctcaccttcgaccagaccgaccacccgccgtgcgttgcccggggaggacagatcgcgatggtggtttcccccaccatttgcaatgtgaaattgaggcgtgtcctcatagacgggagtgcagccctcaacatcctttcccccgcagcctttgacgcaatcaaggccccggggatggtgctccggccgtcccagccgatcatcggtgtgacgccggggcacacttggccgctaggtcatatcgaccttccggtcacttttggtggttccgccaatttccgcacggagcgggtgaactttgatgtggcggacctcagtctgccctacaacgcggtcctagggagacccgcgttggtgaagttcatggcggcagtccactacgcctatctccagatgaagatgccgggccctggtggccccatcaccgtccatggcgacctccaagtcgcgcttgcttgtatggagcagcgcgcggaccagctcgccgcggcgtccaagcccgagggtggcgacgagaggctcagcgcctccgtcccggccgccccgaggcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtacggccgggcgcaaggccggtccggcagaaagtgcggcggcaggccccggaacgtcaagccttcatccgcgaggaggtggcgcgacttctggaggccggattcatccgtgaggtcatccatccggagtggttggcgaacccggtcgtcgtccccaaggcgaacggcaagcttcggatgtgcatcgactacaccgacctcaacaaggcatgtcctaaggacccttaccccttgccacgtatagatcagattgtcgactccaccgcggggtgcgaccttttgtgttttctagatgcatactctggttatcatcagattcgcatggctagggaggatgaggaaaaaactgcattcatcacccccataggaacttattgttatacgacaatgcctttcgggttaaagaatgcaagacctacttttcaacgtaccactcgaatttctttgggtagccagttaggacgcaacgttgaggcttatgttgatgacatggttgtgaagacgcgcaaccaagagaccttactctcggatctagcggaaactttcgaaagtctccgctccgcccgcataaagctgaaccccgacaagtgcgtgttcggcgtgcctacgggcaagcttctcgggttcttggtcactgcccgaggcatcgaggccaaccccgagaagatacgagctatagagcggatgcgccctcccagcaaacttagggatgtgcaatgcgtcaccggctgcatggccgccctaagtcggttcatatcgaggctgggagagaaggcgctacccctatttaagctcctcaaatgttccgggccgtttacttggacggaggaggctgaacgggccctcactcagttgaaggcgtacctcagttctcccccggtcctggtcgccccgaaaccagatgaaccgttgctactttacctagcggcaaccccgcaggtggtcagcgcggcgttggtcgtggagcgcgacgaggacaaccctcgctccgcgcacccccaccctgtatcgactcgacccgggagagagcagggaggagaggcccccgagccgaacggtggcccgatgcccccgacggccggagctggccctctgcccgcttgtccgacggtgccaggcgcccccgaccctcaggatggccccggggccactgcgggaaggccgcgcctgtcgccctccgaccccgaggtcgtcgacacagaagccgagtgcgcctcgcgcggcctttcggacgaaaagcaccctggagatgcggctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttccaggcgcatcgggtcacagtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggaccccagctcccgagcccgtctccgtccccgaggccagctcgggcccctcgcagctgcctcacaccgcctactgggtgatgcagttcgacgggtccctgtctcttcagggtgccggtgcgggggtcacattgacctcgccgagcggagacgtcctcagatacctggtccgcctcgactttcgggcgaccaacaatatggcagagtacgagggactccttgcgggactcagggtagcaactggactggggatccgccgcctcctggtgttaggcgactcccaactggtcgttaaccaggtctgtaaggagtaccggtgctctgacccgcagatggatgcttacgtgcgccaggtgcggcgcatggagcgccatttcgacgggatagagcttcggcacgtgcccagacgggataacgcggtcgccgacaagctctcaaggctcgcttcctcgcgagcccagtccccaccgggcgcctttgaagaaaggcttgcccagccgtcggcgcgacccgaccccataggggagacggacgcgcctgaacggcccccgaggcccgtcggagtccaggcctcgggacccgaggggagcgctcccagctcccttagatcgattgcttggatcccttagactctacccgaggaccgcgaagggagtgaacgcgtccagcgcatctccaagcgctacgtgctggtagaagggaccctctatcgacgcgcggctaacggagtcctcctgaagtgcattcttcgggaacaaggcgtcgagcttcttgccgatatccatgaagacgaatgcggagcccactccgcctcacgcaccttggttggcaaggcctttcgccagggtttctattggccgacggctctcaacgatgcggttgacctggtccggcggtgcagggcgtgccagttccacgccaggcaaccccatcagccggcccaggccctgcagaccatacctctttcatggccgtttgctgtctgggggctcgatatcctgggtccgttcaggcgggccccggacgggttcgagtatctgtatgtcgctatcgacaagttcactaagtggcctgaggcttatccggtcatcaagatcgataagcactccgcgcttaaattcatcaggggcatcactgctcggttttgggtgcctaaccgtatcattacggataacggcacccagttcactagtgaactcttcggtgactactgcgaagacatgggcatcaagctctgcttcgcctcccccgcccaccccagaagcaatggccaagtggagcgcgccaacgcggaaatcctcaagggcctcaaaacaaagaccttcaacatcctcaagaagcacggcgacttgtggatcgaggagctgccagcggtgctctgagcaaaccgaaccacgccaagccgagcaaccggggaaacgcctttcttccttgtctacggcgcggaggcggttctcccatctgagctcaccctgaggtcccctcgggccaccatgtattgcgaggctgatcaagatcagcttcgcagagacgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggctgggatccgttcggctggccacgggcgacggcacagagctgcctaactcgtggaacatcgaacaccttcgtcgcttctacccctagtgggggtcgggtgtcaggtctcgggctcaggccaaccccgcacccccccgggcgtgcagggttggccgggggctaccacatacagataattgtcttttttctcttccgtatttcaataaaagcattttcggtttcctaatgactgtgtttgtgccattgtttccttttgtagaatcttgactttaattagcacgctcgtgctcgatcctgccctcggtggcccgggccggctaaaatcgccaaaaggggcccagaaccgagccgtgccccggggcgtgatgaactccgggggggaatcggcaaaggcccacaatcgggtcatccataaccctcggtcaccacgctcccggcctggccagtctcgacatgtggatctccccaggcactagctccggcccgcgccgtttgaggctgggacccgggcacgagcccttgttcaagccaagacacagaaggaccgcggcacagaccatcctcgtctcatacacacaacaaatagaattgacacagaaatttcctctttatttgattgcagattaagttagtctatacaagaaggggacccgaaggcctcggaagaagaaataaaaaactatataagattggcatgggcctgggggctcattccgacgcgcccgggtcgccggcctcatcgccgctgtcgcccgcaccgccgtcaccgccctcttcgtcggagtcgagggcgaacgcgagccggggggccgtaccctcgaagctgtggacgatgtggtcggcagcgtcccggacctgcgcgcgcgcatcgtcctcggtcccgggaggaaactcgtccagcgctgcccacggggagaagtccgggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatacttcgcagtccgcccgccccagaggcccgcctgccgcccggcgcggtctatacgggagacggcatcccgaagcatgccaggccctacctcgcctgccaagcggagggcctcgacctccccggcggacgagtccagcgcgccctgcagctcggcgatggtgtgttcggcagctgcgaggcgggcggctaggtcgccgtcgcccgcggccgccccgccgctgcgcgctctcgcgtccagctctttcacccgcgcctcgagctcactggcccgctgatccagtgcggtcctctcggcgcgggcgcctttcagattacggcgcgcctgctcctcccgcgctgcctctgcggagggacaggctgtccgacagccgatgcgccgcggactcggcctccccgagagctcgctcccgctcggtgagcgcgtcctcgctgaggctgagtgtggactcctcttctgcgcacgcggcctcgtgcgccgccagcgttgcctcccggatggcgacggcggcctcgcggtccgccaggtccctctccctcgcgcgggcgcgctcttccagcgccttggcacgagcctcaagggcctcttcgcgccgccgggacaccgcctcgttctccgccgcccgccgttcccgtgcagcggcggcgtcaaggactccccgggcggcgtcgagtttcttctctagctccgccgcccggctcccgtattggaggcggagatcgtcccgcgcctcgttgagcacggcggtggcgatgagggcagtctcccgctcctcctccacctccctggcgatctccgccagctccctccgacgggcctcgagctctgaggcgtgccggcggtgtgccttgcggcccgcctccaccatggcttccaccgagcgccgcccctcctcgacgcgcgcccacgccgcgtcgagctccgtccgctctgctagcaggacctccatctgggcacctagctcgtccagcaccgtggtgttcgcggcggctaaggcctgcaggaggggctccgcgttcagtggggcagcggaaggcagaggggagagccgcctcggtatgggcgccgcgcggctcggcccgccgatcgacgtgccggacccaggggcgacccccgaagctggctcgtcccaaacgtcgcccgaggggtcgggcccgagcggtgcgcccgcgacctcatcgtgggtggcctcggaagtcatcgtcgcctcgggcggagtcgggtcgggggtttggcaggccgcttggcgtgcacgcgccacctccgcctcccgaacggactcctcggcccggcggagtttggcctcctcccgagcggcttcctcagcctggcgaacccggacggcctcctgggcagcttcctcggcttcccggaggcggtctgcggcttctcgccggtcagcctcccgcctccgggcctccgcggtcgccgtctcctcggcctcggactgtccggacttggaatgacgggaggagcgcgacgggatctcactgaggcagaagaaaaaccagaggacaaaaagaaacgggtgagtgaaaacttgccttgggagatgggagaatgaatacggccgcagtgggcgcggggacgaacctgcgaggaggtcggctaaacgaccaccttgggggagagataaggtttccccggcgtggttcggtctcccccatcttgcggcgccgcttcttctttcgctccccctcgggctgcgacgtcggcacggcaccatccaggcgcctgctgctggcacgcgccgccccgccccctcggggaggagatggggaaggggtaccctcctgcttcctcttcccccgggcgtcggcagggtggctgcaccccgggcccccatcgtggggcccagaagcatgaccccctcccagggtagattgttcccccctgcggctcccgcccgcgccatcgtgacctcgaggagcccgctcctccgacgccccgaccgcctacatgatggtcaggatgttggcgcgatctggatcgctgcagagggggaggactccttgggggatgagggatgcctccacggagctgagattcagcacccgttggaccaccatcttgaagtcctcaggggcccagtcccatctgcccccctggtgggtcctcatgtagtcctcggacccggtgtactcccaggcgcctctggcgcgccgctggagcggcgcgatctggcgatgaaggtagtcgccgtacaccatggccctcgtgagcccctgggatcgcagacctgccaggcggtcaagaacggcgtcgtagccgtctcccagatctaccggcgcccgccagctggaggcctgcgccgggggctggctcggaagtcggaggcgcgtttcatcggcgaggggggtgtagaaccagtcgctcttccagtcgtcccacttcttgcggaggacgcagggaatgtagcggttcagcaccggcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcgtaaagttccagaacatccatgaagaaagaagagaatggtgggaccagtcctgccattgcgaaagagaggaagaagacggaccgccccgggtagtgtggcgccgggcgtccctcacccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagaacgagtgagtgcggcaagggtagggcacaggaaacaaggagttagggcgcaagcggcgaaggcaaggggaataatggcgagaggaaggaaacgaatctcttccttggcgcctttatacccttgccaacgttatgcccggctcctcgtttctcgcgcccactatctcgccccctcgtttctcgcgcccacgcctccactaatcctactcgtccgtttgcggcgcacgaggcggatgtgcggccgtggcagtcaagatgggacatatcgtgcgcgtgttaactacgctcgccgaccgaagcgccatcatcatatctccaggcgaaatgaacctgctcgtcccgattcgcgcgctactcgagtaatgtaacggtcttgaagaggccactcattgttatcggtcgtttttccctagccgatgcacgcgatttgcgaccgctgggttcctgcccgcctgtagagagcggccccacctgtcaccaggtctaaagagtggcgtcacgcccgagcgcttccctcgaggggggcgatcgccctggcataacgccgggggctactgtcggtgacatgggaccgggagtatcatgactagaggcttgggcagctgcggtcacccacgtggcctaaccccctcgggagggtcgggcccgagggggacgtgcccaccccctcctctgtctccccgaggggtcgagccgctcctgtttcggccccgagggctggggcgccccgaccccctgtggtattggcgccacgggtgtgggttaggtgggcacagcggcgctcaccaaaccacttttattgcggaatggacaagcgcgccacgccgcatttaatgcagcacggcgcacgcatatccggtccgtgaccggtcgcagtgtgtgaccggtcacagaccggtcagatcgcgggttaggtg

SEQ ID NO: 28484 - DNA, 8934 bp, Oryza sativa
attcctgcagcccagtaaaaaagaacgagaagagaaggaaaaatgggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcctccggccgaaccggcaaaggggggcctgcgcggtctcccggtgaggagccccacgctccgtcagtcgccgctctgaaaaatattttttttgtcaatctgatcgcatggggagtctaagccgaccattgtattctccagtgatttccagaaaataatagattttagagtttagatccctctcaccttttttttttggagttacattcattatatttctgtgataaaattaacagtaaatttgtaattttgggataaatttgatgttacatctatatttttgtgatacggcccatcaaattttgtagttttgtgaaatttactctacgttgaaattgaaaattagcacatataaagctatacacaaaatccaactcacatacctttctgttattttctgtacaaaataagtatctactccttttgaaatcttaagtgtagtttctactaatttaataattccattttttttcaaaacataattgttaacggatgtggattcttaattctaacatggactttatctagatccaaaaacatgcatggtgctgttgtatcctttcttttccttctataatgaaattggcagagctcctaccctttctcctaaaaaaaaaatctaacatggactttgaattaataaatagaaagtcataatagatttggactaaaaactaataaatatgaggaaaactgtatttggtgtgctctttaatttcgacttttcttgataagataattggtatatttcaaataattgattgtttggttggcggccaaagtttgtcatgctagactttgagagtatcacagttaattaagctaagtcgtactcttattttctagcgaaagtttatcacggttaaggctaaaaaatatggcttgcttcacttatggctataatggagttgtggtaaagttagcctccagccaagtaaacccttttttatatcctccgtacaaatttgtacttggctttagaccttttttttcaaaaaaagtttaagatcaacagttaagaactactacagtattaagttgtatgattttatatttggaaccttactaatttaatcccaaactttgtaatacttcgcagtaactagccatttgctagtggcatatactcttcatctaatctaagcctttgtaatttgatcccgcctaaatggatgactagatttatttatttactatttatttgattaacatgggtttttttacataatgacaatcagtatagctgtacagatatcaagatatataagtaagaacagttcgaagtttccctgcatacgaaggatcaaattgacaaaatgacttgaattagcatgagtgtccatgtcctactctccaagtctccattgcactcgcagaagctaatattttagtattatgctgacttttgcaatagcacgcaaaaaacattgctatattttatcatgagatattatgtaatcaccgaatatgggttaagatgcgacgccatggaagctccactgtatgtcacgatcatcgtcagtttgtcactgattgtgctggatcagcagcgccaatggatgaggagtccataatggattagcttttggcgccccctctttgtcgcgattgtttctcctcttttctgatttcccccccgttgaacgtggatcacgcaattgatggccgatcttctgagctactggcacgcgattctcttgtctttcccgttcccataattttcccacgacatgagaaaaataagttattgtctaaaaaaaatgagaaaaatatgttctctattgacgaagctaagcctggcagcggataaagcagctcacacggatctaggggatatcagccgctcgcgtaaagacggccggccggtggtgtcccgttgcgtgccggtcgccgcatgatgagtcagcttcagatagatgatcctctctctcctcgccgtctcctcctgtccggtcgtttttctccgcttcgatacgcgggccgggcccccgcttttcgcatgcatctttcggccgcgctcgcgagcgcacagcccaaatattcccgtggcccatctcctcctccgtctcggcggtcttgcgcgaaaaccccgtcgtcacctacaacgaactaaccgcgacttccgcacggaaatcaccgagagaacaaagagccgcgcgcacgcgacgggtttgggtcgaaacggacgtcgttttcgcaaaagtacggggcttttccgcaccaccaatcgggcggggcggtgtgttacaggggaattactcgggtcaacacgatgttgggtacaagcaggaaagtttgggttggatagagtggtaactaaactgccatgtcagggacagatcgaccagtgagtggttgaattaccatgggctctctgatgatccgcgctaagcaacaacagggggattcccgtcactttctttcgttgttgtttttctcgataggctaattaacaagaatagattaggcgaaagaaaaagcgcgagtgggggcgcaaaagcgagccggcgaggataaggcccctccacaggctccccaaccgcatttgtttagtccaatccatcgtgtttccacgtggcgacccaacccctcggagtagacctgcgttccaaacagtttacaggtcgtctgctcgcggagtcgcggctcgcccctccccccccccccccccccctcttgatttatatatacccccacccgcccgtggctccgtcgctgctgccgcgcgcctccgctccattcctgattcctcctcccaactcttgcttccgttttccgtgcccctcctgccgacaaacccacacctgaatagctcatcctcacctgatcagctgaacctgtttgagagaaagaagttagttggccatctcgccctcgctagaaaaaggaaaaaaaagaaggaaaggagaaggaggagagagcttgctttgctgctgggttgttgctaatggtgttctactacaaggcgaggccggacgccggcgactacaccatctacatgggcgccgacaagaacgagaacgaggagctcatcaagtacggcctccccgaggacgtctggtacgtacgtacgtgcattctccgcacacgtactgtagtagctcgtcgtcgatcctcgcgtagcggcattgcacatttgcgtttgcgcttcgcgcgcgtacacacgtacgatcggctagtcgcacgcgtaggctcgcgatcggcagctacatgagaggtggagaggagagctcgccggcggcaggtcggcagctgcgaggaggaggaggattgaggctttgacgaggccatgacgaggcgtggtggggacatcccaacgcccccaacgaccaaactctactataaaagatgtctaccagatcgaccccgtctaggaggagtacgtaactgctcatgctcagcaacaagttgcaactctgtctgtagccatcgcctgccatccgcactagtactactacagtactactactgtgaccactaccacagccttttgtttgcttcctccatctaggggacctcacctcgatctccttgggtttccaatgcttaaaagtacttttctgcttaattcgtcaaattacgcctcatctgaaacatgtagagatatttattccgatccatgttaagatgaactatatagtgctgtaggaattttcttagaagtaagaacaaagatatatataaacgtacgactggttgttttgatggaaaggtcggtttaaagtggattcttcccttctaatttcgacaaggaaaattgcttttgtcccgtcaggttccacgtggacaaggtatcctcggcgcacgtctatttgaggctcaagaaaggcgagtcgatagatagcatctgcgacggtctgctggaggactgtgcacagcttgtaaaggctcattccattcaaggtacgcactcatttcagacaacatttgagtgtagaggtagcgcatagcttaattagctttcttttccaccatctgctttgtgtgcttgtggctagattcttttggtttctaacgatcaactagtaaattttcactcgtgcaaaaaagtagggtagatacagtttaccacaaaagattctgcagttacgaagaatttatcatggatagatgcaggttctcaaaagaaaaggaaacgtttacttgcaaataatgataatcatttgcacctccaattatgttatccacggatagaggaaatagagcatggtgtgacctgtcggatattcgtgtggcctacaattctacaaagctgcagcatcacattatattgctggttacagacaggaatcttaattttgtttttgcttttccaccccggcctttttcttttcagcaacttttagcttcttgtattattggcactagctacagtgggccccttggatcaattatccgcttgggttgatttggcctatgtgaggggattgtgtgataattagaacgtgacgagtatgtgtcttggatcactggatgatatttgcagcttgcatgtgcttgtcgtgcaggaaacaagatgaacaatgttgaggtggtctacacgccctggtccaatctcaagaagtccccatccatggatgtcggtcaagttggcttccataataccaggatggtaagctgctagggtggtctaacatcctcttctttgtacataaaaaatttacagcagcatatatatgctcataacaatggcaggtaattgatttctatgagggggttacaaggttagaaactattggtaaaaggaaggtccatgttgcagagagacacacacaaataccccctccaatcaaacttgctcgagtcagagccatgaattatctacttatggataagttaaatatcttgagaagtaaacataactgattgtttaaaacaatttatccaagcaatacaattgaagaaaattttacgagaaaatgtatttgtagaggcatatggagcaaataacatgagcaagttagttaggtagatgaaaagaatgcggcacccgtttcctacattttagaacagcaattttgtgacaaggtagttattttcacccaacatacaagtgcattatatgcgagacatactgtgttctttccggggaaaaaaatattgtggcgcattttttataatttaaataaatccaggctatatatatgtatctggctaggctcgctatctactactccctccgtcccaaaataagtacagttttagcactgttcatgtccaatgtttgaccgttcgtcttatttgaaatttttttatgattactacttttattattattagatgataaaacatgaatagtactttatgtgtgactaatttttttaatatttttcataaatttttcaaataagacgaatgatcaaaatgatgaacacggatatatatggctgcacttattttgggacggaggtagtattattatcttttaaaaaaaaactagtactactacattattaagagcaccaacaagccatcatgacatcaatggtaggggtctatcctccaaaaatatatagttatgcaataatttgatttcaccaacatgttaatatgttgcaacatattatgactagtgccactgtttcatcaaacacaattcaacaaaaatatcgcttaaaatgccatatacacgaagtactcatggtaccgaaaatattatttgtctggaaagggaacaaaatgtaaacagcagagtaatgtacaggctgtctagatatatattttttattaggaccaaattgcttaaacctgcattattgcgttcaacttgcttttgcatcatattttgatggagatacattttggaactaacagttgttgatatcttttggagttggcgtacattatcctgcccatatattatagaaaacgggttttatttttctgaaaaagaaaagaaaaagaagctagcgcctcttgtttccgaagggtcactggaaaaggccgccagctgattcgtcgaggggttggggtgtcaattccgcagatgcaattttgggagcatttgcataatcgatctgcacgggaacactgacagacagagagtgaccagccttgcaacttgcaaatccatctcttgttagccagccaccgcaagttgtagctgccgccgatcgatcagatgccagtgatctcctgtcatgctttcctttggcatctaatcgagatccactcatccaccaaaccagctgcatctcatcagcaataataggatgtgtcacgacgctggctgatcactgatgcatggcaggttcgcgtggtgatcgtcgagaagcgcgtcaatgagatcatcaacaggttgaacaagaccagggtagagcgccggcctgatctgaaaggtacacgcacgcacggacgacacgcatcgatcgatcgattgatcagatattcaggcattacacatacaattaaaatcgactaatccctttggcctttgtacgccgcagccgagaaggacgcgtcgaacgcggcggagaaggcggagaggaagatgcagctgaaggagaagaggcggcgggaggagatggagaggctggagaaggagaggcgggcggagatacggagctacaagggcctcatggtcgccgagaagatgacctccaaccgccagatcgcctccgccggcaactccatgcaggagatggaggacgacttcgtctgatccatccatccatccgtccgaagccagcaaccgctcccgggcatgcgtgcgtgcgtgcgtgcgtgcgtaacgtacgtgtgcggccacgtgtttctctgtacatcatccatccatataagcgtgcgtgatcgtctcaccggtcagtctccctggaacggtttctgcagttctgctatagtagtggtagtagcacatctctgtacatacacatggtccctagcaatgggcacagatgagaaagaaggcaacgcgattttcggtatttcgatatttctacatgtcgtagtagtatttggcagctgagtgggccgcgtgacggcgccgatgcaaactctagttgatctgacagtattacgtgatcagttaccgactccaatgaacgtcaagtggtcttcaacatctttcggatcactcgtaggtattgctactcagcagtatttttctccttcgaccaacaggaaccaactttgtgtctacgttgttcactgctgatacgtgaacacaagatgttcaacagtcattttattcagctattacagggctcactgagacaaactaaattgaatcagaagaggagataacattaacacttaattgcaattctgactttctaagccaacttcgccagttatcacgagcgaagaacgggtaattttatcgggaaaaacaggggagtaccaattaccaagtgtacaacagaggaaaacggacgagaaggctaacgggcgaccgctcgctaccagcgatctttttttttttctttttttttcttttcctcttttaataagtttatgcacttaaagtttacacatctaaagtttgtaaagcgaatgtttataagtcaaaagtttatatactcaattcaaattcaaattcgaatttaaatactttatatttttctcttttagtaagtttatacacctaaagtttacacatctaaagtttatccacctaaagtttgtagagcgaatgtttataagtcaaaagtttatatatccgattcaaattcaaattcggattcaaacattatatgtatgtaatatttctatacacaaagtttatgctgcaaagtttacggtataaagtctatgcacatgaatgaatattagattttttttcctaattttcttttactaattttattttgaaatttatgatgtaatagaaaagttaaaaagagagatgaaagaggagtattaggagggagggacgggtgatcgctaggaggagagggaagcaatcacccgcccactagcaatacccggaaaacggacgtgtatgaatgaagaaaaaagcaaggctacactgccataggcccacaataattttggtcctttaggcccatgctattagcctgataatctctttagaataggatgacagcctgcttcatcaagctgggccaaaaatctgaacagcaggactgcgataataacatgctaaccatatgggcttgtctagatgatgaatacaggcatacagcagtacagcctccacgttgtcaaggaaaacttcgcaagaacatgtcgcgaaaactgaacggaatttgttcatggagacgccggtcgccaggacgggcactgccacggtgaacgcagttctgagcgccattactggtcaccattgatgcatccaagtgggtaatcaagagagatagataaagttagtcgtggctttctatgggcaggcaaggtgcatgctcatgacggttgctgctgagtgccgagtcgcctgggctagggtgtgcgctccgacagtatggcgacctgggaataccaaacctcggactaatgggcatcgcactccgttcgcgttgggcctggctgtggcgggtatcttcggataagtcctggcaaggattaagcgtaccttgttctcttaaccattcacagtgcaagcccgggttagaaaggatcacgaggtgacacataggatgaagccctttaaaaacattttctccacggatcaagttaccttacagtgagacccacaaatattttccagcatttcattctcttgcatcaaatatctcaccaaatg

SEQ ID NO: 28485 - DNA, 11221 bp, Oryza sativa
tcccatcagaaggtcattcggacggcaaccatacaagtctccgtctgtttatgaaaaggtggggtaagtcccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcatctggcgcgccaggtaggggactctgcgagggattttctgagctctcgcactctttcgtgtgcgccaagcttttcctgttcagcccaatggccgagccagcaaaggcgcacgacctctccccgagtatgagcggtgacgacggggagccaaacccacgtcgtcgagctcgtactccaccgccacctccacgccaaagtcctaggcgggagaaggcacttgagagggccgaaggatccgcgacttcgacatccacaggaggtggagaagggcggcgagatgaggagcgtcgcctcctcgtctacggcaacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcagtcctccgccaccaaggcctctggtgctgctgccaccggctccgcatcgtcaagacggagggcgcggcgagcggcagccgctgttcgccattcggccgccactccttcgtcaatggctccgacccgggaagatctgcgtggggaaccggatgcccgcatcagtatcgagcgtcggcgtaatggccgacgtgctccccacgcaaaggagggcgcctcctcgtccggagtgtcgcctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttctcatggccctgaaaggacaggcgcggggttggctaatgaacttgccacccgcgtctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaaggacgaggccggcgctcccaacagggaacgcccaaccggcaagtggtgcaccgtccacaatacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcaatgatgacctaggtttccaagagcctggggccaccattgctaccgtcgatgggggagcgtgtgctcacgtttctcgccggagcttcaaggccatgaagcgagagcttctggccacggcccctactcatgaggcgacgcgccgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgaagccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgtcgggccccggtggccccatctctgtccatggcgacctcaaagtcgcgctcgcttgtctggagcagcgcacggaccacctcgccgctgcatccgagcccgagggtggcgacgagaggcttggcgcctccgcccccgccaccccgaggcagcggatgatcacaggcaacgaggtcccggtcaaggaggttgccctgggcgacggcccgtccaagaccacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctatatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagataaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttgtccgacgacgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctcatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccaccgcctcctggtgttaggcgactcccagctggtcgttaaccaagtctgtaaggagtaccggtgctctgacccgcagatggacgcctacgtgcaccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagacgggaccctctatcggcgcgcggctaatggaatcctcctgaagtgcattcctcgggaacaaggtgttgtgcttcttgccgatatccatgaaggcgaatgcggagcccactccgcctcgcgcaccttggttggtaaagcttttcgccagggtttctattggccgacagctcttaatgacgcggtcgacctggtccggcgatgtagagcgtgtcaattccacgccaagcaaatctatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattctttaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatagtcaagaagtatggcgattcatggatcgaggagttgccagcggtgctctgggcaaaccgaactacaccaagccgagcaaccggggaaatgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccctcgggcgtgcagggttggccggggcctacaacatatgcatattcttatttctcttacatctgtatttcaataaaagcagtttcaatttcctaaaggctgtatctgtactgttttttccttttgaagaatcttgacttgaaataggtcactcgtgctcaatcctgccctcgggggctcgggtcggctaaaatcgccgaacggggcccagaaccgagccgtgccccgaggcgtggtgaactccggggggggaatcggcaaaaacccacaatcgggtcacccataaccctcggtcaccacgttcccggcctggccagtctcgacatgtggatctccccaggcactagccccgacccgcgccttttgaggaccagaacctgggcacgagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcaaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttgtcggcgtactttacggtccgccctctccagaggcccacttgccgactggcgcaatctaggcgggagacagcgtcccaaagcatgccgggccctacctcgcctgccaagcggagggcttcgacctccccggcggacaagtccagcgcgccctgcagatcggcgatggtgcgttcggcagctgcgaggcgggcggctaagtcgctttcgcccgtggccgccctgccgctgcgcgccctcgcgtccagctccttcgcccgcgcctcgagctcagcggcccgttggttcagtacggccctctcggcgcgggcaccttccagattgtggcgtgcctcctcctcctgcgctgcctcgcggagggacaggctaaccgccagctgttgcgccgcggcctcggccccctcgagagctcgctcccgctcggtgagcgcgtcctcgcggaggcggagtgtgaactcttcttcggcgcaagcagcctcgtgcgccgccagcgttgcttcccggatggtaacggcggcctcgcggtccgccagatccctctccacgacgcaggcgcgctcttccagcgccatggcgcgcgcctcaagggcctcttcacgctgccgggacgccgcttcggtctccgccgcccgctgttctcgggcagcagcagcatcaagcaccccctgggcggcgtcgagcttcttccttagctccgcctcccagctcccatattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcaagacctccacctgggcgcttaacccatccaacaccgtggtgtttgcggcagccaaggcctgcagaaggggctctgcgttcagtggggcgatagaaggcgtggggcagagccgccttggagaggatgccacgcggttcgggccgccgatagaagtgccggactcggggatgtcccccggacccggttggtcctgagcgtcgcccgagggagtgggcccaagcgacgcgcccgcagcctcgtcgccagctgccccagaagttgtcgcctgagcgtcgcccgagggagtgggcccaagcgacgcgcccgcggcctcgtcgcgagctgcctcagaagtcgccatcgcctcgtcctggcgaaatccgacttcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctacggccgccggatcctcggcctcagactggccggacttggaatggcgggagggacgcgacgggatctcgctgaaacaaaagaaaaaaccagaagacgaacaagatgggtgagtgaaaactcgcgttaagagaatacagtcacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgctgctgacacgcgccgccccgccccctcggggaggagatggaggaggtgttcctccctgcttcctcttcccccgggcgtcggcagggcggctgctccccgggcccctgtcgcgggacccagaagcacgaccccctctcggggtaaattgttcccccctgcggctcccgcctgcgccgtcgtggccctttggagctcgctcctctgaggccccgaccgccatcataatggtcaggatggaggcgcggtctggaacgctgcagagggggaggattccttggggaatgagggccgcctctacggagttgagattcagcacccgttggaccaatatcttgaagtcctcaggagcccaatcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacagaccgctccgggtagtctggcgccgggcgtccctcgcccagcgtgactatctcccggccggtggcagattccggcatgaagcggcgcggcagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacaaatcccttcctcagtgcctttatactcttgccaacgctgtgcccggctactcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgaggggg

SEQ ID NO: 28486 - DNA, 13503 bp, Oryza sativa
ctacccacatttattgcggtttggttgagcgtgtcacgccgcatgtaacgcagtgcagtgcactcgtttatccggtctgtgaccagtcacagaccggtcagatcgcgggttaggtggtgactggcgatctgacgcacgcctcgccccatcccgtcaggacgagggcttctaggcgctcgtccccagctggagctagcgtgttacctcccagagatggcacgttagtcctggtcagatatatgccaggtttcatcctaaccattacaggcaagatgttgtgtgaagaagggtgagcatgtaggttgctaagctgacacgtagtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatcttccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcactcggatataaccatgactaccttatgtattaataaatcaaaggcacatatgttctacattagatttacttgttatatatttgaacaaccgttgctacacaatgagtttcgtgtgtttttgtttgcagagatacttgcttggacgaaagaaaagagaccgagcataagaaatgcatggatgattgaagaagttgattggggaccaaaccaagaccttttccaagtattctttcatctcaccacgtcacttttggtccatagaagacaagagataaagttctatacgttttggactcgggcctcctgacagcatcaacttcaaacggacctagccgctgatctagaagaaatttcggggcccatgagtacttgttggaaagcttatgaagtctactttcagatggttttggttccacatcaaaactcctaccgagctgccgggaatctgcaaaacaagtcatgcacctcatccagtccgaatctgattttgagttttgggccttgtaattgtgtcgtgggcttagcccaagggggtgtgcgccctatggaaaccttaggacgttcctaatcatatttattcagtagccgtcatcgtttagagtcgggttttgcttagattaatctgtcgagaatagtttcgccgctagatcggtttgtaagaccccaactcgtgagcttaatcattcatctgcaattttggttgttttctatctcgctcttgtttgtgttcttcgattggcaaacagggattagccttctcggcgaggtcatccgtgtttcgacacgggtgataaccagagaagacgtggtgttgcgattgcggggctcaagagcgtgcgcgttcaagaagccggatcgatttgtgtcgcgactctgcccaaatcgttgtttatcagaacctttcggaagatcgggaaccccagtgcacatcaccaaatcccctttcttgctcactcgggagcatcggctctcccctcctctctttgctgatgtcgacaggcagcacggccggcgagccctgacaacgcagatcgaggggcggtgcggccggcgagctctggtgggcgcagattggggggcgatgtgtctggcgaactctgactagtgcagatcgaggggcgtgtggccaacaagctccgggcggtacggatcaggggtggcgtggacggcaagctcttggcggcacggatcaagaggcggcactcccctgaggtggagccgacgagctctccggctgtcgctacatcaagtttccccagtgaggaatcgagtaagctggcggagtggatcaacctccttgccctagtcttcatttcgctcattcctctccgaccgctcctccttcgccatcaccgcgacccgacctgccccccaccactttttcccatactccagcttctccccttcctcgtcagcactcggcagcatcgccaacaagctccaagcctgctcggatcttgacatggcggcgcagaagaatggggaagatttgggagcagcaacagaaaggggaccgtgctcgcaccttctttttcgggcgtgaggaacctgaaccctagctaggagccgcaaaccttgcaagggcacgggacccacctccttttctcctccacatcaacgttcagcaacgaggtcactcgccacgtcgttgcactgcgaaaggcctgaagaagcgaagcttcgtgtcaatatccataggttgtcaggtgggcaatgggacgactacattattctaagaggacaactggttgcagggatttggtgttcgttctcttgcactggctgtgcatgatcggatccttgctagcattaggaggcgtaggacagtggccgaggcgctactcggccgcagatggaataagggacatcaatggtgctatggggattcaaaccatcctggattacctcaatctttggtcgctcgtacaatcggttgatcaactaagtaaccaaccagactcaataatctggaaatgggaaagctcaggtgattactcttccagatcagcctaccaatcattgtttctcggtcgaatacctttccaatccacgctgatatggaaatcacttgcgccacctcgctgccactactttacatggttagtggcactaaatagatgttggacagttgatcggttgtgcaaccatggactgccacacccaaattgttgtgtcatctgcaaggatttaaatctccggctatagctgccgttatagccggagaaagctgctggcaatagcaaccgctacgatatgttcaatttaccgctatgttttctttgacgctattagctgcttttagctgaagattgccgctaaacagaccatctattagctgccgctaaaggccttggtgggctgaaattccaatgaacaagcccatattaggtgaccgtgtggctcaagtgctcaacaaaacctaactctctcgctctctcctcctctccgtgattgcagcagcagcggcggcgacctgcagtggcgacggcgacggatgctgctgtggctgcgaccggcaacggcggctgctgttctcagaggcggcggctgcacaaatccctctccctcctcactcttcttccccaagtggtggtggcagctgcgcccggagaaggcagcgatggctgcgccaatccccactcttttcccccaaccccaagcaacgacggcggcgaatgcatatgaaggcccactcctctctcccccaagcgccaccaaggcaccaagctcgaacggcaggcaccatgtcctagcggagtcagaggcaggtaggatttcttgctttgatgttgtcgagtgttgaagaattgaagtgttttgaactattttgaatctctgatgttgtcacgaatttattatgatattggcaagtttatgttcaatttttgcaaatccgctaaatggcttaactgcagctatagccggccatagctggccatagctgatgaaaagcccagcagctaaagggcttagccagagattttaaaccttggtcatctgtgatcaacacgacgagagcatcgatcatttgttggtcgcatgtccagaatccagacaactatgatggtgggcgctcagagcaattgagcaaccacattccatctttggctctgtaacagtcggaagaaaaggacggatgctaccgaatttacatgttctttaatgtaagacttcacttatatggttaaacatatccatcatattttgcatgtagggttgttttggtttgaagccccaccaaaagtttattaatgtcaaataagatttggcactaacaaaattttggtaggattgtgttgtttctaactctattgaatggataagattcgatctccatccaaatagctaacaaaaactgttcaagaataccaaacaattgataggagaagaattgacttcaatccaaacatgcccgtaaacgatgactctccggtaacaaattgtaactgtccactcacaacggggcacataaggaaggtgcatttgcaacctattatggacaagttaggctcacgtctggcaggatggaaaggaaggctcattcagcaggcgggaaggaaaacactggttacctcagttttgagttctataccaacatacttcctcactgccttgaaacctcccaagcaattcattcaggacatggacaaaatgagaagaaaattcctctgggcggggcatcaagagctcagtggtggaaagtgcaaagtgaattgggaaaaggtgtgctcaccaatcaaattaggaggattggggattcttgatctcgacaagtttgcaagagcgttaagactgcgacggttgtggttctagtgggaatgtccacacaaaccgtggattggtacgcctccgccctgtgatgatcttgataggaagattttcgctacggccacaatggtctcaatcggtaatggtaggaaagcagatttctgggaatcaaattgggtgggacaccagccactcaaatatcttgcaccaacgctcttcactcattccaaaggaaagcaccgaacagtacacaaggctttgagcgataatcaatggatcagggacattaggcatgacttaaccttggcgctggttcaagaatttgtccaagtccatcaacagatttgggaaagtggaataactttagtagaggacaccgaagacactatcctttggaaatggacaaacaacgacaagtattcagcaaaatcggcatacatggctcagttcagcggcggaactggatcaagagctgccaatctgacctggaagtgttgggcaccatcaaagtgcaaaaatttcatgtggctactactgcaaaacaagatttggacagccgatcgtctacaactccgccaatggcccaacaattacttttgtcagctttgctacaggaacttggagacaacgcaacacctcttcaaagactgcccctacacaaaggaagtatggtagagggtcctctcaagattaaattgcaatcacactcttgcaccacacaacgacgatgagggcttgctggaccggtgggaaagaagaactagccacggcgacaagaacaaagcgaaaggaatgcgctccattcacatgttgctcggttgggagatttggtgcgagcagaaccggcgagtgttcaaaagcaaagaggccacaatgtcgtatctggtgacgaagattgtggatgaaatcaatatttagataggatgcggggcaaaagatttagctagaatagtgcacaatagcgcctgattgtaaccatcccactcctctgtagtccccctgccccctctatcttcctgtatccaccccccccccccccccctgttttccttttcttctctgctcctcacctcttggtgaatctgtacagttcttcacctgcttaatataaacccagcagaagctggcttaaggttttttttaaaaaaaaaacaaattgtaactgtgatcgttcgaaagccaaatcgaagggcgaaagatgcttcacaaaccgtccaaaccgctgactccttgttgcctgctcgcccgtcacgggcacgtacacgctgttccgcttgctgaaagacgggaagcacaccaagttttcagcggccgctcacatggagagtggcaggaggcgccaggccgccggccactggaccaacacgaaatctccctcgttggcgagacaactctgacatgacattgcttagcacgcagaggtcgtccgtccatggcaaaaacctcgcttgcacggatacccaagcaggcacgagctgccgcagcgccgggcaggggtcacaggccctctctttttttccatctctcgtcgcgcacagttctcccgaaagcgaccgcgccgcccgcgtcgcatccgtccgtccgcatgccaaccaacggcccgggatctcggcacggcccggtccatcccgcgctttcgcaggacaaaacatcggaaaccgcgcgcgcacccgcgcacccaccctttgaaacatttctcggcgtgagcccgtgcctgctcttcgcctctgcgtccaagagcatggccgccgccaccaccaccaccgtcctcgccacgcacgacctactgctgctgctactactactcgtcgccatctccttcgccggagcggcgccgctggacccggagcagctcgtggcgctgcgggcgctcggcctccgcccgcaccgtctcgacccctgcgacgacgcggccggcgccgtgggcgtggtcgccgcgtcctgcgacgccggggtgccgtttcggcgcgtgacgtccctcgtgatggccaactgctcggcgaccacctccgtctcggccggggcgctcgaggcgctcgcgccgtccctccgggcgctctccttctccgactgccccgcggcgccgccgcggctgcttccgccggagcagctcgcggcagggctccgggccttctcctgcgtcgcctcgctccaccgcctctccgccgtgtggctctcgcacctggagaacctgaccgagctcaccgtcgcggacactcccctcgccaccggctccccttcggagctcgcagtcgtcgtctcccacatgggccacctcaccagcctcaccctctccaatgccaacctctccggcttcctcccgcaccactggcactgccccaacctcacccacctcgacctctccgggaaccgcatcaccggcgccatccccgacaccctcaccctcctcagcgccatcacccacctcaacctcagctccaacgacctcaacgggaacatccccacctccatcggcgatctcatttcgctcaccaccattgacctgtccaacaactccatctccggccgcatcccggacactgtctccacgctgcccgagctcgaggtgctcaacctgggctcgaaccggctcaatggcagcatacctcagttcctatccgagatgaggggcctgaaggagctcaacctcgagggcaacgacttcgacggcatggtgccattcaccgccaagttcgtgtcgaggctgcgagtgttcagggcggccgggaaccccaagctgtgctacaaccggtcggtgctgtccgccgagatcgccatcggcgtggcgccgtgcgacaagtacgggttcccggtgatggcgccgccggcgacggcgacggcgcggtcggagcggagcgcggactacgacgacggcgcaaaggacggggacgcggacgagggcgccgacgcgcggggcgggcccagcgcggcggtgctcggggtggccatcgggctgtcctgcctggcgttcgccgtcatcctactcgtctgcctctgcaaggtgtgccggtgaggcggcgccgcgcgcgcggcgagcgagccgagcaagcgggaaacgaggggatctcgtcgaattcttttgcttctttcgtgttgagttggctggttgatccgtgccacccggtgtcccggtgaaatcgtgaattattccctagctagctcatgatcgattgatattctttctcatgtaatttttgttgcggttctttgctcttgatcgggttcaagatcttggtttgagagctaagaacagccatatacaaacgacagcatcagtttgagcattctgcagagccaagcaggcaatgttttggcaaatgttgttcccctgtgtctgtcaacacctgcactaatggctcgtgtgccactgttcgtatgtgctgcactgacattcctgtagacttaaactattctgagtagagaaaatccgtaaaagttctaaccaatgtacggcaatctaggatttgttactgaaactacggagggcctgttttgtcacatcgaatatttgattgggagtttttgggcgcgaatgaaaaaaaattaatttcataactcgcttgaaaactgcgagacaaatcttttgagcttaattaatctgtcgttagtatatgtgggttactgtagcatttatggctaattatagactaatttggctcaaaagatttgtctcatgatttccatttgatgtgatgtttttagaaaaaaaatttggagaactatggttgtttggtttacatggacttattctaagtccctgtcacatccgatgtttggacaataatttggagtattaaacatacactaattacaaaacccattccataagcttggactaattcgcgagacgaatcttttgagtctaattacgccatgattttgccaatgtgatgctacagtaaacttttgataattatggattaattaggcttaaaaaattcgtctcccggattagctcttatttatgaaattagtttttttattagtctatatttaatactctaaattagtgtccaaacatccgatgtgatatggactaaaaagttttagcaccatctaaacacccgtgaaccaggccggagtgatgttactggtccttttggctagtactgagcactgaatgagagatcagttcctgtctgtatagcgtgtactgcatgttcgagcaccagttgatccggctgtgcaaagagattagagatcaggccagtatttccttccttgcatttgattgtggcacaaacacacagggggtgcgttgttgggtggccgtgttcattgcgtgaggtgtaaatgctgtcatctgatgaagaggaaagtccattttctgctcctttctgcttggacctttcgagtcggactgcaattttctactagccttcaacctcacgttgccaaccgcgcgcaattcggatgagccgcacggctatcatgtacccctcggtcccgcctcagcgcaaccatccaaaaagacggaacagctacgaagctacagcattggtaagcttttcagttgggctgccagtttgggcaagcgcagtgatctcgcacgtacgcgttgaacattttgcctgccactcaaatggtggtactagtaaggcaaggccaatgtatgatgcacatacacatcttaagatggaacccataaatagttagtcttttttatggtatgatgcataatgttatggtctttaacatgggtcccactataaaataaaaaattaagatggctgccagcttctttgagatagtagggagagagaggatgtataggagaaaaaaaatacttgtttattcactatggctagttgtaagcttaaggtgcatcataagaaaatttttcctattgctaacttgcacaatatataaggtgtgtcttaagaatatatttattccttaaggttacctttttagcacattgtggttgctaatactagtagtttagtagttttctgtatatctacacgtattctgctactcgaatggtatgatgcctgaagaccctgaagtcagatttcactgctttgccacgctacacttgtagtacaagtcacaacagacgagtggacgaccacgatacattggttatagtagtagagatacaatcgagtactgtgacgtactgagtgtcttgatgtaccttggaaaatgaagtttcacagtgttggtgcataagagcagtttaatggtatagcccactactagctccaaatcatttgtagccaatgtaatagacaatttatacaatagttgcttactatactattaatacatagtcccacctgtcatacacacattacgtcttggagtccgtgctgtagctggctacagatctgtagcccactgctcttctctctcttcctttatctctttaaaatatgtttatagctggcttatagtatgctattgtacctgctctaagagcaagttcaatagtatagctcactgctagctccaaatcatctatagccaatgtaatagctaattcatataatagttgctcactatactattaatacctggtcctacctgtcatacatacattacgttttggagtccgtactgcagctggctatagatctgtagcccgctgctattctctctttctttatctcttttaaatatgtttatagctggcttatgcctgctactgtacctgctctaagtacatatacagttcaccacgctttgtgatgacaattttccgatgtgatgatcgccgctaatgagcatccatgattgcaacagcatcatatggaaggtgttgattccctcctcgatcgtgtccctacgtctatgcaagacagcacgggccaccatgggttccaactcaagttagtcaggtcgacacagcaaactatcataagcttgcccatgtaaacaatcaaatcttattttacatggtcatcatccagtcacaccttgcaccacattgctgattggtagattaatttatctacgttcttctatcagtaggagtagtagtactaattcgtggcaattaggtcgtagtattgattattgtcaagatgcaaaggcaaggaagcgtgctcgaattagcagtcattagtgctgtttatcatgaaaggatgcagtactagccgaaaagggtgttgtttatcatgaaagaatacagtactagccgaaaagctggtgctgaaaagttagtgcaagaatatggtagctagggaattttgaaggctaagcaaaatcttgtttgctattattcgcaagacaacggcgtaccttttttctcttctgcaggaggctacgcataagataagattcagtagcatatagtcatataacattacaaactgatcagtagtccaatttcaagttcaccgaagaaaaccttttctttccccctcttttttctacaagtatgattaaacggatttaacggtgccctctcatagtttcagcggcttcaacatcaaaacttcttatatcacagacaataacaatacaatgaacattttcatgcggagtactaacctacaacacctctcagatcgaggacaaagcccagagagaggaaaccacccatcgtcttcgtcgcattagatacacacatttgcaataccggcaaaacaccgccaaacgggatgctcctggagcacaaatgtcgctcagcagtcgaagttggcgcagctgttggtggtggtggtctcggagctgccgatgaacgggtcgatcttgacccagaggagggagaagacggaggcgagcaggacagaccagagcacgacgatggtgggcgtccggttctggcgacccatgagacccttgaggaaggggtacaagtgcatgatcacccacatggcgaagaacaccttgccgaagagcgggccccaggactcgtagccgctgttgagcgcgtcggagaacccggccaccacgccgacgaggttgagcaccaggatggaggtcggcgggatcagcaccgtcgtccacttgaacacgtacagctcgccgaactcggtgtcgtccgtcgccttggccgtaacggtgaagttggtgtccagcccagcaatcatcttgaggataccctggaacacggcgaagaggtgggcggagacgccaccgatgacccagaactgctcgttgcgccaccagtcctcgatgccgatgccactccaccgcagctccaggacgctcgtcacgatgatggagatgaagaggccaagaaaccatatggttgcagcgttggagagctgaaattaagaacgacaaatgaataatgtcactaagcaatgttcaacatcagaactcaaaccaaaaacatgtatagagacaggcatcttaccgtgggaatgatgaatttgcctgtgagcaggcaaatggcgggcaggcaacagtatgcaataagaggaagagaggtgaacgggtagacgatggtgttgatgtaggacaatctctggagccatttcagacgaccaccaccgtagccgtaccagagtgggcagtgccggctgaggaagatctcaacggaaccgagagcccaccggagaacctggtggagacgatcagaaaggttgattggcgctgatcccttgaacgcgggtcttatcggcatgcagtagatggatcgccagccacggcagtgcatcttaaacccagtcaggatatcctctgtgactgaaccgtagatccagccaatctatgacaggacagaaccaagaaatcacgctttgagttttaggaggaatgaacttcaacaaaggtatagataataaggggagaattaacacctcttttccccattcagttttctcttcatatccacagctaatgacatgaatggcctctttgatcagtgtagatgggtttgcggactcaggaacgcctccattctccataagagttgattctatgaacactgatgacagtccaaacgacttctcaaagctcatctgggagataagcatcgagcgttcatactcatcatagtctgcaaaacaaaccacattataatgaacacaaaattattcaaatttcgaactacttttatctctccatgtttgtgcacttactgtcaatttcccgaagattgaaaatggcggactcaaggtcttcacgtcgagagtctctatgcatttctttctcacttttttcagcttttttcttaggacagcagcagcagcaccatgaacagacagaagactttggaagcgcaggcagtgatggtggtccataaccatagagcgcttgcctatagaaacaacaaccagttcccacataaaccggaccttggaggccatcaagccctttcatgttaacctgcagatgataagtatgaatatataaattgggtaaagataatagtcatgcaatacatagtcactctcttagtacttacgtcaaagaacacaacattcctattggcataacgatcgctgcgatcaatgccatcgaacctttgtgggaattggacatagcagacatctctaccaacagaagggtccatcatgaaacacatcgcttcacgaacagctttgctattgttaacatagtgatcacagtcaagattaagaatgtaaggggcatttgtcagaactgcggatactcgaacctgaaaaattagaaaggtgaccaaactttcaattactatatccacatgataagtttgccatactttaaactaatacatatatgtgtaattttctctaggagctatttttaccaaagcgttcatggcccctgctttcttgtggtgttggtaccctggtcttttctctctcgaaacatagactagccgaggaagctcatttccgtcaaagtcccgagcaccggtctcaccaaggaaaacctgttacaaaaagccagtggtatggtaagtgtaagtttgaagaataggctatcgtctgcatgttctctatgtcttg

SEQ ID NO: 28487 - DNA, 5405 bp, Oryza sativa
ccatatgtgagtgtgtgaaaaaaaggggcttcacaaaacatttgaaccattttactaataaatctggaaaaccttgaattactctaatgacataattttaattaactgcatcctgaagagtaggatagaatttatgcacaatctcctggacaacaagaatgagcatatcgataatcaattgaagttgtatgacatatattatctgcgaaaatcttaaagtggaactgcataggattagactttctctcctggttttctgcatgcaaacaatagttaacacttgacatattttgtttcaaagcagaagtcaatagaatctctactccaagtggcaacctaaacttcatttattcttaacttttgtacaccagaaactatcccgttttcaggtgagaattacaaacttgcaaatctgtaaaaggttgcccggtatgaatacaagaacaaatatccaagattgatgttttggtaatgaaaactgaattacctggatcattccagggtggtcacgagggttgttcccaggccatggtgtcccatcttgcataatccagccttcctcaggtgtcttctgagccttagcaaccaaagcatttatcctcaccttgtattcttcgtaatccctctgcacaaaatgtgatagttgctttaatattagcaaaagtacaatataacataaagagcaccatcaaactgtataaattcctatctcctttcatagcccgacgctcccttgacgaaagatgggtgtatcttgtccttcaagtagtcaatcttctgtgagaagtagaactcaggggcacgtggctcaatggagtacttcttgcaaaatggaacccatctcctagcaaattctgctgtttccgcaagtgattcaaatgtgagcatagccgaaccatcgtctgacacgtaacacgaaatcttctcaactggatagtccacggcaagaatggacagaacagtattcgcagtgattagaggaggctctttcaatggatccactgtactgacaaagaaatctacaggtgccaacccagaatcttctccatctccatatctgaaacaacacatgagcaatgcagcttatgagacacaaattcttaatgaatagtaatgtatatagttttcatatacaaattaggctttagcgaacacaccgtgcaatcagcctatcaacataagtttcgcgattgataggacaccacttggggaactgatccaggatccaggagaatccaaaccagatctcacatatgactgatgtcatccagagaccaaaggcgctgtaaacagggttggtgatacggtagtgaaagaagagccccagaactaccagacgcataatgattactgccctgtaaggtgtgagcttgttcttcgatataggaatgatccgagaaagtggctcatatgcatctgtcaagctgcaaaagggcaaattgcttggtattacaatcaattctccaagtacagtgttatgtcaacaatcagcatttaaaacctgaagtaacaagagtttctgaaactgagactttactggcacattatcaggatatgaacacgaagttaaaaaggttgcataataggctaggatagtatactggaggaacaaagatgaacatgtactgttcgcatcacaaaataagaaggcctagtgttataccagaaaaagataagctgcaccaaaatgaaaccttattaatgaagtatgaaatatgatgtgttaagaacttaagattgactacatatgctgatctcgaaattagctaaagggtttttctgtagtaatccaattagacgttttatattttagcattgtgagataatatctgcattagggatttattagttcagttctaaacgaataacgtctgcataagacaacaagttcagttctaaatgcacatgatctggcatctagtacattcaaagaaaaggttagatatagccagattctaaatttacccaaaccataaagtttgtttttttatatgtcaacaaggatcaagagtattcttagcctattgatctaatcagatatattttaatatacacaagaattttcatttgtaactgtaaataatgtatatgaatcaagaaatgttaagtttttgatggatcacatggatctatgaaatggttccatgttccttactctttttcatccataatctgttcttcaacaggtggagcttgagcttttgctgcagctttctttgctgaggctttcttctctttctttttctccttccagctctccaccctgttcttccagatgggcttcccagattcatcattcaattcttcaaatccataacaagtgaaaatatatatatatatatatatatatcagtactcagttggaataatgcaaggaaaaatatgacagacaacgagacgagttgcttaccactcccaactccagagacactgctaattgtcctggcatgggtgctcatagtcctggcatgaactccttcatcctgttcccacaaaatcccacacaacattgtcaacaacgtcggagcgctcaagctgttctacccagaattgcacgagtttatggagagggctattcacctggtgatcgctgagttggctggccatggtgaccctctcgcgaacaccgccggccgccggctcgtggctctcttccacttcctcctccacgaccgccccctggccatgcgctgtgacagagatcaacctcgtcagaaactgctacttcatcccccgcatcgatcgaatcccgcatagggcaaaacagtaacccgcagcgcgcgggggcacctgggtcgggcgcgccgtactccccgccgcagcgcgcgcaggtggtgcgtccctcggcggcgtcctcgtcgaggcaggccttgcagagcgcgtagctgcaggcgcggcaggcggcgtgcgcgtcgtccccgcacgcggcgcagggcgggacccccgactccatcatggctcacccccctctcctctcctctcctctcctctcccccaaaggagacgctccggggcgccgcgagcagcagcacgcgaccgcgcgcagagagcaatgcgcagaatgggagggggagagagagagaggctaagcgtaccggaggttggaggcatggtgatatagccatagccgcagaggcgcgaggtggggtggcgctggcaggcggtgggtggggttggggcgtcggcatcgcgtcgatcggcgggtggatggaaagaatggaagcaaggttgagcggacatggaacgggagagaggaggagaggcgggggaggaggaggcgtgcgcgcggcaggtgttcggtgttttcttccatggggttttgcggggtttcgaagcgaaggtgacgggggatttggtttggtttgcgttggccgcggcgaggcgcgtaacctgcaaggcgtaggggggatgaggggtgggggatcggactagcgaacggccggttggtgcgcgaggtgaggagggtgggtccgccggatcggcgagagcgctcgcgctgtggcgtcgtttttgacagcccgcttgctgcgacggcgacgggccggacgcgaggtgggaggtcaggtgctccgatctcgcgcaagagttcttcgtgttccacatgttcacggccaccggcacggcacagcacggcaagagctttggttcacggcgcttttgcggatgcggtttcgttgtactcgttagagaagttcatgtgctgagatattggttgacaatgtcgtggggcttttaactttacgagtttacgaccgacaaattgttaagcgtggcgtcgcaccagttttttcatgatgtggcccgtggagagcctagtactgtttcatgcttcacttttttacgcatcgtgattcgtgaacgtcgcgtataacagtaccggcctagcctctgataatgtagttccgcgtccttacggggcaggtgcaccgtgcactcctctcagtctctcacatcaaacacacgtatcgaactatcaactaccgtagaagagagaacaatagcttttggattgcgactgttctattcccctaatttcattttcctcctccaaccatagaaacggcaccttgacagacaaaaccatatcaatttaactccctcgtttgcactgactcggcgcttacttttttttttaaaacctaagtcagcctgagctgattttatattaagcagaggaagaactgtacataatcacccacggtgattagagaggaaaaggaagaggaaggccgagtttagttccaaactttttattcaaacttttaactttttcatcacatcaaaacttttctatacacaaacttttaacttttccgtcacatcgttcaaatttcaaccaaacttctaattttgatgtgaactaaacacacccaaagtatataaaaaaaacagcttgccacaacgtatagttttaatgtgctattctcacaatgtctttagccccacaaacagaccataactggacctcatccagcaccttcgccaccacctgaagcattgagagttatttatccttgaagattcgtctatttctttcacaccatacttcccaacagagaagcacgtgtagcgatcgcaatccctttgtttgtctcttgtcctgctgggatgtcctcttttcccaccattcaatcagcttctcctctggattgtgcgctagaaataattgactgcattccagtctcgcagctactctgttccagacctctcgtgtgaacgggcaatccttgaacaagtgctgcgccgtttccaggtttctgtagcaaagctgacaaaagtaacaatttggccactgtctgatttgcaatcgatccgctgtccgtaatctgttatgcagtaataaccaagcaaaattcttgcacttggacagtgcccatgatgtccaaatcacggtggctgcccttgattcctctctgccagcgaactgggccatgtatgccgattttgctgtgtatttgccagtattcatccatctccaaatgaccgtgtcctcagtcccttctgataatgctagttcgctgctccaaacaagctggtagaccgcaaagaattcctgaaccaatgtcaagttcagatcatgcctgatgtgatcgacccatttttcatttgccaaagctgcggcgcttacttacagtagtaactattagagaaaaagtaaaaaagtacagtctaatctatcttttatcgcctaagttttactttggaccatccataaactaatcttttcactttggacctgggtaactttaccatattttcggtttggaccacctaactctctttactatttgtatccaccattggtttccatcaatgctcccttctgattcctacaaacaacaacaacaacaaaagacgctacttatgatttgcaggaaaaagttgattgccttgttatagggggc

SEQ ID NO: 28488 - DNA, 2924 bp, Oryza sativa
caattcaaatccacatcaaatccaatcatccaaccttaagagaacactatatcaatttctcacttcattctcaacaaacaaaaaaacatcaatacatgcatatatgaaacatcatacaaacataaaatggagaaattcatcgaaatcgtcgtcgcccgcttgccatcgccactggcgtgaccgccgcctcctccctccgactagatctgggagagggagagggaaagggagagggaagggaggaggaggccctccggtcgtcgtcaccggtcgctgtgatcgtcgtcgtcgtcgtggtggtggtggtggtcgctgtcgtcgtcatggtatgacggcggcggatccagcctccccgcctgcgcccgagcgccgccgccaggtccgcctgtcatcgctgccgcggcgggcggcggcccctccctccggctagatctgggagaaggagaggaaggggagagaggtgaggtggagatgagaaagagatagagaggagagatggatgcagtgggtgggtgggtgggtgaaattgcttttaaatgcgtgggtgggtgatgctgtgaaggaatcgatttgtgagctgtgcttttcgctggcggatccgttttttcgctggcggatctctatagtagccgctagcgaaaacgctgatttttgctggcgaacatttaagaggtccgcctcaaaataatatatattttttatggcggacctcttaatatggccgccagcgaaaatcagttttcactggcgcccccccccccccccccgattttctacactggctgttttttcttatagccgccatgaaaaatattttccaaaccccataaaaaatcgtttttctagtagtgtgcgatggcccctttgccgataaaagatggccacgtcgagcaggctagtgtgggggagaggggatccattcttttttttcaccctttccccatccaacccaattgcgtggatggagctagagcgcgtcggggttcgtgcaccttcatgatggctgaccaacggtgaggcgccagagcggtggccacgtgttgaaggtttttgaatggtggtggcagcggagtgtgacaggaacctttcttgggaggggcgaaataattatgagcgaaagctatgccttcaggccggcaacgacgatgcttgtgggtgccgttttcctattggggcgttgctgtataatctaatctcgtctctcccagttactttcttcaggtgaaaaccatgtcttggccccaggccaggcggcggcggcgcgctcggcgtcgtttcgaagatcgctagttcttgttttcgctctcgcagcagttgttgtcgtaaacgtatggtgtggctgttttttcttaactaccatcttctagaactatagacttatatttttctcctgctttatcaatacatgaaactcgcacgctatcagactttttggaacagaagtgtgctgttttgttttggacttgagagcacacttaaaacgggcggcgaatctatgtggcccaccataacgttgggcttatttccgtagtccggcaacactcgcgcccgcgaccgagcggcctagcacacacactacagtctcgcacgtgatgaacgcatggcccaaatggtcgcaggcagggcctagcacacacactacagtctcgtacggtgcttgggcctgttcctgttcgttgcttcggcctccatcaactcacaagcggaaaagcctacatagttaaggcccagaagcttctttttctggagaaaggaataagttcacaggatgtccctcaacttaacagtgagatttgtgagtaaattgcattagcggtacacaaacttgtcaggtgggtgcaatttagtgtatgaacttgtaaaatgctcgttttggtgtataaacttatctgatacatgcaaactaaggctaaaatagcacgacaagaccgatttttctatgttgaacattataaattataaattagtagatgagtagacgactgtgtgcacatagtagtagaaatattatatttataaacttagtttccactttatctttctttgtttctatcccttgcatcattactcggtttttgatttatgtaatcattatgccttattatatgtttatccttcttagacatatgtttacatagagtttaaatcaacaacaagattaacaagattaaccttgccgtgcaattttgaccttgttcgcacgcaccaaacaagtttgtgcaccaaacgagcgttttacaagttcatgtactagattgcacccacctgacaagttcgtgtaccacttatgcaatttactcgagatttttttagttcccttaaccacaaaatcagaaatgtgtatccctaaactcacataaatcgtgcactcaaggttctatggcagtatataagggtggtttcactaatgtggcatcctagacaacaaaaaaaaaaaaggtatgtgtggcccacatgtcaggtgcatatttttttcttctcattctcttctctttactttcttctcttctcttttcttcaagggaggttgtcggcgttagacagggcgaggcggctggcggttttgtactcttggtttgtggtggcggcggcaggcggagtggctggcgaggggagattggccgccccgggagagcggggtgagaggagggccgagagaggggcagagcagccggcggtggagggccgaggccgatccacgagctcgcgtcgggaggagaaaacaatgataggatgccggtaggagaggagggcgctggcaggatagtgttgacgacgacgagaggatgccggcgggagaggcggtcggcgcgaagacatcaccggcgacgagaggcggagggaataagtaggaaggaggtggtggcggctagaaggggcgaggcagcgagagcagatggatcttcatctatgggcggcagcga

SEQ ID NO: 28489 - DNA, 31416 bp, Oryza sativa
  unsure (1)..(31416): unsure at all n locations
ccccctaaatctgccttgcctggaccacctagggaccttcaccaccacctcatcaaccaccccaccgtcggcacagccctccactgaccccgttgcctagcagccaacccacctccgtcgtctccatctcagactcctcccggcgcgagctcgcgctggcctcggccctccactgtcggccgctccactccgccgctctctcggccctcctctctcgccagcgtggccggccgcctctcccctcgccagctgctctgcccaccgccgccctcacaactgaggatgaacaacgttgtggccgacccaacggtggacgttgggcggggtggcagcgggcgagcgcggcagcgggcggcgatagagggggagagaggcggccgcagtggcgtgtgtgcgtcggtgtggcagtgacagtggagctcggctcggctcgccagccgcctcactcccgtctgccgccgacaaccaccgttgaagagaagagtagaaagaaaagagtaagaagagatgtggcccccacatttttccttctcacttaacttacatgtgggatccacatattatttttattttttttggctgactaggatgccacgtcagcgaaagcacccatatatactgccataggaccttgacctcgagtgcacgggttatgtgagtttagagctacacatttctagttttgtggttaagagacttcaaacaatctcgctgttaagttgagggacctccggcgaacttattccaaacagaaaacacgcatggcctgcttggcaaatgataacgaacaaatggcccagaaactttcacagttgcttggttgctgcttccgcttgtagcttccatcatatagatagtgagatgttatgatctcaacttaatgaaatgaatggattggccaattatattgtattgtatactgcatggttaccgtcacaaaagatgcgtgatccgctgatccgcatcatccagagttatataatgggagaccaaatggaccctgaacaggtaaaaggaagcatgtcgggagctgcacaatatttcttctctttcgttctcaagcgcaatacacatccgatttgtgctctaccacttacatcaatcatgcacacattcatacgcgaaaaggaaggaattgcttcgacgagcttgaacatgcctatattattctcgtcacacaaacacaaaagtcaatcatagcgccaccggaacaacgaggagccggataagatgacttcttcatcatttcataatagcaaacaggacgccagccaggcaacgtcaaagaaataaaaaacaggagcagacaatatcgtgcatgcatgtcactttcagttttggcaagcaggcaggcaagtattccagccttccttatttctcttcgaccacaaaaacaagctcaggtaaccgaagctagcaagcaacagacccctgatatttcctcccttttataaaagcattcgcacaattattcctcgttgcagccggagaaaaacggggccagaaaaatatcagccgcgctacggtacaaaccggcccaggcccggcggccgcgagagagggtgacggccgcgtgacgcgctcccgcgtacggaacggagcacgcgtgcgcgaagtttcctcctcatctcatccaccccctctcgcaactctcgcaagttgcgtgcggcggcctcgcgtcgtctcggtacccatctctcgtccgtcctggaacacagcgcggtgatgtgaaatctgggccttttgtctccacctgcagccgaagcttcggtcgctacacggctcacacgcgcacgcgcacgcgctgcaaagctaccagttgggggggctcgcgcgggcgcggcgcctgtcgcctttgcgggcggtggagtttttgtcatcaacttgagcgtcgtagcagcgacttctcggcttgggattcggcggggacgggaaatcattggagttccctgaatttgtcctggcaatggcaacgcgagggcgctgactactactactacgaaggggatgaatcaaggatcgctcgctccgataaggaaaaaaaaacttcctgtttgatcactatcatgtcaacctcttttttcatgtacatgtgcgccgtaggctgtagcttaagatctaagtaggcgcatcgtttcaacgccgcatgccgtttgtcaaagctgcgtagttcagcaagaggagagatattgttttcttagagcaggtttaatagatcctaatcagccggcgctagcacgcttcgcgtcagccaaatctgacgtggaggagtgagaagagaaggaaaagaatggagcgggcgttccgtttatcgttcggctgaagcgcaacacacgagaaaaaactgctttcttccaaccaaatgcgaggagatcaggtgtacatgcgaatattaaatatgtaaatcttcaatagaggtaaataaacagctaacctaatagccagcctattatattagtgatggctataggtgacatggtactaatacagaaccggcagctggctatattattatcattgctcttagaagtctccctcctgatcagcgaggaggaggcggaggaggatgaacgggtcatcaatcgtaaactagcgctaataattcgagggccgtgacgcgaattaaagaggcgcctgatccatgacagcctcccgaaaacaatttttttttgacaagccgaaacaattatttttatcgcgaatgattgagatcgatggatggatcgaacggccggtcgatcgataccgacgcgcgcggctgctcttctccgattcgtcgtcgtttttcgcctctaatcccatcgcgaaatccggagcaagaaacggtctacgcatatttggcaccggcattctcatggtagcttgcttgcattagccgttgcatttgttgatagaactgctcccgccacgcacatgacatcgttaatctggccagcacccgcagtgtcttagtactccctccgtttcaaaatgtttatcaccgttgactttttaatacgtgtttgattattcgtcttattcaaaaaatttaagtaattattcattgttaaatatactttcatgtacacatataattttacatatttcacaaagttttttttaataagacgaacggtcaaacatgtgctaaaaagtcaactgtgtcaaacatcttgaaccggagggagtactatataatcagattagttaacagttaacaacacgaatcacgaggctttggcacgttggtgctggccgaaaccaaggcgagggggagctttgctttgggttaaaacataaaagtactccagtagtaggaactttgatgctactggtactatttagttagtgatccggatcagtacttcagtaggccccgcgtgacggatcgaagaagataaggtgaagcaggtccctgctgcctcgactgactaattaaagaatttggcgtttggttcgtgattaagggtttggttacaccgtgtcccgctcacggataggctgcttaattctcttttttaaaaaaggttttagctagatgcgctggtgctgctgctgctgcttccagaatccaaactcatgagcttgaccaactgaaaagccaatccgtatcatctcaattactactccttacaagtactactagtactaaatatgtactgctgttagtagtactgctaaaaagtctaaagtagcacaaaatcagaacacacattttcagtattgcaggagataatgtttccagctaaaacacagcttcatcctcaagaagcttgttgcgccaaaatagcattattgggcacaagttagcgactagtgagccccctgaaaaggagcccaaaatagcgttctatagatacctttttaatttcatcctcccgtttggacaaaaggaaacaggtcttggattggagcacatcatgatcaacatctcaaatcagtgatgccgagatttctgcacgtggggaacgtatttctattcgtcagaacaaaaatgaaaaaaaaataaatccagctcgcacacaatacagggaccacttctcagtagcccaccacaaaaaaatctagtactagtatatggatcgatcgatgcccgcatctttcgtgcttgctgtactcagttaatcatacgggctgctagcattacaatatccagatgaagaagttaatgtataacaccatttgtgtcagacagagatatcaaaaatattagagcggtgtaaattaagctagataccgtgcatgagccactgacagcatttatactagtataagatcgaaacaactaattaacaagtaccccaaacaaagccatcgtctatgttttttattttcaagtgaggcacatggaccattgatggttggacacctatagctcgcaattgaggggaaaaaaataaggagcgcttcgatacaacttgcaccggctgtaccctctcccaggaggccggcttcttgagcaccacatggaaaagcttaactgccgtagtttcagatcgggtttgtacacctgtacgtgaacccacgtgagatgcgagtgattcgtgaggtagtatcatcgatccaagctatctcacgtgtacacctgtagtagcgtatcctccgccgtttgatcgagatccaacgcaccagacggattgctaacaaacaatacataatcttctatttttttgttgttgagatatatatgatcacgtcacagggcggcactggttctggaggttcgtctgtgaattaaaccacgctaaagtacagggtatccgtatagtattccttctcatgtacgatctggtgtgtattgtgtttccacggggatagcagcagaagcacggggatgattggccagatcgggttagggagggggtcgccatcgccgcctgcactagattaatcgctcgccccggcccagaacgtcgctctctccgtccgtccccggctcgccaccatctcctcctccaagacgcaacaacgagagtgagagagagagagaatcgagagatccaatccagtttgcgcaacgagtggcatggcatgcaaccgatctagaacgtcaaataaaaacaacgccatgcgtacatacacgttcatgtgccgcgcgccggtgtagcgcagcgtagagagagagagagagagagagagagagagagtatggtagtcttcctacgctcggtcagtgacagcgtcgctgcgcataaagaaaggcatccactagcaggagccagcatacgctgccgcatatacaaacacgcatgtagccaaggcgaggagagagagagagagagaaagggagatcattgaaagctgcacccatccgtttgttcgccaccatttccatcccctccatcatgagctccaattagccgcacaccgatcccctcctcttcttcccccccttctcctctctcctctttttttcctcatccgtgcgcgatactgcgcttagtttgtgggtggggggagtgatcatcaccaaagccacaaagggggcgcggagagatattatatattctttgggaaagcgttggattagtttttctcgctttgggctttttatccggagttggagtgtgtgtgcgccgggagtggtggtggtgatggcggccggagaggaggtgatggatcggtcgacgtcggccgaggacgggtactgcagcgccggcacggactcgccgcgggcggagtccgtcgacgagcaaggggccgccgaggagtcgtcgccccggggagggcagaagcgggagctcccctcgccgtcggcttcgccgtcgtccccgctgccacctgccgcgaagcgcaggtacggataatattatggctcggtctgcgattgattaaagccctaggtaggatttagggatagaggattgattggtgtttggttggtttgagcagccggaggtcagtggagaagcgggtggtgtccgtgccgatcgcggagtgcggcgaccggccgaagggcgccggggaggggccgccgccgtcggactcgtgggcctggcgcaagtacggccagaagcccatcaagggctctccctacccaaggtaattaggctttatattcagtttggttgatattcttgagcctgttgattagttaccgtgctgattaatcactgcaattagatcagttaaacggttgttgaagtggcaagatttaatttgggtttgttgcttgtgtttattatgctcagggggtactacaggtgcagtagctccaaggggtgtccggcgaggaagcaggtggagcgcagccgcgccgaccccaccgtgctgctcgtcacctactccttcgagcacaaccacccgtggccgcagcccaagagcagcagctgccacgcgagcaagtcgtctccccggtcgacggcgccaaagcctgagccggtggctgacggacagcaccccgagccagcggagaacgaatcgtcggcgtcggcggagctggaggtaccggagccggagccggagcaggaatctgagccggttgtgaagcaggaggaggagcagaaggaggaacagaaggctgtggttgagccggcggcggtcacaaccacggtggcgccggcgccggcggtcgaggaggaggatgagaacttcgacttcggatggatcgaccagtaccacccgacgtggcaccggtcgtacgcgccgctgctgccgccggaggagtgggagcgcgagctgcaaggggacgacgcgctgttcgcggggctcggcgagctcccggagtgcgccgtcgtgttcggccgccggcgcgagctcggcctggcggccaccgcgccgtgctcctgatgatcacctcctcttttctttttcctccccttttacaatttcccttttttttttttgcttttctttagttctccttggagtaatttggattggaggttagtacatagcttgggtgatcaatgggagtgagtggcttaactgttcaagagagcctcctattcccactctccaaattgcgtcgcgtgttcgtcatccaaagcccgtcgtgccgtttccgaagtggttggcgacgtgattccaacgacaaaaaagcagcgaaaggtgggcattttcaggcgtttttcctcgccgtctgtgtcgaatagacgcgcacatcgatcgctccaaggcccatcccgccgagtgagtgatgagtgagttaggtttctccgcacgcacgcacgcacgtccccaccggctgcggcttgcaagtgggggcctctcgtctcgtccgatgcggaatccaacggtaagcggcactggcattagccgggcaagcgttttcggcgtggtagttggaacttggaaggatgcgcgcgcacgaggccacatgcccgggtagtgtggcgctgccacggatccacccgcgggacgcgtgccgcgccttcccgccttgccggccacggcccacggccggctgccgccgccccggtccgcttggcgctacgcctacgcgcgagcgggggcgggcggagcaaaacctcggcgcagcaaaaaccgctttcccgctagccggctgccggccggaggcgcgaggctagcccggctacgctacatgtatgtacgcgcgctgccgcttgggacgtcgccgaattggtccctatcgcggcgcggtgcgtcgtgttcgtgccgtgtcgcgacaccgtccctgttactacgagagataggggcaaacggatcgttcggctcagggttccatgtatctagccggccggctgttccggctcgcgttctgcgtgtgtatgcatgtatcctgcgaggcaggggtgggggaagcgaattcgcggatttcggaattcctcgagtggtgtactagtactgttggtgttcggagaggagcttttgtttaattcgtttccagaagtaaatacaaggggacgatgctagattcgtgatgccatcttctccatgtggcgattaatttagaaccatcttatctcagcagcagttaagcactactacgtatgtataggcacctcttttaactgctctagatcatgaacacactttttttcaggagagattctcacgttgtgcttgaaataaatatttcaactttccaccaatgacacgactaggaagtaggtaccaaagtttcgtcacatttttgcttaagcaattactagaacatttatttattcgtctgttagcttcgatgctaagagacaagctatacagatgaaaaaaaaaagcttgcaggactttccgatataatttccccatgacaatagaggggatagctaggactaaaaggtagaggtcgtagaaaaacgcatgatcagccaactttacaaacaaaagataaaacatgtgactttactagcctatttggagtcattatccacagtcggacatttcacaatctgaccacgtaagagtagatgataggaatcaaatcggcaggaaaagacaaaagagttgttgtcagtttgtcactgacgtaagggtggcatccatgacaaacctggcttttgggcttggctatggctacttgcatgtacttggaccaggccttgtttgctgatctattttagacaatgaatggataaggccttgtttgctgatgagtttctgagtttacataacagagcacacctgcaggaaattttagcatccatcaggaaggacacgcaacatgaacttaagatgggaggcctacattactactgttgcatgtgccactctttttttttttagaaaatggattaaaatccggcctctacatccacagtggatgtacacagtccaacatgtgccactctaaaggatgcagttaagcaactcagcacaagccatactgtcaaaaactctaattgttcagaaggctgtcagaatgccccgaaatattgccaggttcccactgtaaacaaatgttttgcagaattatgtcgaatacagtaaccaatctgacgaaaggagctgtcttgagttaagactttcaagaaatggtataactgaaagttggaacaatctaactctcaatatcaccacaacaaaatgaaaattaatggacctctttcaatagaagcaacatacagccgtacacctagtggaaaaaatcaacaagaaatgcatctctactctaatttgagcaacagccaattctcttcagcgcagacacgtcatctttcacattaatcttctctcctttgattggagcatttgatccatcatctgatgcctcaaccgtcttcttgctgacagtttggtatatctgagtcaaaacttctgcaaaagcattctctacatttgtggcgtctaatgcagatgtctccatgaagtacaatgactcagcctcagcatattcctttccatcttcagttgaaacagccaccagatggcggagatcggatttgttgcctactagcatgacaacaatactagggtcagtgtggtctctcagctcttttagccagcgtgccacattatcgaaagtagcacgccgagtgacatcatagacaagcagtgcacctactgctcctctgtaataggcacttgtaatagcacggtatctgccaacagaaggaaaatattaggtaatcatataattatgcactaaagaaaatcataaagaaggatcagctactcccactgttccacaaagagtttacttttagcattcaaaatttgtccacgaacaatttacttttagctctgaccctactcactccacaaatcaacatactctctcacacacacattctccaactattaataacaaggggaacctaagccattccctcacagtactaatctgcaatcagtgtgagaactgctacaaataaattcttcgtgggatggaggtagtaattctgattccaatagcaaacatgttcaaaattgtccacaaacaacagaactaaaaacaattggcatgaacatttgatattagaaggaacattatgatgccttatttgttatttcctaggttaaaaagtgctgccaatgtgttgctacagtaatatgtgatagacacatggcatgcatgtagtgaggaaaaggccaagctatggtaaagtaaggtgctctctataaaacatgtacatctcagcaatagactaaattaatagtaaaccacctcaatagtatgtctacatgggtatctatagctctctaatccattgcctcgtttttctctatagattatctccaggttagtagatagctttgctctctctcttcattcaatctattccaagtaggaaaatatgctgacatagatctcttgtagagaacctatagataaccattgcgggtgccctaaggccataaggggcaggccatcttttcctgttccccttcgccaagtccagatctaggatttaagctctagtcattcacatcaacatggtgtgactgtacaacacaccaaattgcacgagcgggtaacagattattggaatggagcaaacaaccgccaaactcacagtcaacatctcaggtcaaggtcagtaagcaaggttgctttttgtgaatgtgtgattggcttggttgctgaggcgtctttatggtataacaggaatgtggaatttagaaatattaaggatccaaatagaaactatagcagaaaaataaggcactggtatagcacaagttatacattataaaattttctgtgaaagctttgtgattttgttgttaaaattgccaaccaatcctagttcaccccacgtccccacccaagtcagtctatgtgtattttgcattctatgattgtctcggatatagatttactagtttcttagactttaatttacaatagcatgcaaggtgttttcttaatataaaattgtattcttttttagatgtggaaatggtttaaatctcttgcctctgctaacaagcacactgcacacggccaataagttttattgttgtataaaaattgagtgatgggcctcccccaacctctctaaagaaaccatatggacctagtatttctgacagaactattcttatccataattcagagagacttataatgaaccaaaagtttctatatagtacgaacaaagttttgcactgtccaattaggatgatcttctcgatttatactccccctccaaggctccaaagcaatatcaataaaactgtgtggtattgcaatacagtgcgttaggtagttaggtatacactacataagccgggaaccaaagtatgcttttgatgcgtatttatgcactcctcatgatgcagaaatgtcgtgaccacaatggcactttctactcttgagatccatagcaatagaagccctcaatagcgaccatttcgccgctggggccgcacttatcaataagtcctctaacacctgtgaaacacctgtcccccagttaacactgcagctaaactagcatcactgcatttttgacacatagcatttcctctgcttcctctataaacttcgaatggaagacgacacagcaaccactttcgctagaacacaacaacgatttttggtggtttcactctcgaaccattaatctcgaatgaaacagacatggacgtcccaacagccaaaccacgtgtcacctcccaatctagtaatctaccctccaggagaaccagccagatgtgaattggcactcactacactttcggttccatgccaaattcgtgcaggaactatcaaggtcaaatttacaatattaatgctctaatatcatcagcaccgaactagttcaaacaagaaattaaaatcgacaacgacgacaaccaaagttcacattttttttaaccaaaaccaagcaatagcgaagcgcctacaaacaatctgcaggaaaattatcggctacgtcgcactctaacttccaagagaaatccatgagcatgcggccagcagcaaatctagcagaacacactcgatgcactacccatttgcgcaccaacgcgggaagcggctagagtaggagaggaagggggaggccgtacgtacctctcctggccggcggtgtcccaaatctgggccttgacgaccttgccgtcgacctggatgctgcgggtggcgaactcgaccccgatggtggacttggactcgaggcagaactcgttcttggtgaaacgcgacagcaggttggacttgcccacgccggagtcgcgatgagcaccgtcttgaacaggtagtcgtagtcgtcctccgccctgtagccgccgcctccgcccgccgccattcccgcgcactagccccctcgccggccggcgcttctctctcagctagctagtggcgttcggctttggatctcgcgggctttggaggacggagcgagcagttgtgggcgctgacaggtgacaccgtgacagctgagctgagcttgctcggttttcttgcgccagtggccagtggggttttaatttgtctgaactctgaagaattaatttgctgctcttcttacgcagaaagtccactctacttctttttagtcctctctgttttatttaacctacggctgataagatgtaaaataaattgaacgaaaccagttagtactaggattttattgtaggggccattcatattaatgccatttcaaatcatactatttttttaaagttgctaaatattcgtatatatttaatttcttgataaactttgataaatatataagaaatactgccattgccaaattttagtaacgtttattttggctacaatttaaacaaccctgtagtctgaactaagaattagtctgttgctttttatacgtagaaagtcccctgcacttctttaatttaggcctatgtttgtacaagctaccgccatgaaaataataaaagaaataacaaaaatcatttctaagtaaaatagtattaatgatttagaagttcatattaaaaaatatactacgagtctacgatgaaataactctaaaatcaacttgaaactgagttctaaaatttaaattttgttgtggttcataggctaataaagtatgactctttggtttatacgaattctgtaggaaaagtagattaattaaattcttctagggttgcactattcatttttttgatggatggagcataggaaaaatagggaatatctttcctttgccatagatcaatatgaattgaaacatttacaaacatctattttttttcattccttttctcaagtaataaaacaacaaattgacacaagttaatgatacattaaccaaatgaattataatttaggtttgttttgtaagtttcatgtgttaacaacccatcttacattttccttatgtcttaatcatctgtgttacacgtaagtacacgtatgttcctatcatattcatgcatgtttcctattcctatagtttttcattgttgcgttttataggtgtccctaagcaaaaactttttgtcaagctcctatagacagcggtgatggcaaaggggtcaaatgaaatattttgattgtaaaatttgatgctagattgaatttaatctaaatttgaaaaaaaaatagtatatgcctaaaggtcggtcaaacaaacattcgtaccacgggctaattaggtcccttatgatttgatcgcacctagttagacagtctaatcgggctaattaggtcccttagagcaagtttaatagtacagcccactactagcttcaaatcatctatagccaatgtaatagtcaattcatacaatagttgcttactatactattaatacctggtcccacctgtcatacacacattacgccttgaagtccgtgctgcagctggctacagatctgtagcccgctgctcttctctctcttcttttatctctttaaaatatgtttatagctggcttatagtctgctattgtacctactcttatgatttgagctgtctgatcggcaacctaaagtctagatcgaatttagttttttcttttcgtgtgtattttcttgctctaggatcaaggtttcttgagtgctactgtatatctatcccaataatacatgaaaagtctttatttttactaagattaatatctttataaaggttatgccgattcaattgagacaatgcaattcaatatacaaggctcgtcatttactttagatttactctactttacccctacctcatctgttggtttgcatggtaaccattcaccttcgcggctaaaatgcgattttttaaaaaaaaattatcccaaaaactttccagttcactagataagtgtttatgctcagatcggtctaaatcgtctttggtagattacttgatatcattatgaaaaagatcagaagctacatcaccgtacccgtggttggagatcaaagcgcctctacagctacttcgtttaagccagtggtaggtgttaatcataaaaagacttcaagagaatcacagctccggatccgctaccggttaaccgtaacccaaccgaccgttggacggctctctttatttcttgaaccgcgttaactactcgaactcttgcgagatctcctctcgaactcgttaaagaaaggcgtgacgcctcctcggtggctcgctcgtgaactcgtgaggcgcgaagtgccggccgccggcacggtaaggcccgagacgcgcgcgctcagctcgtgggatgccttgaggccagaaccctcgcagttttacggcaggaagagcgttcggtgagatccagacgcgcgcggtttgaagcttgaaaagccaagcgaaggccatcaaacgatgataccgatcagagtgtgatcagacgccttgttgccgccgtcgtgcatggtatagttcaatactaccggagtacttggtagatgcagcgacagaggatatgccagcgcgcggcgcgactcagatcccgcaggccggctacggctcacacgccgcacatgcactcgtgcagcgcggctgagcccacgttgatgaaacagctagctagtagcctagtagtacgtgcttgtatacaggtgggtgacgggtccattgccagtgtgacgtgcccacaggcacctaccgtccgtcaccactcaccaccctttactactccagtacccagcagaagatgatggcatgtagggtttcatctagttccagtctaccctttgtacaaataccaacatgagatgggagtccacgagcagccaagtatctggcagtatggcaatctctatgcaataactgtttgacatgaggaataatccatagggattgggtaccattcacttctaaatgatgcaaatccatgtttgaataccggcacaaaatgatgcaaattatgcgaactgcttatgcgtatttccttaaaaaaacactattggcacaaaaaaaagtgctgttcatatgggaactaaattcatccaagtgaaaataccgcaaaattcctacattctagacggaacacaagggtatgaatcgatttgattttgtaaatttcacaaaacctctagtattatggtccaagttttaaaaaatgattttgatacaacacataaccccagatattatggtttcatagtttgacaaacccacactgttaattaatttggttcgctactgtaccaaataagaaatactacacttaatttagatggataaaaattttggtaaattagaaccatgccattataattttgcaaagtttgagatatgtcttcggtatctcaatgacatgtgggacccacatgagtcaatgacatgtgggtcaggatggcatatctcaaattttgcaaaattataatggcatggttccaattttccctaaaaaattttatagatagatcaaagaattcataaatttgagatttgatttagaacttctaagtatggagaatcaaataaccattgattaacaacatggttttctaaaactctaggcccataataccagcgatcatgtaagccacatgcattacccgtatgttttttgttttattttttaaacaagctaggacaataatatctgcagttatatgaaattaactcatttaggtattacacatcctgtttttatagttgataagtgtgccttttgccaagtttagggactaaaaagtgttctttatggaaggtgaaaaggcctcatctcaacatataataatctcaaaataagggaaaagaattctattatcatgtaatatttacacatttctatgcagtaaatttagctaaaagtaaagaaaatcataaattacaatattgctacatataaacaatgtattttcctatcgaagaaaaaggtgtctcatgctattcttccgcgcacgtgccaatactggccaaaactgagctctctactcttccaattaaagaaagcattagcaaattcctaagtggaggaaaagtattatcaaatataacaatactatttatgcacagttcttgacagatatctgcaccttttttgttgacatgaaaatctttctttggcgactagattgtctgctgcttgtgtaaatgtgtcttcttaatcaataatattgtttgcgtcatgttcatgttcatgctcatcctcatgaataacaacacaacttccctaagtcgtggaagcacagaaaagataaaaaacgatggcacttgataccaaggcaagatgtatagatggtagtcacctgtgaggaggcataggtaactaaatttccagaatatgaaaatccatcaaatagtccactctctgggaaaaaaaaatgtgccactgtcaagccaattgccaacaatgagaaatataaaaaactgaacaaacattttatccatcatattttcttactcacctgatgacatcagcctgaattaccctggttttccatatcgtcatcatcaaggataacatattttgaagcaccgctagaagtttgggggttcttgtcacaattcttattacgatggcctttcttgaacctatgataccttcgcatatcatgggagaagaatgaggaaatattgttcactcaacacggatgcattagaaaataaaattttgcttctagttacatagcaaacagagatgctaaatgcttgctaattattgctttataccctctcacacaaagagctgacgtgccaaacaaatattgttgaataatgcgataggtagtaataaaggttcaagtgaaaagaaagcaccaacattattagaattgtggtacagttgatgacttgaagttaatctagtgattagaaatatgaataggtttcgagttaacatgaaaacaaaatttcaacatagaaaagggaacattgacttacttgtataagttgaatagactgacaccaaatattattattcccagcccaagcccctttaaccaggtaaatgtatcattgaagaaaagcacagcaacctgtcagttttaattgttacaagttgactcaaactcacatgcatgaacatagatgaattatatacataatgaatatttaaagtgaaatcaagctttagttataccaaaatagtgaccgcttccttcacaatcccagctacggtcactgttacagcacttgttacagaaaccagaacatattctgtcaaaacctgcaggtggaaaggtccttgtcatcatcttttacggatacatttcatgatatgacaactcacaacaaaaataatcagcaggcatgtataataaaaactgttagtgtatcctgactgaagaaaaaaaggactcattgcaggtattattggtgcacggcgacattcatcattagcaagctaattctgacaagtgggtacatgatccataccatgaaaaaggccaaagcaccaccaagaagcatcaataagctgctccttattatgtgagttgaattatcaaaaaagtggcttgccctgacgtcgtgccatggatccatcgcaatagaaagaattgcagttgttattgccataaccggggtaacataactcatcaacgtaaagggatttcttaatcctgtgaatcatagaaaacaaaaaggatggctgttacatggtggttcctagtttaaaaacaaatgtatcttcatgcgtatatattaagaacctaatgctacataatatttctagttcatataaccttttttaataaggattataattcatgttactgttaaagtcgaagcaataagggcagtttcaggcatgagatgcaacacaaacaaataggattaagataaatcctctcaatggacaaaaaggctatgacaaaatgcataccatattcctctttcttcagtagattccatagacacataagagaataacaaaaaagaaagtacagtcagtacatcaatggaaattaaaatataaaatagctgtatataattaagaggacatagtgacatgcccaatcatcaactttgaatcataacagtagtaagacaaactattaaagaacaaagtattaaacctggaggagaatctgtgtcatgcaccagcggaaaccagacataacagcagcaagcataataaatacaaatccccaaagattgaattctgtctctttagcaactgtccagaaagaaatttttttaccatagttaaacaatgatggagcataagataagtactaataggcatgccagtacgtggtagcatcaagcagtaacaatgcaacatctaagtgaaaaaattggaaattacaccataatccctttaataaagcaatatatacaatttggaaggtcattttgtcagcgctctctaaaaagaacaaaagagaattgtttcaaataaaaagagaactgttatttcttgatgaattcagtatttcagtacctgttagtagaactccaaaggaaacaatcagtatgattccaagaaggttaaagctgggcttctctagccttccaaagaaagatgaaaagtttagctctataacatcaaaacgatttataaaaaaaacagaagtatataagaatataattcctagacaaagcgacaagaaaaaaaaaagcgatttgcatgaaagagaaatagaacgataaaagaaacagaaccaacattagcaggttgaagcaagatacccactcaaggttagaaaaataaaaatcaacaaaagatacattacataaaagtatagatagaagcaaacattttaaatctaccaacttactcgtattgttcatgtgagagtgcacgtgtcagtgcgtgcttttgagtgctttgtgcttgtgggtgcattcattataaagattaaagcacttaagagttattaaggatggaaaaatcagatcgaggctcaatttaaggttgcataattggtatttaaatcaacgaataatggaagaaatcactttagaagaaaacacatgtgtatacactgttgaaaagaaatcaacagcatagcttacctaaacaaaaaggcaaacagaagaatgaaaattggagctgcagatttacactgcataataattgaaaataatgaattagaattccaaatttgctaaccagtacttaactatgaaaaaactaggaaacaatgattcatatagggtgaaatgtaccattgtagcaaatgttacagtgatgaaaacaagtgaaatgttgctcaaatttatgtcaagagcagtagccaaagctgttgggacaactgcagaacaaataataaaattacaatatatcatttgtaaacaatgttattcaaataaatatgatatacaaaaatacaaaacaataaaaatggaaaatatatatttacaaatattttcaggtagtatagattctggtttaacctaatctttgttgattgactcggttcaatctattagagcattgattgcatatccactaagaaatgtgatattgctcaacatcataaaagattcagtaagagaagtatactaagctccctatttgagcctgtgtgacgcattaaccacttttatttctacatgccaccagctcaaatttcatttgaataagagaggaataaatttagcatgtcatctgttctatcatggatttagcatgccaattgtcctatcatagatttagcatgtcatctgttctatcatggatttagcatgccaattgtcctatcatagatttagcatgtcaattgttctatcataatagtcactagttgcttaaggctgcaaaagccaatattgttcatgctgactggtcctaaacctgatcttgtaacaggctaactaaagagtacccttcttcttatgtcacttattagttgtgtggcaaacatagacgtaaaactagcattcaatttatttatcccctataagtccagaatacccaaagttgattttactaatttgagcgcccagctacccaatcccatgccacttctctggctaaatatgtggaagcatcaagaggcataaagtaagctacactttggtcacctcgcagaaagtaatctctccatgtcattgcactagccgctccctccaggccccggtgctggaaccatacgatcaccctcgatgccacagcctgcatcgtgaaatgcaccgtgttcatcaggaatggcgctgggaacttccacatgtgcttccccagcatctccttgttatacctgaacacacgccccacgagcacaaacagaacaccagcatcaaacatgtgctcaagcacatactccccctaatcatccacactccaaaaaaaaagcgtgctactcacagcgtcaagcaggtgctcagcgtgtaccaactcgcaattagcgcaataaccttcgcgatcaaccacggcgaaatcgggaggtcatcagatctcgccgctgcccccgcctcaatatccatcggcaagtggctgccgccgccgccgccactatcggagggcagaagcggaagctcgaactcctcggaatcgtcgtcgctggccgccgaggcaggggaggcgcccccagggggggcattggacatggcggagcagtccttgcaccaccgcgagaacgacggctccctgcggatcccgccctgtttcctctgccctctactcccctcctcccgcggcttcccggcgccctccgggaggcgctccacggctaccaccggcgcgtcctcctccttcgggacggggtggccattctcgacgacgacgcagtcccccatggacgcgggtggcgctacggcgatgaggccggctctacagcaatttggatctaagagaggcgtggatggatctcatcggcgacggcgagcgaccgcggcggcggccgacgagaagccgcgggagatgggggttttgctttcagcgaggattccggtagcaagtcaaaatcggaacacctcgtctcggcgacttcccgagcggttagctttgcagcttcgcggctggtagtggtagtttcccctgcgggcgaggaggacgctgtttttcagggctttttttttttacgggattttcagggctttttttccccacatggaaaacccttttctttctctctgagttggtatacgtgcacttgacgtatcacatgatttcgcttggagatttgtgaaggtgcgcggcccagcagatggagtcatggagatagcaccggcccatccagcgttgtcggtcagtcggtccaagtaggttggcaatttggcatgacctttaccgctggtcttctccaaagcgtccatttttgcgactagtttagacttgatactcatcatgcctgatctccggtcctcttatcaagtctgtactcatgttgcaacaggtatatctactcacagcactaagggcctgttcactttgatgccaaaaaaaccttaccattaccaaaattttggcatagttttggcaacttgccaaaaatttagcaagatttattatatagttaacaaaatttggtagcaaactaaatgtagccattgttttggcaactttaccaaaatttggtaaggttgaaaatggcatcaaagtgaacaggcatttaaagtcaacaagaaatgcttagagatacagatactcgacgagtagtagaggaaacacttcctatgggaatgctcgaaaaacctcgttggcgaaaaacacaaagtcaactggataagaacatgctcgccaacaatcaatagtggtatagggatgctgaacctaaatagattcgtaagagctctaggagtaaggtggttattgcaagaaaataaagcacgggaaaaggctcgatcgggtgggcctcttaacaccccatgggacaacttggtcagattatttattgtcgcaaaccacaaccctattaattgggacgggtccataatccacttttgtgactcagcctagatctaaggtagacgatcaaaggacttagcaccactagtctacgcaatctccaagagaaaaaaaagaccctaaagcatgccattgaggagagcacgtggatccaagaccttaacttctcaaacattgatgatgtgacggtggagctcatcgacaagctggtcactatctggagcgtagtgcaagagatacaactcgctgacgaccaagtagatgaaattacgtggaagctcgcaagtcgtggagactcgagagcacacattggaatatacctacaagtacagtttctcgattcagtttgcacaaattacgaaataatcattgggaaaacctggggcctgaagaaatgcactctttacttgccttatcgtgcataatagagtgtggatgccaaacagaccagcaatccaaagctggccaacaactcctattgtcatcgcctatgccaggcataccatgagaatggcctaccacctcctcgtggaatgcagatacaaaaagaaaatatggagcatgctatctcatgagaaacttagaccagggaggtggcatgtgtctacgtcggtatacacctagtggatagcgctagcaattgccaaagatctataccaaagaatggagtttgctcgtttatcctcctcatggcttgataggtgtgaaggaaagtaaccaaagagtcttcgagcataaagatcactctacaatagcggtggtggcaaaaattaaggaggaagccaacaccgctttatagctcatcccctgattttacttttctttttacaatttctcgcttttacttgtacaaactatttactcatgttttattcaatgatatcggcacacttagtactagttcgtcaaaacatatactttttttgagctgataatatatatcgttttagaaaataattttaccatgtttttaaccgctctcatcacttagactaatgaaccaacatagttgtgaattaattagtacagctatctttgccgcacttcatcatgtgatagttatttgtttcgctgccacttgctaataaattttgaaaaccaatgataatttgcatgcaacgtgagcagtgtgatcacaaagcctaacattatgcacctgacagcataaatcgcaggaaagagtttactccgagctaaaaactgcgaacatataaacagtcagatccaaaaatcatttcgtcattaatcttccgttcacttccatagaagcaatccagacgaccccaaaatcaaattcagagcacacgacaaaaaccccctcacaaaaagcgtttctctgagtagaagtcagacaaccatgcagtcctgcaccctggagccatttgaattctggaaactgggaaatttggaatctttcgccagataaaccgccaaattattgtgctggagccttgtggagataaaactagccagcgttgccccatgcatttctctagcttacataacaaaagcaccattacaaacagcaagagtataataagctcgagctttacactccagcatccaatgcgcgcaagttaaacaaacacctcaaagcgtgcgcactctgctgcgtgacacagcttttagcagccacgcgtgcaaagatccacgtaggcacgtccgcttcgaatggagcaaatgattggaatcagcagcatccacgtcaactagctaggcaagcacgctccgatgctccatggtgccgaggaagaagaacgtacatcagctgcgcggcggcgcaacggcggcgacgcgggcggggttgagctcgaaccagacctgccggaacaccttgacgatgcagtcgtggtgctcgtcggcgttgagcgagaggtagcacgccaggagcgtctccagctcttccggccggccgatgcgcttgctcgcgatcatctccaccatcgacgcgcggaactcccgctgcgggtcgctcgtccggcgcaccaccgcgaaccgctccagctccgacaccgccgccgccgccgccgacgccacgcgacgcggggaccgcacgcgcacggtggcagccacccgcgcgcccggggtcctcccggagaacgaccgccgcccgccgccgccgctgcggcgccggcgccggcggctccgcggccgcttcttcctcgtccgtgtcggacggcagcagcggcggcgtcgtcttcagcgccgggacgaacggagcaggcaccgggatcggagaagcggcccgggagaacgggatgaggttgcggagggtttggaggtcccggtcgccgccgaccgagtaatggcggcggcggtggtacagctgccgcgcggccgcagcctcggcggtgtcgccgtcgttgccaaccgagaggcggcgcggcgcctgctggtcagcggtcgaggaatccgccagctgctttgcgacgccgcgctcgagctcaagctcacgctcgtgctcgtgtngagctcgcgcccttgaagaagcaagaagggaatccgccagtggcggcgacggcgctcttgtcggccggcgcggcaggcttcggtttagcggcagcagcattgttcttggccgtgagcttcgagagccacgcgagcggcgagaaggacaggaaggccgccctgctcttgttgcccttgtcctcttgctgctcgtgcttgtgctcttcctcttgtgtgcgctgctgcttctctctctggttgtgtctactacttctaagcccccacttcatggctcgcttgctaccaccaggcaccaggttcttggtgtgtctgcccgtgtgtgtgagtgaccttggagtgtgaggagagacgagggagttgcaacgcttttaaagtggggagggttttggcggctaagcgatggactgtgcaatggtatgtccgtatgtgaggttccgtggtgtgtgcctgtgtggtgtacatgtgcatgcaaattctttttttttttgccccttgtgctgctattgggacttggagtttgaactttgatgctggggccatagaggcgtagtagagctttccggcatgccgtagctaggtgggtgaaaaactgaagacagctgctgcacttttcatggcacttctttctggtttctttgtttttctgcctgtgtgggctctggctgattgatttccgtgattggtgctgatttttaagctcacgcttgtgcggtgctgcctgtttgcgacgtttgattgatgtctcactttttcttaattggccatcacagattaaaaagtatgaattactccctctcaactattatggtagtacgatttaccctctaaactataataccggatatttgatgccccaaactcttaaaactgtataaattaccaccttaactcgattcgaagcggtttagcctacgtggcacatacgtggcgatacagtcagcaaaaaacaaataaaaaccagtggggcccaccagtcagtgttttttctctctccttctctgcccctctctctctttctctcagggtgaacaaaggaggtggctagcgcctggtgagcagcaggcgaggagctagggcggggcaggtgggggcagaggcggtgggcgggggcggaggcggctgcggctgacggatgaggagccgaggccagcggcgggcgggagtgagggcggaggcggggcccatggtcctacctcacccctctctctcttttctctctctgccacggggggcacggtgggcacggcggggagggcgagcggcgacggcagacgcgacgcacgagtgtcggtggccgcatccacggcggcaacgcacgagatggagctgcacatgaggcggacggcagtgaggatctccgcctccaacactggccgcccggtcgtgttccgcctcagccgaccgtcgcctaggggatctccgcctcaatcgcctgctggctgctgccggccgcccggtccagctccttcgccgccggtcgcccgggagagctccatctcagccacctgtggcgtgggcaatctccgcatccgtagtcggatgctcgggtgagctccgcctctgccaccggccgtcgagcgcatgcacctcctcctcggcagtcggccgtccgagcgcgtgcgtgagagagagaggattgggttgaggaatgggcatgacaggtgggccccagggagttgtttattttatttttctgactggaatgccacattggagctacgtgtgcaagctcgagtcaaaacctctgaaaacagtgttgaggggggttatttgtccggtatgaatagttgagggtgtaaaatatatggtatttcagtttaggagtataaatcgatcgaccacgatagttgataggggtaatttgtacttttttttctaaaaagaactaccgtaacggcgtaacgcagccctcccttcatggtagtactacattggtaggagtacatgtacgcatactcctattattctgtagtggtggtatagtacaattccttgttgcaatgttccgagattttttatgtttagtacagtaagtactcctggtaggtactgcctagtctttatagctcatcagatccacaagattggatcgctaccctcactggctcgtcagatccacaagttgtcagcggtgcactgtggatttccaccagaaatacagtatccagaacctcacggagttcacaaactagggaggcaccgcgagaggaggaacctgcaggcgtgagcttgaatgtgatccggcctttctacgcgtatgccataggtgcatttttctcatgtggctccgtggattcacatcctctaccataacaaacattaacatctaaaatattaaaaaaaataagatctacatacttataattataataatattgatatcatggtaaagaatcctgctccggctcagtaaaccagcacgcaggcaaagttcgcaaactcacacgacgttccgtctttgcccgcccgcatgctggcgctgcgacgctgcggcctttccttcactcgttcatcacgaagcggcaggcagcgcagaagcggcaggctcgctcagcgcaggtcggggaattgggacggcgacgaatatcgcagtggcacgatgaatttcgcagtagcacagacagaggctttcgccaattcgagtgggtaaaaaagtcgccggttggcggaaagctaagctacgagcgaacgagggagagggaaagaagaagaaaaaggccgtgatggcactgaggttggttggttggtttgggggcccttctacgatcgtgccaacttttcgcctttttttcatctctgcacgttcactgttaacttgtccctttgctgcctctctgatgagtaattcagcagcagcggcagcgagcgctgtgcctctttgtttgaacgagctcccgccatcttatggcttcctttttgtatcggcgtttgatcttttggtgcactctccagtaactctgtgtgggaagtgcagtaaagattttgcaatttcctgtgttgctttcttgcatgaagacatgaataattctgtacaaaccgttgcccggagccccggacaataaagatatacagtgcatggacagtgaggttcgaaccgatcgacgtgctgcaagctgcatgaggaatgtgtgcagatatgcatcttcgccagcttggttcggacttcggagggcatcatcgcatgtagctacccctgtttcagtcataagttcaaaaaaacatctagctccatcgtctcgtttggcctagacaaccaaaaaataagacaaaatttaaatttttgaacttaattttaaagttgattttgaaatgcttttaacgtaatttttgttaatgttggcttttaagtcgctacgaacaaatctacaaaaagttttaattataaattaattttaattttctaataagccaaataaaccattttgggctaaatgggcaaccgatgggagctatcgttgctttctcctctcttttttctggcgtagcacgctgtaggctcacttttagccatgtagtgtgtctgacgaagaaaatgactaaatgatggggagcctatctagagtgtagattgccgtcatagccaactgtccttccgtgtgttttttacatgttgagagcacagtagcatgcgcagttcaaaattcacatatggcacgtactagtaggttggtcctctgacagaattagggtgtacccgcattgcctctagagttgctagctgctgttcttatcaagaagttgagggtacgtgcagactccagaaagcaacgaaggacacgtgaatttcacgtctaataaaaaagaaaacaaacaagttgggtccatgaaacaatcgagctgcaaggcctagtttgtcaaatgggctagattttaattcactagttcagcccatctccacccaagattagtagggtactcctataattaagtactactagtagtctagtacacacatgttgcccacaaggaccgagagataataatgtcaagccgacccgacaaggtaacagattaaaaaaacaagaaggctttgcccctcaataatacagcctcaccgacaaaataatccggtcttaccgaagcccttgaccggagattttgcttttaaaagcacgcgtatctttgacgtttccgggatatgcatggagatggaaccataagcccatgaacatgcatgcagtcagcagtcgtcaagatctgcaggcgttctagactggggaaggcatggcgtgcggccacgccgtcacgtttttggcacctatgtgggtgtttatacaggggtgtaaagttttgacgtgttacatcgaatattatataggatgtcgtatggggtgttcgggcgaaaaaaactaattacagaatccgttagtaaaccgcgagatgaatttactagtctaattaatccatcattagcgaatgtttactgtagcaacacattgtcaaatcatggagcaattaggctcataagattcgtctcgcaaaatagttgcaatatgtggaattagttatttttcagtctatatttaatacttcatgcaggtgttcaaacgttcgatgtgacaatgtgtaaaattttcacttaggatctaaacagtgcctctatatctctagcgcgacatgccgtggcccgtggctattgtatcctgtttattacagcttttctcttatagcgggtttaacggtgtagccaactactagctttaattcatttgtagtcaatttaataattaatttatgcaatagttaactacaaatatatactacatcattaataattggtctcatatgtcatacacacatagcgtcttaaagtctgtgcatttgtagcttatttctcttctctctcctctcttatcttctctatgtgtgtttatagctacttcctccgtttcacaatgtaagtcattctagcattttccatatttatattgatgttaataaatctagatatatattaatatgaatgtgggaaatactaaaatgacttacattgtgaatcggggggagtaacttatattttgttattgtacctaggataacctgcttacataagagccctttcaagattatagatttttcttattgatttttgagaaaccctcataaattaatagctccgtaaggactggtgcacatcttaatttgactttaccgccggataaagagaccttttgttgtgacttgtttggttttttaaaataatggaataacattttggtttttctcaacgatctacaactaattattacaaaatccacacataaacaaattcagtacacactgacatgatataaagaaaacgcaacctaaaagacactaacacaatataaaagaaccctgaattactgaattctattcgagaatctctatccaaagttggcaaacaggtgcataatcgtcgactcaagtttacgacatgcatcatttattaggatatcatcatcgtgcctttgtagcttgatatcatcatcatttattacttgtttggtagacgcgttatattccgtattaggtttttattttggaacgaaaaagtattaaggtagtatacttttttaaatataacttataacgttttagatttataatatttttttatttagataggaatgatcaaacattctagtcaaaagcgaacagtgtcacgcatgtaaaacaacagtgggagtagtatttcttactagataaatacactgtcgcgttgctacgggaaattaagttacataatatgtacaaatatgatgtaatatgattattaaaactaaaaccaattgaaacttattaatttttagcctataaataattgagattgcatgatactatgagagaagaaagaagagacaatttgaacctagacctatcatttaatggttaaaataattgggggtgatgtgacttaatgagagaggggagaaataacaataactacacttagcgaggatgaactatataattacataggattcctcttggataaccggatatatgaatgcaatactctgaacttgcatcaaaagctaacagcgtcacgcatgtaaaacaacgagtagtatttcttattcctcttggataaccggatatatgaatgcaataccttgaacttgcatcatataactccgtgaagatggtgggcttttttttcgagaaaccttcaaaaaaacagctccatacgaggccatgtataatgcgtggccttggacctatggtctcagcctccacgtagactcggatgccaccgtggaggggaagagtggtttcacagtgtgtcggaagagctggtagaggaaacaatggccgaaccgcgcctcaactcagagccacggtctaggtcatggattgggtgaatcagtggcctcagcaagtagctcaaaggaggaggagagagggacctaccagatttgagcatccggcgagctcctctgtgccaccggagagacatcacctcctcgaagatcgtcgtcgtgcgccgccaatgcctccgaggagtccgatgagtcgccagcgttcggatccagcgagccagcgtacggatccaacgagagctcctcctccctgccgccgccgagaactcgtcagtgctgtcaccgagaactccacgctgccaccgagaactcctccccgccaccaccccgtcgtgttgctgccaagctcaccatgccgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28490 - DNA, 201 bp, Oryza sativa
tctggaaggcgcccgcgccgagagggccgcactggatcagcgggccactgagctcgaggcgcgggtgaaagagctggacgcgagggcgcgcagcggcggggcggccgcgggcgacggcgacctagccgcccgcctcgcagctgccgaacacaccatcgccgatctgcagggcgtgttggactcgtccgccggggaggtcga

SEQ ID NO: 28491 - DNA, 2089 bp, Oryza sativa
  unsure (1)..(2089): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgactaaaatttttacagggctattgctttatttttaacactacacactatactttattcactttcaatttgatgacagtgtcaagaaatccatttagttcccatccgccctaccgatgccgccgccagatgcggtcgcactcacttctcctgccccgcgctccttctccgtcccgcacagcgccgcgcgagctgcggcgcgggcccgcgctcgcttctgctctgcacccgagcgcgcgagagagagatgcgccatgaagcgctccttcccctcccccgctgccgctgcgctcgcttctcctctgcccccatgcgcgtgcgagagagatgcgccgcgggcccacctcgcttctccttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28492 - DNA, 258 bp, Oryza sativa
aaaccccacaccactataaatataccacccttctccccctataaactccctctacgctctcctattccaaccctaccacttaccctatacctctccacctttctcccttccccaagcgttcctctttctcataactcacactgtaaatatctcacttctatctatgtccttcactccaaactaaactatatacacaaaccccccattcaaccccaccacttcaccttatcctataactatccccttaaatccaacccc

SEQ ID NO: 28493 - DNA, 45485 bp, Oryza sativa
  unsure (1)..(45485): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtttctctatgcagactgggagaggctaccgggatttggtataggtgcgcaactcgctggaatgtcgggacttcttgctattgctataaaagagagaaggattctagttgcaggatactacaaccgtgctgatcacaatggttgtaaaggtaggaacaatccagcttaccttgtagattatgaattgataatatgatatgtgtagtgctacctcaagttgtaacttttaactgacatgataactgagataactgtcaatgttcaattttcaggcctagcaagatctagctggtcatgctactttttacctgaaacatctgcagactgccagaaacgtgctttagatctcatgcaaagcaaagattctagggaaaatggaattataaaagttaaggaaaactatacctccaagcaaatatgggctgggcatatacctaggtaccatttcgatgcgctggtcctgtttctggaaagctaaacacgcacccaatactgatgagctatacacatttactccctccgttcctaaatatttgacaccgttgattttttaaaacatgtttaaccattcgtcttattcaaaaaatttaagtaactattaattcttttcctatcatttgattcattgttaaatatacttttatgtatacatatagttttacatatttcacaaagttttttgaataagacgaatgatcatgtttaaaaaagtcaacggcgtcaaatatttagggacggagggagtatatctcattcatcgctctgttcttgtggctcttgccgattcatgcacatgttttctgaaacctgctgttatgcaggatatgggggagaccatggaaatatatgcaaccgacaacagagatagatgggagattggttaaaaatcattgtaaaatggatcggagatggtggattgcacaggtgtgtacctcatgccaagatgaatgatgagcatattttgtgctattcataatggggatgcaaatatgcttcatcaacctgaaacttccatgtaggccctgagatacctaatgaggttccagtcagagtacatgtgcagattactgaatgtggctagacattcagcatttggcatgcaggcagcaaagatggttcttgaaaatgtcccagatccaccaaaggtttgtattagcaatctgaagatttttatgttgctttgttccgtggagagttttgtctgcgcatcattcggataaagcaacattagcactaaccaccttacttttttagataagtaactgaaagatttcacaattgcagcctagcattagcagaacagaatctgacattgagcgacttgtgtggtcggagcataaaccatatatacccgggcctcttatcagtatgcatgtaaggatgggagataaagcttgtgaaatggaagtagttggctttgagaaatacatggagttggctggtcgtcttcgaaaacgttttccaagtctcaagaacatctggctttctactgaaatgcaggcaatttaactcctcaattctcatccctcgtatggtgtaaattaatttcttcatttcattggtctgtaatttaactctgctaatgctgaaatgtaggaagttatcgacgaaacaaaattatatcccaaatggaatttctatttcacaaatgtgacgcgccaagatgtcaatgtgagcatggcaatgtatgaggccagcctgggccgtgagaccagcacaaactatccccttgtcaatttcatcatggccactgaagcagatttcttcattggagccctgggatcaacctggtgctacctcatcgacggcatgcggaacaccgcaggaaaggtgatgtctggctatctgtcggtgaacaaggaccggttctggtaagcaattcagaagctgctaaaccttgttcattgtattttagctcctctgaatagatatgtttggcctaagtttgcttctgtacggcaatagggcatgtatatatgcaccatcctagcagataactttagcgtgtgaaacttctgagctaataggaaaacagtatcgttatatcaaatcaggtccatatattttgatctggtatccacttaatcctagatatatattatcctgaggtccagtgtacccaagaaaaaagaggatgcacttaccaaattttcagtggtactcataatgctgataagtggtacacgagagatccaattgcagaattttatagtagtatgacagtaacagctatgccatgtaaaagaaattgacacacaagtttcctgtagaacatcggtttcaaaaaaaaaaagtttcctgtagaacaaccagggcattctcctctttgtcaaccatttgatttgttgaagacatgacccaaaaaatccagtgaactttgatgaatacacatattcactaatcactagcctttctctctattttttttaaaagtacctttacggtggtctgtactagtagtgttttactactagcattatcatcattagaaatgacctcaaccattgatttatgagatctactaccagaaattggatttgaaaagatgaactttctagatttttttcgggaatacgcaaaaggattacgcacttttgtattaagaggaataaaatttacacaaatggcaaacaaagaagagagagagagagagagagagagaggagaggagaggagggggggaagggaggaagaaaaggaaaacaaggacttaagcctattctcgcgattacattgtgacgaccgaacgaccaaacgaccaaacatgctaactaggaagcgctggcaacgggggatgggcaagacgccaaaggatggcctcttacgccatggctgcgacaacctcaggctagggccgggaatggttgtcgaacacatggttgtcccttttcattccaaatagaccaaccgccaagagtcacaatcgtgttgaacccacgacgatgctccctcggaactttgagccgacaggagcagtgccactcaaagaaggaatcagcgtcagagggaaagcactgagggaggccggggcttgaaaggacagtccaccacagctatagggactcaaggcacccaatcagaatgtgatcaactgtttcttccagttggtcacaaaagacacaataggttgggtgcggcaggccacgcttctccaatcggtcagtcgtccagtagcgccagtgagcgaccagccacaggaagtagcgacgtgacactgaggtggggcaaaagagcgccagattggtaggtgctgaaacgagatcctgcccgagaagagggcaaggtaagctgatcgggtggagtacgaccccgaactctcccacctccagttgaaagaaccaagatggccctctgagagagtcgttgtccgcagcaacgaccaaatctgcaagttttgcagtattgcatgaactgtctagattgattctactaccaatagagaccactgtaaaactccaccttttttttacataatggaagtattgtttgtggcctctacatcaactatgatgcacatggccatattatggacaccaggattttaaccctagtggtaagaatcacgcacccacgactccaccaccacaccaatggtgcttcaaataaatggatcatttcgacaaagttccaatgacagatgagaatgttgaactggccatttctatatggagaaaggaacactgtagcatgaacctatgcactaagaattgtgctctacaaattttctttagccaaccttttccaagtcaccctacatgagtagatgacatgtaatactttacctccttttgttcttctcctaataaggtaccattctctagtgcttccatttgcgattcctggccaagagtgatgcactagtttcttctcaacaacccatccatccagtcactgcttcttagagatggatggatcctgaaactctgaaagggacactgtaacagtgccctgaagaaaaggaacaatgaacttctcgtggcatacatcgtatataatgagtgcaacacatcacaatgccaaggtagtggacatgagcacatcgcatttcagcttgctccccacttccaaagattccttctgaatcctatcagcttctaccatggatcaagccccagggggctctctccccttggacaccatggaatgagaactgtgcgcacgcgcaatggcgatcgcgccttcggtggggcggttcttggagccctggtgactccattgacctgatgatttcaagttggatgatttttgcaaatgcaatcagtatttggcaatggtttgtgttgtggttgttactgtatgcagtggatgcagatgtatgaagtttagcagcagtaaaaatgcactactgcatggttgatcattgcttggcctcaatggctcaatgttaggtatcagaattcagaaagtggtatattctgatggatatatagtatatggatgccatgcatccttatctgaagtctaggaggtagagttactatagtagtagacgagtagtgccctagcaatgcatggaacttgtgtgcatttttggatgattattgtgaggcaaaactgtagcaaaaaatgggtttagacatgggataagagagtgcgttctctgtagtgcagagtgcatcttctgacttggaatgcagattagaacactaacagttgtatcatcacttcagtcaaaaaacacttgtattattaccaggtatgacgcatgactcatctggaacatattcttgaaagatgcagcatcattcaaaaggaagtcaaccggttagtgcattatctccaaatttttgttaaaaacaggaaatccgatactaaaaggtagtgagaggaggcttcatgctgctgacgaaccgtgcaaagcaccaaaaacagttgcagtcaccatggacaagactcatggtcagcaaactgcagaaaaacaacgcatttccggcaaaaacttcttccggcttcagtctgaaggccgagaacaaatctgctacgaacacatccaactccaaatcgtgaccatcagtctgaatcgcatattagaaaaaaaaaagaggagaaaatacataaaagaaaagaaataaagaagagaaagctgcttttcttgtttctctttacagctgaaaaccgctctcgtctgcaactttttcgtgtatcatcagagcatccaaaaggaggagaattgccccagacaaattgtgaggatcagagggaaacaaccagacacacacatacacagacgcatcgttatgggagacgtcagcctccaccacctgcactgcactggctaattttgatcactgaattaagcacacacacccctactaactaatctttctgaaacacatagcaattgagcatcacagtccctacggtagagatcattcgcattgtttaatttaagagcaattttatgaagaggttctacgaggtattaaattttactctaaatttttttgtatctcatggtaactcctcaagtactgtaaaattgctcttgatttaatggatcatacatttttatgctaccaccttaacaactggtagtagaattcatcaatcgatagttgagatcactgctactagtgatagttctaaccgcagtaaaagtacttaatattcaatgccctgttctctggcattaaaatcaaatcagcagatcattttaggatcttagggatttggaattcataaatctatatgatagtgacctatttttgcccactaattctttctttcccatgtcaatgtccatgagctgcaggaacaatagggatcacctagcagcacaccaacttgtgcactgcccacttaggactttggttgcaaatatacacattttttttcagataatgaaatgtatacattttatacatcatcatctgctcttataaagtagcacttctctccacttagatcctacatatgtgcgatgataaatcactttatggaaaaggattggcagggcgatgtttaattttttgatgaacaaaacaaaggtcggcataaatggacctgaaagtagaaaaaaaagcttctaatcacaatagcctggattaggaaaacgccagccatacgctcatctttttatcatcaaattaaagccaaatgcagtgaccattttaagatcacattatgcactttctttattaaaaaaaaagatgtgccaaaaaacatagtattattgtataaaagattacataattaattgggtccacctgaaatttcttttcgtacacgatatagaatctaccacttcgagcttttcctaaagctagcgtagatagagatatgcaaactgtaaaatcacttagcaaagtaatcccacataacttctcagactaattatctcttgagaaagaaaacttgaaacaacttgcattgtagtagacaatcatatatgaagcgactgatatgacagattagtagtacaattcagacagattagtggtacaattcagtgtccaatttgccgctcgtcgtgaaaaacattaattcgatgaaatgaaagcttaattaatcaaccaaaagatggctttgatatcatcatatggtttgcatcgtggatcccattgagcattgatcgatctttgtcacacatctctgatcatctgtcagaaacgtacaagactctcccagatcacagcacgtttatccggatcaactcctgaaaagatgcacattccttggtggaatatctttgcgcacgtaaaagttcatatacatacgtgaagattacaaactcattaattacgtgctaactagtaattaattagtaaaatcaatccggacacactagaacactagaacatcatgtaattcagaaagcaacgctggtttaatttctcactgacaaattgctgcacttgacacttgtcaccctcaaatctttcatattttgcacatttttgttgtgattcctttagctaattctgctctgttacttataaagtacagtcattgtgcacaattagcttagctccattactcagaagtatgcagccatttcagtccaatcagttgtgcattatgcgaagcaaaatttaactataactttgtatgttctattcctatccaagataccaaaattaataaactaaagtgcaattgagagagagatgcccgattagccacaggtttcttagtgctatctgaacttacgcactatatcattctgcaaacaaacgatgcgtgcacgggttaaaactagaatcatactgcaataagttaactatgggcatagctagagattagtgaatattaaacaagtcaattagccaaccagcatcctaaacatgtcctaaacagaaaggaccaattagatggctggatgaagcttttaattaaactgactttttcttatttttggaagcatgagccaataggaggatggtttagaagaataaatcatgcagctagtgttgcgaatgatctttccattctggcttgggagaaaaaaagaagaaagggttatctctctctctcatttttaggtcacatttgttgtgaagtggacactcatgaaatggcaacaacagccagcaaaggaaggaaggaaggatgaaggaaaaaaaaaggcctttattatcatgttttgcattcttgttaaggagcattaagccctgaaaagtaggtgctagccagtgccttgcacccttggtgagatttgttaacatttaattaagctatctctacaaacccttctcttgaggctttctggtttgtgcttagtgacttggtttcctcctgaaaccaacaagaagattcctgcagagaaccagaattatgctgtgtgcattgcacagttgggccagttagtcacggcaccagattttgacccttgcatgcaagggacccccaaaaagagagatatatgtgcttcccatgagctgacacttgttttctttagatgagctgacgcctgtttgttgctgaataatcatatggattcctatcatcctggcatgcacaaacatatcgctccaagaaactttacaacgtcgatgtatttgttctgcccatatggtgaccactggaaaaaccactatgaatatgaaccgctagttggctgtgtacacacttgttggtgtagaagccggcttttgatccattaataaaataaactgctagaacaaatgctaggaaaaaaacaataatttacagcataatgcaatttttcaagaacgagatttcttgaagagaacatcttacaaaaaaagatatcgtgcgaatcacgcatgattttcttttttagcatcatattttttttcattttctggtaagtttgtaggccataaaaattttatatgtctgattctaattctaattcaaaaccatatattttttttctaaatgtttctatattaatagtctctaaatataaagtttctttgtataaatttttaaagacaacatttcatgatagacacgacattgactgaacatgtttgcgctagacccagacacacaaatattggcacattaaacctacctaacatcataagctctatggtgtttgacaagactatgactactatatttttttttcaaaaatataagacttcagctagtttagagtatgaatataacaaaatttagctggacctataccaaacgaggtcggccgggtttcctattgtttgtggcgagggaggcagcaagcaccatatccgaggtgtcatggacgtgtacgcaacgcgggtgtacttacccattttttcttcgatctctttcttctgttctgcacttctgcttggaccccatgacgtgcgacgcaacggcagctgcgaccacttacactgcagtgcgtaacggacatggaggcaaaataacgcctcaccgtttcaatttttttttccgttgcggaaaaaaggcgcgaaatacacgtcgtggagacaaaatttttcgcgcccccgcatccgcgcaggggagatggatgtgtatgtacacacacgcgtagatatgttatgtacgtacgtaagcgaactagttaattaatgccaggtaatacgtacgtatgcgcgcacttataatacgagaaataaactggctgacctaatattttcttccatttatgacatgttgttttgtgttgaaggactgaatagctagtgatttgtgatagttatttaagggtagaagcaaataaattactttctctctttaattttatatattagaagtcattttaatttttttcctaatcaaatttatttatgtttgatcaagtttataaaaaaagttatagcattttcaacgtaaaataagcatattatcaaaatatattcatcgctagatttaatgaaactaatttggtattttagatattgctaatttttttcctataaatttacactagaaaaaaaatcaaaacgacttataatcagaaaaggagtgagtaaatattaactagtccctactattataaaaattgaaaatatttttgccggtattttggtacgtcatccgtatttgagtcggtttttaagtttatttgcttttggaaatacaaaaggagttgtataagaaatttcttaaaaaaactcgcatgccaacttgaaatgaaagtcggactcctaattgcacacagtgaatttcatcctagctaaacatataacaataataagattaaaatatcattcacccattgcaatcgcatgggcattttttctagttaaagaatatatttgaaacagcaattaaaaaattaaattcaaatatagaaagttcttataaaaatcacgttatctagaagctcaggaaaaaaaaagtgtgcacggcaaattcgattcagtttcattaagcgatcgatgttgggcggctagttcatttaatgatggtcgcgtcgacgccgtcgatcgatcataccagagccaaccgtatacagtgaacatattttttcttttttcttttaggatgaggtatgcgacttgttagtactgtcgaccttagctacacttttccgttgcacggctgcgccactatccgaccaactcagctcatgtgcatgcatgcttactgtgtaaccgatcagttcatatttatctttttttttaaaaacacacacacacacacaaataccatgtactccactacaattgtagatagataccttagagcagtggtgtagttagaattttctcacgcctaaagcacaactagtataatttacataatttacctttatttttcgtgttttgaagtttttaaatgtaacttttaatagatatttaagcttagggcaacagccctaactgccctacccagttttcgtcactgcgcctagagaaatataccttttttttaaaaaaaaagaaaaacactaaaaagaaagaaaagaaaaaggagtaggagtcggcgtcatggccacgtcaggccggcgtcgctgcagcagcggcggtggcgtggcctccattgcgcatacatggagagcatccggctgatctggtccctgtactagcagaaccctagctaagcttagctccattgtctccaacttgcgatcgatccatccatccatccattaatttccgcgatccaatcgaaccacgatatgtgtaaagctatagcatatctacagtcactccatgctgcaccgcacaaaacactctaatcagaattaattaattaattaattatataatcatccatcctattttaaatacattagcgggtttccgtgtttgtcgtttgaccgcacatcttatttaacgaatttataaaaaaaataaaaaaaagtcgcgcataaaatattattcatgttttatcatctaatagcaacaaaaatactaatcaaaaagtttaaaacaaaacgaacgatcaaactttagacatagaaatccacatacatacttaaaagtttacgaccttaattagtcctactcccctggacactgccctcttctttaattaactaaataattaattaacacatgagctgattagtgatactaataagaaaattatagtgcatgtcaactagccaattacttgattagttattgtctttttttagaggaggcaactagctaattagcagctgcatgcatggtcacctgagtgtgagtggccgagtaggttaagcaagggtctgtctctgcttgattcctgcagctgctcatgtttccctcactccattgcccctgccttttcgcccaaaagatgggccgctcaaattaacaacccggcctaaagcaaccggctttctttcctttctttctttaatttctttccttctcctctttaattctctgcgctacaaatatgtatacactgccttactctaattagaagtaattacttaatcaatttctcccttaatacagaattagcatccaaccagatcatgcgacgaggcttaattacgtgtacataactagtatataataatataactatatatgatcccactgatcgaattaagcaactaactaagccactaactgaatgaacaggacacaaacagttctacgaatggcatggtcgatccccactatgtaagtgtatatatatatctctgaattcagatacacctttctactttaatttagctaagctagctagctctacctaatattgtaacatacaaggccactatctgtccctgtatgtgcaccagcagtgccaaatttcgctgcatgcttagctaagctaagcttatatagcaggagcactcgaggtgagcagagagagaggattgaagaagaaggagaagagcaccaagctagtagcctgatctctctctctctctctaactgtctatctatataagctaacaaggcaggacggttgttgcttgcgagatcatccctgcctgcctgtccctttcctgcatccatccatccatcttgatcttctcctagctcgattccacacatgtgaacgtacgtacgtttcagttaattgttcgatcgatcgatcgatcagctgctgctgctgctgctgcaacgaggaagaagaagaagaagaagatggtgaagttctcgagggagtacgaggcgagcatcataccggagtggaaggctgcgttcgtcgactacaagcggctcaagaagctcatcaagaggatcaaggtcacccgccgcgacgactccttcgccgccgccaacgccgcagccgcagccgaccaccttctcccgccgccgcccgcagagaaggaagccggtggctatgggttctccattcttgaccccgttcgcgccatcgccgcccgcttctccgctggacaacagccttctgcctcagtacgtcgtcgttgtgtctcgaatcaaatactaactaataaacgtgtattaattaattaatacacatttctgatgttaatacgtatgtgcatttcgcaggaggatgaggagtgcccggacagaggggagctcgtgcgatccacggacaagcatgtataaaattaattagttaatttgattgtaaataaaactaagtaattaaattgattgtaaaaatggagatgcatggatggatggtgtaggagagggagttcatggagagggcggacgaggagctggagaaggtgaacgcgttctacacggggcaggaggcggagctgctggcgcgcggcgacgcgctgctggagcagctccggatcctcgccgacgtcaagcgcatcctcgccgaccacgccgccgcccgccgcgcccgcggcctcgcccgaagccgctctatgccgccgccgccgccgtcctcctcgccgccgtcgtcggtgcacggctccagcggccgctacctcctctccggcctctcctcgccgcagtccatgtcaggtaggtgacaccaaccacccacacacatgaatcctgggctagctgcacatctctttatgcatgcaatgtcatgtcatgtcgatgtcgccgtcgtcgtcgtcgatggcgtgttttgcagatgggagcctggagttgcagcaggcgcaggtgtcggagggcgcggcggtggcggacgaggtgatggcggcgctggagcggaacggcgtcagcttcgtggggctcgccgggaagaaggacggcaagaccaaggacggcagcggcaaagggcggggcggcggcggcggcggaggcggaggcgtgctgcagctgccagcgacggtgaggatcgacatcccggcgacgagccccgggcgggcggcgctcaaggtgtgggaggagctcgtgaacgtgctccgcaaggacggcgccgaccccgccgcggcgttcgtccaccggaagaagatccagcacgccgagaagaacatccgcgacgccttcatggcgctctaccgcggcctcgagctgctcaagaaattcaggcacatcttccctcttcatctttcctttttgccatatctgacaagctaaaaccacgaagtcacggtattttagaacaagacttgccttttgtgtctatgtatattgtcttctatgccatgcatgatgcatatatatacgcatttgtaagctatttagaattctgatggccaaacctcacactaatagcatgcaactgatcgatcacactaattgcatgcacacaaatgatatagatagtttggttaactgaccaactaggaaaaaaaaattaagttgtttcttcatagatgtatatctaacaaattactactatgaatattagttgcagcatgagtcatggagcactgtgtgagcagcacacaactacacctgcactgcacccaagcatgcagtacagtagtagtttagtcaaatttcaaccccgttttgcatggaagcatccgtgtaaatcacgtagccatccatacaccatcctgtgtcacctgaaagcgactgtttctcctttcaaattactaattcttttgtggtttttgaaaaggtagattaattcaccggttattttaggtggctgtctttatatttcttttacttgtcaattatggtgttcttgtggttctgacggatttggatgcttttttggttgcatgcatggatggatgggagcagctctctcaatgtaaaggctttcaccaaaatattgaagaaatttgtcaaggtaatatactaattagccacatctgtgcccttttgaaatggatggatggaagaatgaagagtctaaataatagatgataaagattaaagaaaaccggtctacatatataaggcttctaggagaataaagttctaagtgtactattagtagtttagtaccctcaaagcagaggtactagatctcattctcgacagtgtaatcctagtcactagtcagcctaataacatgagacagcataaacattttcttgcaaggaataatttaattttttaatatatttttttaaaaaaatgctactccgagctgacagtgactggtacgaactgctttgcatttcaggtgtccgagcaacagcgagctacagacctgttttcagagaaggtgaagaggtcgccatttagcagctccgacaaggtatcatctggtgctccacaatcctactgcaaagctgcacaaacatacaaattcacttcaatcagttttttgggggatggaaacatgtctctctgacgaatatgaactgaagcatgcgaaattctgaacaggtacttcagctagcagatgaggtcgagtgcatcttcatgaagcatttcacaggcaatgacaggaaggtggcgatgaaataccttaagccacagcagcccagaaacactcacatgatcaccttcctcgtaggcatgtagctgagcaacttcaagatcagaatatcagatctgtcatctgcatttggcacacaaatctaacttcacttcttcttttttttcatgttctaatttgcaggtttgttcacgggcacttttgtttcactgttcatcatatacgcgattttagcccatgttagtggtatttttacttccactgggaactcagcctacatggaaattgtgtaccatgttttcaggtaaattcttgagaattacggttcagttctaggggtaaagcactatttagaaatagattttttattactgcgtttgtacttggtacttctgttcaggctatatatgctctgttcttgacaagagttcaattgattagatttagcatgtgggctcaatgtttgcaaatttttcaaatttcagacttaggacctcatgataataaaagatgcaattttacctcaaagtaatgtatagatgtgaccttgcttctgcagcatgtttgctctcatcagcctccacatcttcctgtatgggtgcaacctcttcatgtggaagaacacaaggatcaatcacaacttcatattcgatttctcctcaaacaccgccttgacgcaccgggacgccttcctcatgtctgcatcgataatgtgcactgttgtcgctgcactggtcatcaatcttttcctcaagaacgccggtgtagcctatgccaatgctttgcctggagcactcctactagtaagaaacataaactttgggaaaatttggtaattcagctctgtttcatgtactgattttcagttctcaactcggattctgttgtttcagctgtcaacaggtgtactattctgtccatttgacatattctaccgctcgacgcgatactgcttcatgcgtgtcatgcgcaatatcatattttcaccattctataaggtaaagactaaagacctcatgagttttcttatcacaaattgttgaaagcatctatctgataagcaggctgctttgacatgcaggttctgatggctgatttcttcatggctgaccaactaactagccaggtaatactgaagaaactgaactttacactagagcttttgagagttggagctcagcatcttatgagtgaactggtgctactatctgcagattccactattacggcacatggaatttacagcgtgctacttcatggctggaagctttagaactcacccatatgagacctgtactagtggccaacaatataagcatctggcctatgtgatctcctttctcccatacttctggagagccttgcaggtatgaatctttagatgggaaatactaacgattaacaactttgtttggatcagtttcaaactaatagctgtgtcatgttttgaagtgtttaagaaggtacttggaggaaggacatgatatcaaccaacttgctaatgctggaaaatatgtatcagcaatggtagcagctgctgttaggttcaaatatgctgcaacaccaacaccattctgggtgtggatggtcatcatttcatcctcaggtgccacaatttaccagctctactgggactttgtcaaggactggggcttcttaaacccaaaatcaaagaaccgatggcttcgtaacgagctcatcttgaagaataaatcaatctactacgtatccatggtactatgcttaatatacttcatttctgactaggctagaaaattccagatctaggacactaatgccttcaaataattacagatgctcaatcttgcacttcgcctagcatggactgagagtgtaatgaagatccatattggtaaggttgagtcgcgcttactggatttctcgctcgcttcactagagataatcagacgaggccattggaacttctataggtaattggaagtacttttacaaggaacatcaattttaatttaatgttatggtgtaacatggtgaaatggtttatgggattgcagattggagaatgaacatttgaacaacgttggcaagttcagagcagtgaagactgtcccattaccattccgtgaacttgaaactgattgattaagcagtaggacatgccggcatgctgccaacatcaaggccagtaaggatcagagttccaggaatggagatgctgcttgccgctagatttggtacataagtggtaataaagtttgcagagaccattggtgcacaagaccatgatgttgctgattaggatggaataagcttaaatcagagcagctaatcgaggcagttcgtcaaaaaagaaggaataatcccttcttggtccgatgaagattgttgggcgtcatttcgctaacaagatcttaattttgtttatggttgtgttatgtatgtatctggagatggatgcccaccctccaaaaaaaatattccatgaattcatatgcaccattgcatcaaactgaattcaaataatttgccgataaacaaaataagtaagatgtcaatgttagagaaggaaataagaacacaatggggtaaaataaacatgcaatagatattaattaactgaaggggaagaaacccaatcatttctgctaatacagtgaaagcaagatgcttggcactacagatgactaaataagctaaagcataaacatagtacaaatatattacatgtcgatcacatgatgcacacgataaatagatagctatgacagatacctccattgtgctggacggtctcttgagacaagaagaacccttgatgacgagtaatcgaatgtagggcagtacaaatcatcaaagccaatagcctctcttactccaagagtggctccacggtcaaagctgtaagtttgttgaccgtcctccttaaaggcgtcaaatgcaaatagtcccataccacatgcagccaagacaaggttggagttgccccatacttgggttattgaagagtgatggaagtgggcattgaaatcaggtagctcataggttgcaacaagctttccctttctcagtgaatattgctgaactcgtgatttcagacccccttttatttgcagcctaccttctgtgctcccaatgaataccgagtcaccacgtgagaagattgaacttgctgtaccaccatgtcttgccattttaagaccgatgccagcaggtacacgaaagtcaaatacattaacactttcttgtgtgctaaaaacaccatcatttccctccacctcacaggaactaactctgcaaaacagaacgataaacaagttaactttgaaaacatgtcagctcacacaaaacagaacttacatctcctttagattagttacatttccaagtttcagaatcatcaatgatcaagacaaaaaaaaatcagctattggtaaatgaactaaaaaatcctgcatttgcaagcataagccaagttcaaccagacaggatctagtatagtgttaccaatggtacacaaagggcattcaagctaataattccaggcgtacctttgacgaactcctccgcccagctctgcatcagtgttgttcacatgaaggcagtaaagctttttgccagcagaagcaacagataacaggggttgtgggttaagcgaattaacatcccacaacccaatcgactcagtaccagcaattacaaccttgcccctgctacgccattgtagtgggctggaatattccattccctgtacaggattgctcacttcccatttcatcactacatcaccatctcggatgtcataagctgtgaccatcttttgcttactagcagcagaaagcaggagaggcccacagggtctataccaccattgctgtctttctacagtagaaattgcagagctagatcttgatgaacctacattaggaagaggcccaagaacagttctggacgatggtactgaagaagcatgagatatctcctcaatgtgaaatgcttttgcttctctgctatagtaatcccagctgcaaaacccagggtccagtgcattgccagctgatgccgcaactacatatcttcctgagcatccgtcaacacccggggcacggatcaaccagcaatcaccccacatattatttgagatcacactcggaggcttgtattcagacttgaactgtcattttcagtttaatgcaatcagaacttcaaaatgttgtattaacataaattatgaaaagaacaaaaagaaaacatagtaatgaatcaagtacctcgcggtttgcaatatcatagtaagaacaggtaccatctccatgagcaagaagaacagcttccccctctgaaacaaaccatccaccagttgaggatttgttccctatccctaataactgatcactagagaattcctctgtttcctcctgtaaaatcaaaaaggacttgttctcctgttcatcaaactcttctagcttctctgtagcaagcaattcaatttctttgtcatggtttgggcctaccggattatttgaggaaccttggcccgatgtcttgctgctaacatctgctgcttcacagatgatggttttttccaagttcttcgctctgcggttcttgaagaagccgctttcttcaccatctaaggaagccagaaactccatggctatactattctcatcttcttgaggctcaagggaagaaagttccatatctgtgttacaatcctttttgacagccatggacgattcctgttgagtagcgctagacgatttgcagtctctcaacaatttatgatgtggaaagaacctcgcctctaattcatcagtattcataccttttgcagcatgcttcgggtcacttggctttgtaacagcacactctgcagcctttttagcataagagatctcacactcactattatctgcagtgccgagctgaatcttattatcatccttgacatgggaaattgccttctcaattgcagtaatctccttctggatattagataatatctgcttaggctcatccgggttattctcatccagcatctctttggtcttcttgatatctgtcgctatcttttggactctcccttccaatgcagctagtttctcatgcagcttgcttgggtacttgttcaaactagaaacagatttcactgatcccccacttgcagacgctttctcaaaaactctaatcttgtctgccagcttgctcttttcctcctgcttcttaggctcatcagtattcttctgctcttccctggctctgcaaggaacatcgtccacgtccaccacatggacagtgaatacagggatgacagcattgttgcctccgtcaccatccttctcagtagcaggaaaaggtgcaggtttggaagaagcttctgccgaaccagtgacactagagataactttcttgggatgaatctctttcaccaatttcgtatcaaatccatctttcttcttattgatttcgtcacctagcctggccttcacatcaaagccctcattgtcgccatcaatcccatcgcattgcttctttgcgttggtgccaaagccctctctttcccctttgatctcatcacattgcttggtcacattaacatcgaagctccctcttttcccactgatctgcttcgcctttacatcgaagctctctcttttcctatcaaccgcattcatttgcttagccttaccatcaaagccttctcttctcccactggtcacatcactcgccttcgccctagcatcaaacccatccctcctcctaccaatctcatcagcacgaggcacgctgcttgctctcctcgcatccgggaccctacccccaacgccacccaccgacctcctcgctctctccggggcagcggccctgatcccgccgctcacgctccgccgcaagcccgcctccgcctccatttccttcccgacagatgccctccccggcatcaccgaggacgccctgagggtggagacgagcttggaggactccacggagctcgggatcctgctggccctcgggatcgacgacgtggaccaccgcaccgcggcggtgggcttggagggcttggacgccgagttctccttcccggcagcggcggcggcgggggtgcggcgagcggacgacgaggcggagaaggccttgggggtgagcgggcgggatcccgcggcggcgggtgcggccttgccgcggtccttgatgcgggaggccatggcgatggtagggttagggtttggggggatctgggggaagacgagagggagagggagatggtttgcgagattttggggaaggaatggtttgatttgggaattttacgaccgggagaagcgtttcaaatttcgaaatgtttcgagcgcgaggccctgtggctgtgggcccaggcggcatgggtacaccgaaaagcgctggggccgcattaggtggggcccgctttgtcagtgaccgaccagttctgttctcttgttgggctaaggcccgtgactcggcccaagtgatgagcttctaagggcccgttcgtttgcctcccattgaaggagaattttaagcacacgcaaaacagtaaatctcataagcatataattaattaattattaatattctcttcgtcccaatataagtgcacataatacaggatatcctagtagaatatactaatataagtgcacctaatacagattattataaacttgaataatagagttattttcagtttttaaaataacttttatatataggaattgtttaagaatgtatattttaacatattgaaaaacatgctaatagaaaatgaggaagtttgaagttgaaaaaaaaaacagggtctaatggtaaggattgtagcgtctctttcagcgtaatccagctggttggacctctaattctggcattcaaccttgttttccccttaactattcgctctaaacaagccctcaagctgatagcgtagcttaccaaccggcaaaatcccaaactgtgtgtggccataataacctcatttgaagagagagactgctaccaaatgatgacatctgatcgacagtaagctgcatgatctttcacaatcatataacatcctttcaatccatcaactatgagttttgtacatttctgcatcgcagggtttcgctctcaacagcagactgtaaatgatctgcttagcctcaatgagagcaccacaattactctgctttgaaacacaataagctacagcaagttatagcagctgtactaattaagtaccaacagaaagcaagataacgtctctggcaagcataagatgtccagtttccttggaaacaaagcgaagagaagagggacagcagcagtcataagcaagcatgtgcattgagcttcctctttgcgagaaaatcactgccagattcgagggttttcgtacaacaggaggggaagtgctacagctaaaaagccccccacaaaacacatctttaacaacaacagggccgtatcatcatgatcatcaaacatacatccagctggaagaagaaaataagggggcaaaaaatagaattgaattacagattagcggggtatatagccatcctgtacttcctcgaggagatccaatcaactacgcgttctccagagcacattatcaatctatgctgtcaggtgcgcagcacagctgacatcaacatctaacatctctgaatgaaaggtgacctgctatgtggcgaaacttttttactcctcaaagccatccatcatcgggtgacctccttccgacgaggtgcttttcgatgattgtttccgagttgagccccgcctgttcttggctttctttgccttcatcctccgtttcttctcgttggcatcaacccaggtgtagtcagaaggtatttggaatggatcaacctcatctttccagttacggctatcaccactatcactggactgtgcaccacgcccccctctaacccacgaataccatgagcctgatccttctgattctttgcccttggcatcctggaattgcgttgggcttgagggtggggtagcaaactcatccaaaggttgtaattcctcaaactttgtgaatgtcacgatgactcgtattgttggaacaataggtatcgcaatctgaaaatcaatgttacagagagttagatatcatcttttccaaaatatagattaattcatgtgaatctcattttcgaagtaactgtagtgatgttaattttggtaaaagaagagatctgatttcaaatttgagactatgtgaaataataattatgatgcagtgcaaacgtcttgtactggcaccacaatgccttatccaacaagaactaagattcaaaacaaatgatgagattccaaaaaagttacaacaaaatgaaacgattcagattgctatgcacattgagacaagacatctgtaccaatttagaaacaataaagcatggcaacaaaacatggaaagcggtaaaaatagtctaataatgcaatggaaaaattactgcagcattcaccaaagaaaagatgacacatgaaataacatttgacaggaagagtggtcacaagatgtcgatggatcatcaactgcatttagggatacaaggtcagtagggtacaggggggcatcagttttatggtggtttggagtaggacccagctaatcaagactcaaacagaggaagagatagagtggatgaataggaaataaacatatgaaagttttgaaagcttcaatggatatatttttttggcatttcttaaatctgtgagattattaaattgatggtgggagcagaaacccactggctacttttaaagttaattaacaccacataaaagaaatggcaaacagacaaatagaaatatacaatatatttgtactagattcaataactcgatagtgttccatgtccatataaagtttaatacaacaaggaaaaaaaatgtcatcaaccatcatgcatcaaatccttagaaatagtcaatgatattttgcaagtacactgcacatttatcatttacacccaaatataatatctattattggaatctaattattccatatgggtggccaatagtagtggtaactaatagaaaaggtttggttattcgaacatccatcaatcatatgaattgtgcacatggcgggcaccacatcttatgataatgccttgttagtgcgagggattgattacccgggaggacacacataagatgtgctagttctagaacttgaacagaactatcttgtattaatatgtccggtctaaagggaaaaaaaccacatgcatagccataagccgcgcatcagcgccaacaataaagaaacacatattcataatttcatattcaagcacatgtcataaccaggttcaaacagtactatgcacaagcagcaaggcagacagcacaagtcccagctagggagtgaattacgacgcatgacacagcaggtggatcaaacaacaaacactggcagtcaaagaaaccagtgcaaaataattgctcatacaatcagcaaacagtcgttgattgagttacatagaatcatatcaccatttatgttgcaaatgaataagcgtgcaaattttgactaaaatgaatggcatatcaaaaattcagttaattgctgaaataggtggacattatatagtcaagttggcaggtggttaccttcaccggaaatgtgcctggaggcagtttagtagtcaagagttccctaagccttctgacagctttcactttgtttgctaagacatcaagcagagggatcagttcatccgtcttcaaagggaaatctggtgtcagccacaacactggtcttaaccccttcttgtattcactttcatgtttagtagaatcccctgatgatgcacccttcttcttcttgctgctgttcttctcctttccctttcctaggtcacctgattcatccttactcccttgattcgccttggatggtttctcgtcattcttggtgcctttcttgccaccccaaccaaaccatcccttcttatcttttgccacgccatttgcatccaaatgatcagccccgccatcaccttcctcgcacctctcctcaaattcttcttcctggttccccattctcaacgcagaatcaagctgtttcctctcttcggctgtcaacacttcatccagctccgcgtcaagttcagtgcccctcccattcttctcctccccctccatcgcaaacagctcctcatctgtcatcgcccccggcacacgccttgacttcacagtcaccagaacgtttaacatatcataaaccttagctttccaatgtccaacggcttccgtcctctcctgccggcgccaattcaaatgaggcacaagctctgcctgcgtcacgtcgatcccgggacgatacatgttcgtctttgacatcaacgccacctcatgtgcgacctcggcctccgttggttgcacccctgctccctccaatgcatctgtgatctccttgtccttatgagccagcactatgagagaacctgggtgcaactctttgcccccagcatcctcaggacgagcaccatccccgagaaacaagaaggtctggtccgaacgctggatgcggaagccgtcgaagccggcaagcgtcatgtcggcacgcagcgcagctccacgcttccaaatgcggtaagtgtcggagggggcgatgcggccgatgaagggtatgacggaggactcgaagtggaaggagatctccatgtagaagtctcggatgcggttgatggaggcgaggacgcgcgggaggcggcggcaccacttggcccaggcgaggggctggtagtggcgcgcgatgatggtggcgatggcgtcctcccgcgtgcagacggcctcctggagcgcggaccacccgtcggcgttctggagcgaccagtcggcgccggcggacatgaggatgtcggcggcgacggggtcgcggagccgcacggcgaggtggagcggggtctccctccgcggcacgtcgcggcggtcgatggcggcggagaccgcgtcggccacggcctcgccggcgatggactcctcctcggtggccacctccccggcgcgcgggaggcgcgggagccccgcgaccaggcggcggagcgaggcgtggtcccgccgcaccacggcgaggtgggccgggctgtgcgcgtacttggacgcgtcctccatgcccccaccccgtcgctcggcgctaggtcagggcggatctaggccgagctgggcggcatgtggcccagatctggctcgccgaggtcggcctcgggatccgccccctcctcccgcggcggcggtgacgacggcgcgggggggagaagggagggaggggaatcgcggcgcggcggagggagactggagaggagggaggggggaagtggtcctcctgttcgcgcgatgtctcgctgtatttttcttttttctcctctctctgtgtctgcgtctcgccctcctgctgtatcgagactttgcctgcgtgtgctctagattggcgcctccttccctccctccactgtgtgtttgtgtgggtgatcttgggggggtttggtttggtttggtggtgtcatgggctcgggtgatcatttcatggtcgccaggacagtttgttttgtgagctaagtaagttgcggttgatgatgttttctcttggtgcaaacatcattggttaaatggttaggtaagtaacgggtgtgattttcttttgagaaacacagtacaatcgttggtgcttataacacacgcatacgcatacgcataccctgtctctatgagtatatccacgaggctgggccggtatatcttaaaattgatgaaaccagggtttgaaatttcggttcgaaatttctgaaattttggtaacttcgccccaccccccccccccccccccggcaagctcacatcttgcccgaaattttcagttttttgtaatttttttttaatttgatcaggttttattcaaattaattcaaaatcaatcaaattttcaaataatttcggcaaacaaatttctaaaattccggtccccaccggcaacaaaaccaattccaaaatttcaaagcttgtatgaaacaccacgggtgtctcgctgtcaaggggtacgtcgcctaccactaaataaataattaacagtaaaatacgaccatccgtatcaagtttatgacttaagcccatgtgggttagttccaccacaataaacctaaccagttgagctacgctaaacgcaatacaaacgcaaacaattgctatatccttcttaaatatacttcctccgtctcaggaatatagtaaccagaaactagattggacatcacatagatacattgtgttatatggtgtttaatctagttctaatttgctatattctaaaacggaggaattatctaactaatacatgatatgtcgcatctgatagctatattttacgatggagccagtatatgctcgtcacccttatcaattgtatgcatatgcgctcttataagcaacttcgaacgattgagactaatagacttgaaattaacgaagtcactatatcacacgttgcctggcaccaaaagaaaatcagaaacttgaacttatgagttagtgtagctagtgctgtgatattgtgtacatgtgggacgcatttttgtattggggggctataactaaaaagagggaaagaatgctggtcacttgtctaaattaatgtcacttatccattaattgctattccctctttaaacttgaataaggtccccatgagccatgacataacaccccacttgtgtaagattaatgtcatcaatggatgacactatgcccattgtcgttgcatcactttaaagctttgttgaacaaccctgacaacgtccttttccgtgagatttacacacggccgaccaagacacacgtacggcatatagctgcaggacgaatttgtaacggttaaatatccttaataatccatacccgcattagctacgatatatccatcgaatctaatgatcgatctcctcctcctcgtgaagaaagaaaaagaagaagaaaaagaaaaaaaaacaaactactctctccatcctaaaatataaaaacctaggactggatggaacattttctagtacagtgaatttgaatgggtaggaaatatctcatccagtgttaggttcttacattttaggactgatgaaacacctcttaataattgataaaaacggtttatatctcctgtctttattactgacacagccaaataaagcaacctggctaatgtgatcatcgctagtacaatagcactccctccgtttcaaaatgtttgacaccgttgactttttagcacatgtttgaccgttcatcttattcaaaacaatttgtgaaatatgtaaaactatatgtgtacatgaaagtatatttaacaataaatcaaatgatatgaaaaaaataaataattacttaaattttttgaataagatgaatggtcaaacacgtattaaaaagtcatcggtatcaaatattttgaaacgaagggagtactagtatttacagtaactagcagtgattaatctgtagaccatgcaactaatcaacccataataagagaggctgccctgccctgaccaaaacggtgtaaaagtcattggttgttgtgttgtttggcagttcggtgccgtgttgacgcagacaagtttgcgcggtagttggttgcaattgcaattagcctactgctacttgatgacaaatagtagaactgaatggtcgtgtcaaacatacagatcaaccaggcaattaatcgacaattcgccattggtcaccgagatgagcagagcagctgagccggcaaggcacaagcatatgcaacggctgcaggaggaggaaatctaatggttggtgagagatatgggcagcacagtgttctctgtacctgcagattcacactagatcggatgcttctgtctctgacaaatctcgctactgctcagcccaagtaggccccctgatctctcgtggctgcagggcacagctgtgaaacatggcgccattagctagctcaaatcttgttgttactgtgccaatccagatcacgtacgagtacactgtttgctataattctacaattaaagagatatactccctccgtcccaaaaaaaaaaaagacaaaccctggttttcgtgtccaacgtttgaccgtccgtcttatttaaaaaaaatatgaaaaaaattaaaaagacaagtcacgcataaaatatttatcatgttttatcatctaacaacaataaaaatatgaattataaaaaaatttcatataagacggacagtcaaagttggacatgaaaacccagggtttgtcttttttttagacggagggagtataattttactgctctgaagtctgaactcgcttctagcttgaggctgaggaagagcagctctctactaaattcagcaagtagaaagattcagaataatgttgttacagtctctaactacactgatcatatcctgcgatagcttcatggaggataatcctatgcagaaacaaatctcgtcgatcgagcgacagttgatccaatccatccatcgagagtttcagatgtcctacagttcacgcacagaagcattcttgttgctggccggcttgctgagatctcatttcagaatgggcaaagcagcaaagatgcatagctaacaggctaccactagcacatataaataagatcggtgacagactgacagtgtgtgtgtgcatccatggagtcatggaccccaatggcatccatggcgattggtcccctgatcaagcaagctgcagcttctctcttctctcttctcctctcaattctcatctcagctcatgtgatcttgccttctcacaaagcgatatctctccctcctccctccatgataagcatgcatgcagcccagcttaattattttcttgcagcggctgcttattagctagagcaaaggattaggacagcaaatagtaactgtgagcgaccaaaagcagatggtttgtttagctagctcgatgggcatgcatctgtactaaacaaataacaatgaggtgtagttgtctgacctaagttaatgataattttagcaagcatcttaatttaaacactgcagcataatgccagcatctctatgtcactctgtgtgtgtctggaaaggttgatgcctgtcagttttgctagtgacctatcgtgtgatgataattaggattgataaagttatgtcgcttttgacgccgaatagcagcttatgtggcgattatgtgcagccctagagcagtattaagggtgtgttcgctactcaccctattcacggaaaacataacaatccattaacatgtgattaattaagcattaattattttttttcaaaaatggattaatttaattttttaaacaactttcatatagaaactttttcaaaaaaaatataccgtttaacagttttaaaagcgtgcgcgcggaaaacgagggagaggggttgggacaacttatattcttttgttttccatatttttcaaaataagtactacctccatcccaaaatatagcaatttttagctaaaaatgcttatattttgagacggagggggtatgtttttataaaaaaaataaaaaagttgctctaagaaaaaaatatttttaaccaaactattaaacggtgtgttttctgttaaaatacatacaaaagttgcttaaattttacattgatttatttttaagttttttactaatacttaattgatcacgcgttaacgaggtttctagtcccaaacaaacacaacattaccgctggcttgctaacaaagtttattttttggacacaactacaccgagagtactagcaggatagtgctaaagagagacactattctttccaaaagaagctaccagtacactcaatatctatgtttttttttctttttagagaagtttctcttaaaatacttatctgatttatgatccgattataccgttgtgttcgttgcaattaaatctttacaacaaaatcttacatgattatattctgataatatacatacatatatatatatatatatatatatatatatatatatatatatatatatatatatatatatgttgtaagttacttttattatatatgtaagttacttttgtcatatatgtgatttaagctctttaataacttatatattttaaatcacgtattgtttttagtatctatttgcgtcattatgctctacataaaatatgtgacaatacaagatccatattgatatatattcaaatattttattaatttaaaagcaatgtatttaaattgcagaagtgatttagttatacaatagaagtaacttagctatacaatagaagtaacttagctatgcaatagaaataagtttctgtagtagaagtaattatatgcaacagaattaatttagttatgtaatagaagtacttctaactctctctatagtagaaataataatttacataaatcataaaagtaacttagcataaaatgcaagtaaattgttataacattagaagtaaattcgttgtaggaaagaaaatatggtctatcgaaaaattaaatttaaagtccacaaattacagaatttactaaaaacaataatacaaataatcaatttagagcattatgaatgtataagaagtaacttagtcaaatctaaaagtaatttatatatatgataaaagtaacttacatatataataaaagtaatttacaaacataaatatttttttcgtcgcaatataatcatgtaagatcttgttgtaaagatttaattgtaatgaatacaatggtgtaatcggattgtatatcggataagtaattttagagaaaattttataagaagggtaaaaagaaattttatatagatgtgtaggcatttgtctgttgtctcccgtacagatgtgtaggctttctctgctatgtacgtagactttctataccgtctcctattaagactaaacagagactaaacagagaggcctctctgtttagattttaccttattttttatagttccatacctcattggatgcttcccaacttcgactagtgttcggggctcaagacctaagcgaatatccccgaaaaaaaaaaggaaatacgaatatgtccgtattgggccagcccataagtacggatgttacatttccccgtctcatgggccacttcggggcccacatcgtaccaggtgaaatgaagataatggaacacaaaatactgtatatactttttaacaaattgatccttttcaaaaacttatttcgaaactagtccctgcaaaaaacttcaatcaaaaataggccgcggactcagcgccatggacattggcgctaagctataacgtatcagcgccaacatcgttggcgctaaactctaatccgaggtgacatgaattcgctgagtcatcagatcttagcgccaaggtatttggcgctcaggtttagacgatttaaatagatgcggaggcatttatagtaacaccccattgatagcataatggtagtagagttctactctatccttgaagagcagggtttgactcccatctctctttttttttctttccttttagtttccctttttcttctctccctcactcattattaatatttttttcttttttatctcgttttctttttcttttttttccttttagttttccctttttcttctctccctcactcttccttatagtttccctttttcttctctccctcactcattattaatatttttttctttttttatctcgttttctttttcttttttttccttttagttttccctttttcttctctccctcactctttattaatatattttttctttttttatctcgttttctttttctatgtttatttatttattttcttttttttcttgtaatactatcttcaaaatatatgtttaatatgcaactttttttgaatttgaaaaaaaatattaaagtgctatattatatggaaaatgagaacttaaactgaaatttcaaatcaaattcaaaataaaacaaatttacaaacggaacagtcattttgtaaagaataagagtgagtattaatatgttttttcttttttttatctcgttttctttttctatctttatttatttattttcttttttttgtcttgtaatactatcttcaaaatatatgtttaatatgaaactttttttaatttaaaaaaatattaaagtgctatattatatggcaaatgagaacttaaactgaaatttcaaatcaaattcaaaataaaacaaatttacaaacggaacagtcattttgtaaagagagtgagtagtgaagagaacaaaacttattaaagagagtgagtagtgaagagaacaaaacttattttgtaaaatacatgagggaaaccaggattcgatcctagtaccctatggatgacagcccaagcatccaaccaccacgctatcacggtcttggttctatatgttgcttgcgcgattatttaaaccgtctggacctcagtgccaaataccttggcgctaagatctgatgactcagcgaattcatatcaccacggattatagtttagcgccaatgtccatggcgctgagtccatggcctatttttgattaaagttttttgcagagactagtttcaaaataagtttttaaaaatgaccaatttataaaaaaatcggctaaattactgtagtactacttgggtgacgctcgatcccaatacgagtatttataagatgattttaaagctactccacaagtagataggagtaataaataaaaaaacactttgattaacatcactatatgatttatttttcacagtttcggaagacaaattaattatctttgcacagtttcgctgcaccaccacccgattctatgttcagacaaaggatatcaccaaataaaaaaactaaacccataaatgcatagtagaatccaaacaatactatatattcgcatcagaccgacatagtacgttggacaaaaaaaaaagagtaaaatctatacgatgttatcccgtttgaacgaaatgataccttaaaaatatcgtatgatatctggtaagtatcatcttatctgaacaggtatcaactgatacctatcaaaaatcaagtgcctaggtgatatcttagaggtatcattcaatccgaacgagatatcgttctacattacttccaccgtttcaggttataagacgttttaagtatgatcaaagtcaaatcatttcaactttgactaagtttatagacaaatataataatgttgataatactaaataagtttcatcaaatcaataattaaatatagtattttcataataaatttgttactatttttttctacaaagttgatcaaactattttaattttgaccaaagttaaaacatcttaatctgaaatggagggagcatttttcttaagaaggaaacaaagaaaagttaccatataaaattgtttcagaattcaattttgatgcatggtttcccccattttgcatcgaccgaaaatctcgtgatttcgcggcgggcggtacacggcgcggtgcggtctccctctcgtccagcttcaaaacaaacacacttaccgttacgactccaacggctacttccctttcaaatccttccccttcccaagtcccagccctctcctctcctctctctcttcacccgcaactcgatctccaattctctctctctttctctcgcatcgaatccgagttcacatctccaaaccctagcgagctctctctctcgcagatggcgccgccgacgccctctccccggccggggccgccgccgacgccgcaggcggccatgacgaccccgctcaagacgcccgcatccaagcaccgcctccacttcccggccatgacgcccaggaacggcggcggcgggggcgccgcggcgggcggcacggagcacccggtggaggtgatcggccgcatccggaacctcgccgcgggggcgggcggcgcgtcggcgctggagatcgcgggcgggggcacggccgtgcgcgtccgcggcgacgccggcgggtgccgcgacttcaccctcgacggggtctcggtctccgaggaggaggatctggaggggttctaccgccgcttcgtgcggtcgcggatcgagggggtgcgggtgggcgccaagtgcaccgtcatggtgtacggccccacgggctccgggaagagccacaccatgttcggctgcgccaagcagcccgggatcgtgtaccgcgctctccgggatatactggaaggaggaggaggaggagggggaggtgtctctggtggtgggggtgaaggcgatggccgtggcgaggatgacgccgggttcgggatggggctgttcgtgcaggttgccgtgctcgagatctacaacgaggagatctacgatttgctcgtggggagcggagcgaatgctaaaggaaacgcccccaaggtgatacaccgaaactaattttccacatgccattattaactgttagtaatgcagctgcaatttgcaattgggttcatatgtgatgatgcctagtgcttaggaaatgttattaattaagatagatgtgtgttgaagtttgaaagttaacaggtggtgtctgctttcttactgtcactgtccttttcagtgaatcttgcttgtcagttatgaatctgacattttttttaggagcggataattactttaagctgaattaagttgttttctggtgctcggattgcagcattttagggataaacaaatggtaatatgaaattggaagctgaaatacttactgtgagctgaaacaggttgttttttgagtggataattactgtaagcttaaataggaagctcatggcttgtaagttccaaggattggcatacttatcataggttttaacatgattttcgggaacatatgatggacagaagattttaatagttttaactgcgtaactttggaaattttctatggtgttgaagtttctcagtccttactccttactttatgtgcaggcgaggctagaagtaatggggaagaaagccaagaatgcaacctacatatctggaaatgaagccgggaagatatcaagagaagttgcaaaagtggaaaagaggcgtattgtcaagagcacgctttgtaatgagaggagttcccggagccactgcatggttagttgcacacttgcgttctcgtattgagctgttagctcctggaatcttcatttcaaaaatgaactcgctattgataagcttcgctttacttctctagataattttggatgttccatcggtggggggaaggctcatgcttgtggatatggctggttctgagaacatagaagcagcaggccaaactggatttgaagccaaaatgcaggtctgtgatgtcactaatgcctgtataattttgtactttcagcaggacgtttttaaagttaccccttcaacaatgaatacctaatacagaagaataattaacactgttgtgtaatgaaaaatctaaacataacagttaacggtctgcaaagcagtgaccacattgtaggttttttttctccctttttttgaatgataaagtgatattatcacagtcacgctgtttttaagtactttaggtactactattatattgtttttctgcaacttattgtatgtgtttgataattaagttcatagtttgtttacatgatcattactgttgaacagactgcaaagattagctactagtactttttttcctgcaaattatgttatgtgttcgataacagaagttcatattttgtttacattattattactgttgaacagactgcaaagattaaccaagggaacacggctttgaaacgagtggttgagtccattgctaatggtgactcccatgttccatttcgagacagcaagctcacaatgctcttgcaggtacaagattctaaaatttcacattcctcgatacaaatttatactgtaaaattaaagctgctaacgtaatgcctacgatcttccatgaattttcaggattcatttgaggatgacaaatcaaaaatcttgatgattctctgtgcaagtcctgacccaaaggaattgcacaagacagtttctacattggagtatggtgctaaagcgaagtgcattatccgtgctgcccacgctgcaaccccaagggacaaaatgagctctgaagagtcatctacaatgctcaattcaagaattgtcgcgatgaatcagttcatctacaatctccagaaagagaacaagctaagggagaaagagcgcaatgaggcccagagtgtgctaaggaaaaaggaagaggagcttgcacagctcagggcgaagctcaagctgattgaaggtcagggagcagctgcaaaggaggaagagattaactcaaaggtcatggagaagacccagagtttgaggactgagctcatgaagatggaagagaaaatgcttaggcagcagcaagaactccttgctttgcaacagcggctgaaggaggttgagcgtgaaaagcctgtgcagcaggatatcatcggaggtagattgctggcacgtctgtcagagatgtccgctagggcggatcagtccatgtcaatggatatgtccattgattttgatatgggagatcagccagctgcgcaagacgtgaaggtgatcaaggaggatactcgcaagcagggccagatatggagccaagcaaatactgcaggctcttgcaccagcgctgtggagcaagaagatgatgttgtgaggctgtctgggtacccagaaaaggtggtcctgagcactgtctttgaggagggagatgaagaagaagataaagacagtggcgttgaagaggaagtgtgcaaggaagttgtcgaagagagctatgtaatgcaacagccccttgcagagcctgaagaccctgccacaaggaataaccggattcagaacattttcaggctttgtgggaatcaccgagaattagccaagaaggtccagtcaccagcaaagaaggcgttcggagatgagaacaatgagcctgcgaagcaaacattcggagatgagaacaagcagcagcctgcgaagcgagtgtttggagatgagaacaaggacccttcagcatggggagcgatagaacctccaatgtgcgacgtcagagtgaccgacagtccagtatcctcgcagctttcacctatcgtctgccaagttgtggacgatgccaagttgcccgtgtcggagcagctgaaatcatgcaatgctttggaggcagctgatgagaacaaggagaacaatgcttctggacaagacggcctgcttgaagtctacatcaaatgggagtccggccatctgataaaaggtctgaaattgctgagcaactcgtgtctttctgacctgagaaagctcttggaggatcacttcgaagaagcagggagcaagcagcagcagcagttcaccttcctccttctcggggtacgtcatctagctcctctactactacctatgccatgctttcatccaagtgttctctgctacctcttcctccttgcaatgtcattcatccactatcacatcttgcattggaggatcgaatcttgtcagtgaaaacaaataaggagaaatatgtggggatctctgatttggtgcaggatccttctggcgcaccggtgtccagagagaaggaagcaggggtgccgataagcaagctgccaagctgcaacaaccagccgaacagctacctagcctgcttgcgcgctgtcaagaagcagccggcgacggagcagatgccgttcagcccactggagagcaagctcaattcggcactgaacgacgtgcacctcgccgccctctcgccgaaggtcaacccaatgagccctaactacatccgtgagctcagagcttgagctcttccaacctgaagaagatcggttagatctttcgtaggtttgtcgccggtggcatttcaacggtggcaacgatgtatcatcatttatctatagtctggctctgttctgtctgtaaatttgctagctataggctggttctgcaaacctaaactctgaagtgtaaccatgttacacgagtggctgtggctagacactgcgggtcatgcgtctgtggccaacaaggtgaatatgaatatgattcgattcgtttacttctgctgtgctgctgttctgtctattgcttggtcactagtacatttctatattactccctccgtacttaaaaaaaaactccagattcatagtcctacccctcctagattcataatcgtgctacgacgtgatacatcatagtacaatgaatctggacataatctattaacagtattcgattcattgtattaggatgtgagtatgtctgtattaccattttagacctgtttgaatctcagcttgatttagcttttcaatgacatataaaacaagaaaaaccattagttcattaataattgagtattagttattacaaactttaaaaatatgtttatttgatttttcgaataaactttgataaaaaaaactttttataaaaaacatcatcatttaacacagtggcggatacagcactaaaatttagctatggcggatcatcacacaaggacgaagtgcgtggtattttaaaaatgatgtaacattttattatacacaaactataatatgttcgtacttattagaatatatgccattaacgatgattataatcctaaatttgtcatgaagtttttacaactgaagccttaaatttgttgtgtaacttttatgactaaaccacatttctacgagtgttaaatttgttgtgtaacttttatgactaaaccacatttctacgagtgttttcctgttttttaggtgtgtttatttataagtagacattcacttaagttacatatctattttttagcattcgatttttaccgattaacattttgtggttagctagactattcattcatttgtgcagacacaaggcagtccccctataggtctttaccaccagttaactaaacgaataagcttgtaccaaatgaaatacagccaactaatcatataattagcatctgaaatcaaggctgagatggtcatatgcttgaataccctacctactttgtaggtatggccggcgccatcccttgccacaagagaaggtccgccactgatttaacagtttaaaaaacgtgctaacgaaaaatgagaaatttggagtttacactaaaaaaaactacactgtgcatagtttgtgtaaattcaaaactgaaaatttaggtggagctgttcgttgttactcccaggcccataagtgagaaatgggccagggcccagggatggagtcggcccaaggcccagtagtcgtgtttggtgggcagtcgcgtgagaaaatgagaagatacaagtgcacggaggctctgacgcggcggagacacagccaagggaaaagagttcccacttcccccaccaaactccgctcggatcacccaccggcggcgaggctgcggagatggccggcggcgaggacgaagggtggaggaggagcggcatcgaggtgagcgcactgcagttcgactacgacgggcagccgccgctcttcgcgcggttcaatctccgcatcgcccccggctcacgatgcctcctcatcggcgcgaacggatcaggttaggttttgtttgcctaaccctaacccctcccatcagccgtggttcctacgtagtttcgtcgatttccactattcgatgctccgggcgagctcttctgatggattcgcgtggattggtggctttagctataatatataggctatcttcactccgcgtgtcgtttggattagaattagatatagattgatctatggttcctctattcgtattttgaagcaattcgcgtgtattactgtatttgtttgctagttgcaatacgggtttctagtgtgccctttcgaatttgaatgaccatgaatttgtgtatggtgtcacccttgatgttttggagttccgcattctgacgtttcagccttcttcaaggcaaggttgttctgcactagtgcttgagcaaagttggagctaaagcacaatctcaatggaatgcttgtagatactaaggtgaataggtgatagggggaaaaatggagttcaaacgagttatactttttattatatactcaagttgtcattgatagttgtgaggcacctatacattgctcttgcaaatgcgaataagggtgctctttatcaaaagaaattctctcctttttaaatcaatcactgcacaatcatgtacagtgcctgtaattgaggcatgttatgttcttatcttctgtaatctatcatgcacatgcacacctatataatgtaccaacttgtgccaaaccacaggcaagaccactctcttgaagattcttgcggggaaacatatggttggaggaagagatgttgtccgtgttcttaatggttctgcttttcatgacacacagcttgtgtgcaacggtgacctttcctacttaggtggttcatggagtcgggctatcggttcagctgtaagttttcctttctgtttactttctataagaaatagaaattagttcatcattgatttatatttcttcatgatcaatgtttgtacaagtgcatttcttgctaacgtgctttttccaagaaattcatggaagccattccctacttttcaccaatgttagctgaatagttatttgtaactttggttcattctgttttactttcttagattttaggggtctttgactctgaaatggtttatgtgctgtccaaaataattattagaagattcatgtttacttaattgatttttttattacatatgtgtggagtttgataacagtaaatggcatgacaatagtagactacacattgacaattcattcttgcgtttgcctggtttctcagtgcaatttatatgcatataacacccatgtaactttctcagggtgacgttcctctgcaaggcgacttctctgctgaacacatgatttttggaggtactgtatgcacaataatgctcctcatatcccattgtcattcttgggttcttatgggatgaaagcaatgatgtgcctcacatactcagtggtccttgaattatttgaaaaccctggaggtttcaatcctttctttcagttaactttctgcttgcatgtttctttcttctttttttgtttaaatagatgctgctcctagatttgttattcagtttagtcaagcttaattaatgaagtcaaccttactatagtaaaaatgcttttagcagttcatgctggtgtggtagatgtaagcatgccttttctttctctaccctgaaacatgagcagttgatggggttgatcctgttaggcgagagaagcttgttgatctactagatattgatctgcaatggcgcatgcataaagtctcagatggacaacgccgcagggtacaaatctgcatgggtcttcttcatccatacaaggtgataccgtgttcctagttttctgttgtttcttttatttcatatgtagcaccctaagagtgactcacagacataataactcttgagtgctccatcatacatttgtagtacgccatagttattggctcattgctgggctgagtgctccctgatatgataatggtattgtgcccccaaaagggtaatagcattattgcctagactattctgagaattcacccaacacatcattttagtttaaagatagaaaaactaccttatgtttggctagaggtattctcatggttaaatttgtgttagtgtagtgccaaagactgctatgaaactatgacacctgagatcaatacaggtactcttgcttgatgaaatcaccgttgatcttgatgttgtgactagaatggatctccttgacttctttaaggaagagtgtgaacaggtacagtttttgttctttctatctcttctgtctgttatgcttctcattgcataacatggaaggtttcggcactgcagagagaagcaaccattgtctatgccactcatatatttgatggattggaatcatgggctactgacattgcatacatccaagaaggtgaattgagaaaatcagcaaaatactctgacgttgaggagctaaagagtgccaaaaacttgctgtcagttgtcgagtcatggctgcgatctgagaccaaactccctaagaaagaacatccccgtcctgagacccagcccaggcgctcctctccatttgatgcttcaccgttccgatcttcacgccacatggcctactaccgttgatgattgttcccacctctacacctattctggtgctaattaatcatacttccacaatttgtttctgttctgtttctcatccctttctacggcattgtacctaatatataaataaagcgaacttacccttgtgccgatgagcagtgagtacccatcaagttcatttctgtacttctttctgataatctaatactacatgaattcagtccctgtcattctttagaaaggcttgatgtacattaagaaatggccccatttatcacgagaaagtaatgtgtacctgtcttctcaagtactagcaacttcactgcttatatgaatatataaaacagcttaggaggcttgtacgagctgatcaggtatggtaaccttttctcctttgctatctggtcaactttggctaccagctattgctttaattgttgctttcctttgcatgtagtattgcattacattacatgtgcactcctggaaggaagccgcatgataagcatcaacttgtggaggatgacaggatgcggtatctctggctgtgacccattgctcggtctcttgccacttgccaggttctcaggtttgcacattcttatttgttaatctaatccgtaatgtgttccagatgatcatttggacactatgcagtcagtaggcaggcattgtcttttatcaacatgcttatgttggcaatcatgtctgatccccgtatagctaactgctctcaggccatgctgtctagtagtgtctaccattgactcattagtgataatcatcactgggttggtaatcaaacctgtgcagacaattccagcatatgcaccagcatttctgaattttctgtgaccctgtacttacgtactaagctcgtgtacagatagatgcattctcccctcgctggttaactcgaaactattaatacgtgatgcctgcttgagtcgagtacatgagccgtacgggattttgcaaggattgaatctatataaagttcagaagttacctaattccaacgtgggacttaatatttctggagtttgagctccgtggtacacagacctgttccaagttcaaacttcaattccctggtcgtcggaccaggtaacccacgtttagtgaattttttttcagaagatggatagattcatttgtgcatcgataactgaggcttgttaattactccatgtcaaagtatctgattatatatttttatcaaagcgtcacgaggaaaatatgtttggaatcgttggcgtgtgacttgtttcgtttcggtaaaaaagaaaaaaaaaggcgacgagaagaacgagtttggcatggaagggaagcaaccgtgaaaatgccgtactccgccatacgatcgccgcgtccgtcagcggtcaactgtcgcgcagcaccgtccattccaaagaggccagtaggcggatggacggcccagatcagccgtactccacccaggcgccagctttgctcctccacgtccgtaacctgtcgctatctcagccgtcggacacggaggatcaacggccgagatgggccgctatccgcgtagttattcccgtgcggagtcgctggggggaaaggggggggggggggggggccaagacgtgtcggcctctacctaccgtagcggggcccaccacgagacagcgttttatccggtaaaaaggctgggaaaaaaagatacactgctctgctacttgcaacattggcctccctcttctctctcttttattttttttcctttttcaagtcgctttttataaaattggccatctttaattattggccacgtcatttcggctggttttcctgtctagtcagggtcgagggctcgatggacggtagcattatccgcacgcaaaatgcccctaagctatctcaacttttgtgtttatgggaagtggaaaagatgtgggattctttttcagcacgatgtgaattgggaacagcctttgtggtactacttccttttaaaatagaaaaatttaggttgttttaagaaatattttttaatcgtctcgttagttcaaatttgaattttgtattctcttctcaagcttctgattagtttgaaatacttatattttaatgttctataaatgctaaatattttggtacaaagtttaaattctcaaaataattatattttaaaacagagtaaa

SEQ ID NO: 28494 - DNA, 741 bp, Oryza sativa
agaaaagaagaaggaaaagaaaagagcaacaaaccaagatggccgcacctgtcaattacttgtaaaaacgaaaaaaaaaaacaaacaacctgctcccagttaatcagtttctttaatcgggtggtgtctatttactaatcgtcccctctccttcactctttttctcttgctggtctccgtcttcgtcttctcctcctccaccctctctctctctctctctctctctctctctcctcccctttgttccgccgcttcccctctctctctacctctcgcggcgaattcgccgagagggcgcagggaattttattaggagaaatcccctttttgtatccgtttctccggatccgcacacctcctgttaatccgccgattcttctttgatttgttcatattcgttttttttatttttttccctttgtttgcctttttattcgttcgattgtggggggagggaagagtttggtcgaccggatttcttggtggtttgcctggatctggcgtcctagaggccctcgtgcccgaatcccgattcgattcgcctcggcgcggcgccgctcgcctcgacgggtttggatctcggggtgggattagaggggaaagggggggggggggcagttgattcgtttggttgagaccatcggagcagcaaggagatggatcatgtagtcgggggcaagttcaagcttggaaagaagatcgggagtggatccttcggggagctcttccttggtcagtagt

SEQ ID NO: 28495 - DNA, 61216 bp, Oryza sativa
  unsure (1)..(61216): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctgagtaaatcaccaatgctgggttcaatgaatgcatctttggtatgttgtgccaacccaagcaataataggccaaggaattcagatatatcgaggcaacaaaaagatggcctgctttttgggaaaaaaaaagctttaccaagaaatatatatgactgtgagaacatttatgattttgattgttatatagtgttctccaaaggtggtccagccatctctgtcctctggggcaagcaattcacgcccgctggcaacatcaactccagggataaggtagaagattgtagagctatttgaaatgatccaggcacaactgtgagcgaggtcaacatccggagcacaaaaggcctgaacctacagaagatcagtgggagaggggcagtgttgatccaatccttaatttgctaaggaaacactcatggaactcaaaaggaagatcaacgatgggaaagaactgagttctgatgaaacgtggagaggcaatgattctgggaattaacagaactcaaggatctttggtgtgaaaaatgacatttaggaagagcgaacgtcctactgcatacaaggccaactccaaattgcaggcgaaggtctcttgttcgtggagtgaggttccagcctgttgttaccaatggcgatatgcagttgcagatgccaagtctatcacagatagcatggttgataatgacaagtctgtcgcagatagcatgattgattattgcaatggttgattgacaatggcaatgattgaaaatcacagatagcatggttgatgctgatctaaaaggtaagatatcaccaggcatgtttttccatacgaaatatgaccagaaaacatgtctttggatgactttggcattattccagatgatgattaatctgattcttcggatactaaaccttacgatggaactttctgatgttactggtagcaatgtatctcatgataagatcatggaattttcttgtgcagaagctctgatataaataagctctttcaaggttctggagctaagagaacttgcgaaatcttgaggaatcaagggctattaaaaaacgagtaaaaataaattggttgaactgttgagcaacatggtctgcttctgatccattaacgacagagtctgaccttgtatttgagccattctgctcaactatgtcctggacatgtgtgccacgtttgttttgtcaataccaatccatttagatagattaacaatgtaaattagtaagtttaacaactttacgctgttctgtgttgatcatgtgcagacctacttttttctaccaatttaagcttcttaatgaaacagctgcatttcttgtcttccctctactgtagtgctgttgacccttgattgcattgttttacttggcgaacttgtaaagctagctctattaacctgggaggtcctgcttacattgttctgatctgttggtgctctatctgtcaggtttgcgccattttctttaccaatacaaaaagatatatgaatggtatcgcctaatattctttttctataatgcaggcaaataaaggtgtatctatacagttctgttattgactgcggctgcagctttgctcgtgaagcgaagaatgaaagcggcccagtggattgcagacggcagaattcctggctgcattattgttcggcctctgtcttctcgtccagtccaagagctttgcttgtgtgttgcatcctgctgctaatcaatctctcgtgatccacgcacgcggcgtctcttggccgtggccggggccctcccctcttgatttctgggagccgtcagatctgagcgattggacggttagttcccccgtctcacgtgcctctgcccctgctgtcctcctcccctggccctctttgcctgcctgtatattgtctgttggaaccctgattaaagctgcatcccctcgttcgttttgatacgattgcagatcagtactagcaacaaatttccagtcgcgactctttcagaaaaagaaaaaggattcagtcatcaatcactagagagaagtaaaaagaaaaaataaaggtaatcctctactcctctcctctcgaacttgtgtagaactactttctttgtctggtcgcctcacttttgcagccactcgatcagcatgcatacctatataacttttatgcatagcttgctttctttcttttgctttccgtcatcactagtaattaattaaacttctagtaattcttttttttgcgcaaattcatggccttccaaaggaaggcctaattaaatagattgttaattagggctgttttggtttgatgccaaaattttccctaccaaatagttggcactttaaatagtaccttgtagatatttggtttgatgccaaaatttaccaacggtaatataattcctataaaccaactttaccaaaatattggtagtgccaaatattatccatgatttagcactactaatgatttggtagggcatcaaaccaaatgagcccttaataaacatgaatactgatcatatgcacatgccgtaggcacgagtcacacgattagaagtctagaacagaagcaagatacaaatgtaggtgcatggctgttggcatgtactccgtagggatagtagaagcgcagctggtccatgtatatgcatggagatgaagaagtgaactgttcgaactcggcttggaagttggaattaaagcacgacgaggccaggctagcaagctagcttctagctgggttactggaacccggccaatactgttcgtataggtcagtgccagtgcacgagtcagccatgctgccatggcgtcgtcgtcgcatgccaatggcttgcatgcatacagacagttcaaaactgaggatgaccagtccacatcatacagcgcccgtgcatatatatgtacgtggaccttagaccatacacatggagtttgtgaatttttggtgagcttatttcctgcttacatcacactttgcacatgtgacggagagagataacatgaaaatataagagctggctatcatgcaagagctatcttagcatgtgctcttagaaaaacaaattaaatagatatgtgagattaagacaaaatggtaaagtgtgtatacaccttgtagctccaaaaagttaagtagatatcataggtatattttaatattataaagacaaaatggtaaagtgagtggattatagctatatatgtgattacatatagctactagttgatatatcgatttactatatctatttcatattataagtcactttgattttttctaagttaaatttatttagttttgactaaatttatagaaaaatatgacaatattttcaacataaaacataacaactatcaaaatatattcatttttagatttaataaaattaatttggtgctacaaatgttgctgtatttttctataaatttggttaaatttttaagaagtttgactttagaaaagtcaaagagatttataatacagaaggtagggagtattaaacttgttccaaaatgttgtgccatgctcataatcttctcccatcctaacgagcatgctctcttcttctgttagttgctagattataattttagaatcagggcttagaactcgatcatgtagtagattgcgactcataaaataggatgcaatcataatgtttgtggaagtaagtattgatatatcataacaaacgacatgcatgttttcattccgggagcacacacacatgcacgtcctacgatatgtagtcacgtgtagtttttacatgcaatccaagctagaaagttccaaacattgtactgtgagatggtaaaactgaacaagattgacggccggtgtggatcgaacaggaaaagaagctagaagatggggagggcgtctatctgggagctgaggtcgccgtcaagattccactatcagtggatgtagaaatacacaggtacgtacgctgtacctatcgatctctttctcaagctaggacaaaagcttagctagctagctagttgcattactactggaatgcatatagatgagatgtgcaggtgcagctggctagtcccacgttgcgtgcatcgtatgcagggagcaaccagtccatgtacagggccgctccctcgttgctgaccggcggccggcatgccggattcccggccgctgccttaatcctgggccccgccggccggcgtatcgccggtggggcacccggccgcgcgcccgcgtgccttcccccacatacaccgaccgaccatcaccggtgtgtgtgcatgcatggccccggcctcggccccgatgtacatatgtaagcatatactccattctctaaatgttttacgccgttaacttttctaaacatatttgtccgtttgtcttattcaaaaacttttataaaatatgtaaaactatatatatacataaaagtatatttaaccatgaatcaaataattaataattatttaaatttttaaataagacaaacggtcaaatatgtttaaaaaagtcaatagcgtcaaatatttagggacggatggagggagtatgtgctagctagtacagtgtttgcacgcattgcatgcttagttaatgtgcatatttgatcatggtctcgaccaaaaccacggccttttgaccgccctagctatatatgagcatgtagcatataaaccatcatatcatgcccgcctgtctcgatcgatcgatcgagcgatctagtagtagtggcagtatagtatgtgtgtcgttcgatctagtgatgagatagaccgtgcaattgctgtcaagtcatgagaatcagaatctgaatcagagatggtgctgttgcatgccatgaaccaggcagcagcagctgcacatatgcagtgctgctagctaagcttagctagctgatcgctgtacgtacatgtgtccacacagtgtcaatcagctggcccttctgcctaccttatgtgtgcctgactgcctctcggtcctcgggcatgcagtaacgtagtaccagaggcgtacagctccctcgttttcgtcgttgcagcggcagcgatgaggggggcagcgtacttgcatatattcaccaatgtgcataggttctgagggtactttaccctgctcccagcccacggaacgacgattgggaagcctactttgtactagcgcactgcgccccatttccatgtagccatagagatttattgtatgtagttgatgggtgctggtcaatgtgcccagggcataaactgtagatgcacatatacaatcctccttctttccgcaccatatgcatgcatttgtgctatagctaggagtactaattaatattatcaccaattagaagcctccatctaacccatcacacacaaaatgcagccaagaaccagctagctgttactgttaatatatagacatgcagtgttgcatgcatgcaatacaatgcaaatgcagatcgatcgagaaaatgcgcatgcagtgcacaggattcgtggtgatcacaatatacaggagcagtacatgttagatcacggttcagtgtgcccaagctttacttcaggcaatgcaccagccaaaactccaaaattttgcgaatgaccattggttcgtatgcttgcagatgatgcatgatatagctagctagcaagaccacacacagcaggcaagggtaactagcaaccccctttagtctacagtcttcttctcagtctcgcactttagctgccttcctttatttggacagacattctatggctcccctaactccactgctcatttatcatcatcctctcctcgatccctctgcatgcccatgttcatcttatagctagctagcagccaccgatccatgtgtatgctcatccatctaatttctagttagttcctcatttctatgtcattttcgtatgcccaaaacatatattctaataataattttggcaaagttaacttattttgactatacagattctagaacgacacttatttgtgaacgaattgaagggagctagcagttggcatctagtttagacttaaaaaatttcccgttaaaatttttgccatagtcacatggtcgtaggagtgaaaactgatcggatattatctgatccgctctgaatttgatcggatatggtataggtttttagaaatctagtgaatatggatgcggttgcggatatgatatctctaaaatcctacggacgtggattgtccaacatttctgctagattatccgataggtcgtttcccggataattcgaaattattaacccatataaccactctatctgttgcatataacatgagatggcgcatctaatggcctaatttaccaattaacctaaatttcttagtttgaggctttcaccatctatatcacacttgtttagttgtatttttatattatgaatatcatgtattcatattgtttggtacttaagtacataattattaagatgggtcgttcattgattattgcattgttgtcccttgcattactaactcgatggtgtattttttgcatacacacataacatccgataaatttaatctgtttccaaaccgagtccacaccaactccgcaccattttggacatccgaaacaatcagctctgcatccgcatccactccaaattcgcttaaaaaatgctttaggatttggtatgaccactatccatccgaatctgttccgttttcacccgtacaaggtcgtgtactaatgtagcatgcattatgcagatttggttgtcccatgatggtgtgttacaaatagcttttattaatattaattctatagatatatgtagctgaaaactaaattttaacccaacactttcttttaagaaaaaggacaaacgaaatgtacatatatcatcacctgtactgcagtccaagctacgcgagtactctctccgtcccaaaataagttaatctagtagatagtaccataaatctaaataggagaaataagttaatctatactggatatgacacattaattttactatgaatttggataacttcaaattcatagtattaaaatgtgtcacgctcgctattagattaatttattatgaccaggggtagtattgattattctctagtagcactcaggcaaattttagtacatttatgttctgaggcaaggacgagtacaatcatgatcgaccggtgcgcgcgcctctttggccgaggcgactgtcgtgcatccatgtcgatcgttctgacatttaattgtttgcccaccggccttgatagtaatcggtcagctggttatagttgagtgttggatgttgcactggagatggagagattagcaagcagtttctgtttatgagctgacgtatgcacggagatattgatggtaggtagcactacacgaaccgtccgaatcagccatatacactgattgaatgtgtgtatgtacgtacgtagtcacgtacaagcgcttgcagcctcgcatacatcatatctactcgaggtgtctacttcatccctttggatagtgatgtaggccttgtcattgtgtcaataatttgtatatggagttatatacggctctgatcggtcgagcagtcgagctgctacgtttgacaagtcaaattatgaagaaagcaaccaaagttaatacataagtataaatttaagttttaaaatttaaattttgactgtcgataagccaataagatgaggagaacctatattcgggcttaggtttattggattaaactcgtaagcaactattttttcttatatggtttatgagctggtggcttttaagccctcaagtgtaatggcgctacttaaaaaaagatttttgtatgtggtcagaattgatcttcgcaagtggctggcggaccgcatgcacgcaaatgtctgcggaaatcagcattttcgcatgcgggaggcccaactgcttggggagattcattgttgcaggccgatgagctatgtgagctggttaagtcactgaagtgttcattcttaaatgtaaatattacatttctcagctccttagcaaattcttgatatagtgtatcaaaggtcttccactaaagagcattggtggattgtcgaatcataccatatgtcttgcggttttctcgatactatctcatcaactcatcgtcattaggatttgagaacaagcgcttcatgacatctttcactggcagataccatatcaccatggtcggaatatttttctttgtatgcaccgatgaatcaaggtcgacaacctctctattagaggacccattacctgttctgtaccgactagccccacaggttaggtaactgttcaagtctacatattccttgtagtacaatacacaatgatttacacatgtatgtatcttttggacatatgagtttcttcgcttgatacgtgttagatggcaattagttaggtttaggaagcaaaacacttaagagacccaacaaaccattgaagctactatcggatcatttgtgtctggtcttcaatctgagaagttcaagcatcgaaggcaatatcgtaaaatctttctcacatcccttggattcgtcgtaaagaagatccttcgctgactaaactaacgtctcctaattatctaatcctctcgctgaacccattagcacctttggtttagcgtgacgtggcatatcccccagaccagaaagagctttaaaatcatcaatacgagtagaactgttctcgtccatctgtaaataatcatcaatatgatgaatgaattcttcgcatctcgtacatccatgtctgatccatctgtaaataatcacgacacgaataaaattaaactataggtgttttccaccaaaacatgaaaaatacacgcatctcctcgaaaataatgcaccattacattgaactagcatgaaaactagtgcttacaatagtaattttgctcatctaaatattctattatagttaaaatttgcaaaaatagctcataagagtcgtcttctaaaactgcaaaattctccgcattgcaccgatgaaatattttttaaaaaaatggcggcaaatggaggaggtaaggaagtatataaccttgtatatcaatttaaagttcaaaacctcccccaccctatttgttgcttgttttgaagagataaacttttggttgaaatggggttagctcgggttgggatcaaatatatgggcatatcatcgcgggcaggactcttaagggcccgcttgcaataaccgcattatcgcaagcggccctttaagatgccctcatgtgataatgcacccattatcgcaggcgggtctcttaaggggggccctgtgataatgtgttaccacagacgggccttaaactaccccgataaagtgatttttacatgcggaggcagttacggcctgtctgtagcctggaaagggcattgtccgcaaaaatcaaatctatagcattgtggtggtgtcacttttccactttatacaagcgaaaaaaaagttactccaacttagttttagcttaacagtataagggtgacttgtgcctttataaaagctaaacgaaaaatttgcctatttatttaggtttggacttttttcttataagttaccttgtaatatatcgtgcctgaaaaaaaagagggcagctagggacaaagctagctagtagcaagctcgagaggtggtgaacagagaagaattcaatcccctttgtaatagtttgaatcttaatggttggagttgtatgtatactatttatgtaccaaaacgcgtgtatgggtaaggtagtaagaaatataggattgagacgaacgttgcccatgcttgctctcgatcgatcactttctctttctttctagagcagctatgtgcaagttgtagtatcacattatcttgtccatctctacccatctagcttaaatattgccactctcgaattctcatcagtagccaatagccggtcgatgggaactaatgattttcctcagcgatctgcagggctttttgactgattaggacgtgtcgtcgccgtcgttgcactgcgttatcgatcgattgatcatccgagcatctcgcgctcgcgggcccctcgtgcgggcgcaacagtgccatcgattgctccctctcatggctgcataagaattgcagtgaagtacactacccatcctaaaatataaggatttctgagttttataagtaattataaaagtagataaaattaaattaattatgcttagacggttagattaagatgagagatgattacgatcgtttgtaatgaaaaggtagatggagaagttgctatatcatggaacaaattttagacaatacaaattgctattttttaggatggagggaaaagtcatttttctgtatattattgtttggttctgcgtcttccacccatgattaatttgatcgatggcgacgctctgaaaatgacattaatatacaatcgatcagttccttaccgtaatatgctacatgctcgcttttttacttcaaaaggtgaatcatgtgtgtgcaccaggacttataggtcaaaagtagatccaacaaacaaacagttcaccaatagtattacgctccacattcatagaaactagcgatctgtattttatggatctgaggaagagaagagaaaaaaggcgaacttcgttggagggggagtatcgaaaatccgatggtccttgagggaggcagcaacatgagattgtgatatgttggcggcggcgtaccgcaagctatggcatagtaggaggcgacgaaatagaagcgggaggtatagtgaggcataaggcagagggaagtgtcggatttcggcattccttgaggtggtagcgatggggatcacggtagtagcacatcgtcccgaaatctcatagggcctgggaggtggcgtgcggcagtgacggacgtggtagtggtgggacgaacgttgtgctgtccgccagccgcactttgctaccggtcgccgctcgacactggccaccaagtcttccactcactttttggtagtagcggtgggtgtaggtggttgttaccgttgcagttgtgttgtctttcaagtactaatatcggtgacgcctatgggagtcacaccttcctataagcgttgccgcgatgcccttcccggtggacatccatgctatgcgatgaactgtcccggtggagatgatgttctagatgtctgaaatagcgatggtgatatttaagatgtcgcaaccttcttgaagtcatagcattggaggtttcttgttagtgtgatgtccttatgatggtgtccccgtcgattcgtatacgatggtaattgtggtggtaatctgggcggatgattgttaactactctttgatgttgacttcctctttggtttgacgttagtttgctgatagcgatgggagcgaaattcaatcaacaaatgatgttgtttttatggtttgataaagacatgaactaatacaagccgttggtagaaacaacggttatttatacttggacctttttagggtgctattgttgtttctaatcaagccataattgtaattcataattattcatcgtgtagactctataatagttggttgtaacttctatggagtaatgggaaaaaataatgctattataaaaaaaaaattacactccaccttcataacccgtattatggcatgatgtttcatagaagcatggcgatatatatgtgcatatagcagccgtaaaccctttttttttaccaaaaagcggtcctaaattttgacgattgatctgtgtaaaaggtttaacatgtagttaccgtggtttaaatgtatggtttacctgtccaacctattcaaaatctccattatatttcggacaaattagctactacacatgggtcttacagttggcaaccactaatgggcccgggtattataaatgcatatgtacattctttgaaagttcccctaaatgcttagcccctccagatgggacgagccatgcacatatgcatatgcatcatgcatagaagctaacctgaggttttgttcttgcttttttctacaaggttttgactctagaaactttatgctttgagacgtgaacgattatatggtctgcacactgcgaatgtggtgtttaaacttggagtgttatcgtttaaacgatgtgctcgaatgttgatgctatgctagtaccatttgtagtgaaacatatggcctcaaaggtcgatgcaagccaagacatgggtaggccatgaacgtcttgtgtcgtgtgccgcgctatagggccacgtacagtaaatggtgcccatttagcaagagtcgatactctgttaccacttgtaacacaccatgcgacaaccaaaaataatccacactgatcgtgtcaattgtggtacaccgcgcgacaataaaatccacacaatgtctaaacacccatgtggaacatctgtgtatgggtaaaatctcacctggattctacttatttagaagaaggagagagagagagagagagagagagtccatttttctactttaaacttttgagtctaaaaacccctcaaaatttgaaaccggatactattcaataacgtaaacaaagaaatccgtcactcccaaattcacctatattttgagtttttttgtgtcaattggcaatttaattatgtggctcaaaccgaaaaacaattttagttcaattgataacttacaagattttgcaagttttctcgtttgcaccacaaaaaacaatgtttcaaattaaacaaaataatctttagtggaataattgcaatccattcaacactatatataatttatctagcctgttgatactgctatatatatgtaacttttctttagcaatttcttgagtgcacttaataagttttataactcaaaagcattatttgaatttagaaaattaataaatggctttgaacaattctagaatttttttaaaggtggacgttgatgtatttataaaatttatcgatccacaaaatatttgtgtacttcctccgtttcatattataagactttctagcattgcccacattcatatatatgctaatgaatctagacatatatgtgtggctagattcattaatatctatataaatgttagcaatgctagaaagtcttaattataacctgaaatgaaggtagtattaaactatattttctgcattccgattgtaataaatttatccaaagttacaaatatgctgatagcagatatatttttataatttttgttaagacctctagctagggcgatcaagtagctattcttgcacggcatgaattaattagatgtttattatttctagtatttattttaagactgttcttgctagtaaatcgtgccgtactgcaattaatacatgcaatctgcaacactgattactgtcactgcatgtgatttactttccccgtcccataaaaaaccaatctaactagataaataccccgcacaatgttgcaggagaattgtgtgataatagaaggcacaaccacccttaacacaaacaccaagaaataattattatcatcttgtagtttgaatcatccgagttagagaatgtgagagtggaggatttaaaaaagtagtaatttaatggaaaatatatcatagttaatggtatgcatgcatgcatgacttatattattgaacataaaaaaaagtggttgtaccttatattatggaatggaggtagtatatatgagttctaaaattttcttccttatctactatacggtttttttcatgtgtttatctattttttatacttttatcaattattcaaatgttataaataattgggttgtatggtatgccttttgggggaaaagatgcaatttatacccttgatgaatcatccaaaggctaaaaacaattaaggtgatgtggctttatgagagaggagagaattagcattaactacacttactcgggatgaactttatagatctatataggatactggatgtgacacatcctagctagtactatgaatctagatatatctttattcagatttgtgttctagatttgttttatttgggacggagggagtaggcgccaaggtatcccaaaccactggggccggagttatcgcgccccggcggtaagcacggttaccgcgcggtaaccacggtaaccgtggcaaaccgtacgaaaccgtgtaaaatttatcaaaatttcaaattactttttaaatttatttgaatttaaggaggttaccgtggttttctttttaccgtacccccacagtaagcgtggtaaccgcggttaccggcggttttgtaaaccctggtaggcgccaatgccatatatgaattgtgtcgaattaattaattagcttgtgggtaagtagctgcatggagcattaagggggtgcttgaagaaaggattagggtttcgtaaattgcaatgagtgggatgccagatctatgatctatctcctcataggcttatatatatgtttgcaagtactagagcgccctgtactctgcgttgtgttgatttccgaaaagaaaaaaaaattaccatatgcaaactaactttcactacttgtcactgtcgtcctcctacctcagctccttctccatcgtcgctccaaacaactttaatttcaaactcttccttctgaaaaggcactgttcatgcatgctacaccccttcactctctctaaaaagttcgtgtgtttgtacatgggttgtgggcgcgtacattcatggccctactgtgccgaatcgaagagagacggtggccgttgtgaagcagccagcgacctgttcaattaatttccttgcctggtataaatttcttttatgttctgcaaccatgcacggctacacggagcctaatcattgataattcaaaatagtaatatctaatcgttcatttaaggacactgcggtaaagaaattttactatctataagagataaaaataattggtatcttatagtatctgagatacttgagagctatctatcaaaatttagatttcaaagagtgtgatacctctcagtattatccacttaacattgccacataaatgatcatccatgtcgcctcatcattgtcggttcagtgtgaaccgacagcgatagcgtatcattgtcgatccaccgtgatttatggtccaaactgatcacataatccagcagttatactgagtattattgtcggcttttatcacaaactgatagtgtttgtatcattgccagcttatgccatgaaccgatagagaaaactggttgaccaacatttgaccagagctaggagaggttaaaaatttcctaaggctccacggctgaaaacataagttgttggtagcctatcagtcgccacccaccccaccccaccccacgtcaacaaaatcccctcttcttctctcatagtttccctcttcttccttccctcctaatctgaccatggtgccaaccgcaccacgctagctctcttcctccctgtgtacctctcccttccctatatcgagccctctccccctcccccttctctccctttctctctcccaagtccaggttgaggtctatcttccctccctctcccatgtcgtaggcagctggtgtggtaagtgaggaggataggagacagctggcgaggtggggtctagatccagtgaccccgagctaggagtggccaaattcggcccacgggatggcagcggctcacgtggcatgatgacttgtaatctctgtgggatcctttgaaacaaaggttttattaaaggaattttgtagatatgaatcctttggaatattttcctatatatatgctcctttggataaatggaatggaccctttcaaattcctggaatatggccaagttcataaggattttggaggaaatctaacatgagctctaattaagctcttggaaaattaactttatgccatcctctctctaaattcatatattgtttttatatgaagtatccaaacaatacaattgagcaattccttgggatcacattggcatgccactccaattcctatattgttattattcctatgtttctcaattcctacgttttaaaggagccctcaggagctttgtacaagaccagctaccatatcgggggtccacacattttatgataactagtttcatgtcgtatatgtcctctaatagttctggatcaccccattagggattagcatgaagtacaaacccagtaacggttgcatatatcttatggaatcgttatatatcacttgatttcaaacggtttctgtgagaatcgttagagattagttgtcgaagattaattggctagctattttctagttgtgtacattctagcttagtattattgggcatgcatgtctgtactgtacatgctcaatcagtactgagcattcatatgcgcttgtctcctgcatgtatgtgctcaaagctaatttactattcgatcccccatttttttggccagatcgatgcacacaaatggactcgattctgccacaagatatgttcggctatatatctcttataaatcttttttagaataacaataagcagatctaacttatatatatgtttattggtcatatccagacaaaatataggagaaaacgtaatttttgatattggctaaactagctagtcataaattttgaaaaaaaaattgatcttttatggttaacatgcatccataacttaatttgatcactatatttttaatattatgtatcagtatactagctatcaaattataatattgagagattaattaaagcattttatgaagagtttactcctatcattttcatatagccaaacatactttctaggcaagttttggttagagcacattttgactgcacacatattgcaggcaatatataataaatttcccctgcatgtatctcatttttatttcaatacctaaacacgatatatttgcaaaaaaaagtcagatacgatatagtttctcaaataataaattttcccttgatatgtttctcattttttaatacttattaaacgctagtatttgcgggaaaaaataaaattcagatacgacatagtttcccgaattaagcagatatagataatctaggaaacaatttatacggtatatatgaaaaataattaagggcaggggcatatcatgcatgagagagagagagagagagagagagagagagagagagaggatgattcagcattcaggtggatgggaacatgcagccctgaccacaccagtcaatggtctacagcaaaacactacacctacaatacgtgtacatataagggatgcacatatataataagcatccaacaatatatttgtgcaccacataccatatttcatgtcgtctacagtagtaacataagtggcctgttcactctagctacatagtgtgcatatttttctatcagttgtgtgcccgtgcaacaccgatgcacccatccatcccatcatatgatcctatccggcggccacactgcaaatctgcaaaatgatagaatttaaaaacacaaaaaacaagttagggtcggtcaaaaatcgacaagaaaagcagcagcaggagagaaacaagaggccatcccctccagattatcctgcagtcatgtcatgcttctcccctccctgcaggcctcaaggcatggaaggaattgcaaagataatattattgctagtacatggatggaatatatacttgaaaatgaaatatatttatacaaacatcctaactttatattgttcaaactttggaattaagagagtgaaaggtaaatgggataaaacaaaaaagaaacatctttaactggtaggtgacatcaccaatagtgagacactttgtgacttcagcaatctcaagacatattagctgtaatttctggtaagtgtgtatggtgagtttgtatattacacctcccagaaagctagctataaatatgcacacacccaccatacacactttacagaaattatggctaacatgtctgaaattgccgaagtcacagagtatgtacagacgacgacgtgtgcatctgtattgtatttcgaatattaatttctctttaattaactttcctgtcattttctcaccccctgagtagctagcaccaagctgtctagccttcctataccctactaggctctactacacccatttctacctcacacacctagctagcaagtaggctctctcactccacacccacactactcctcccaggctgcctgcctaaaaggctagacctatccatctcttccccccactcctccagcatcgccatcatccactgttcatccactccatctctctctctctctctctctctctctctctccatcgatccctgcaggttcttgctgctgctgctgctgccttgcttgctgtcaagcatggcttgaccacctgagagcgaggagagcatagcgtagtacttggctagctgctgttcaattcctcatggatgattggaggatcgctagctaggtcgcccggatccacggacacctctcctcgtctcgtgctcgtgcatgccaagatcgatcgatcccagctgctgctgcgagtggagcagtggaggaggagatcggctgctacctgacctagatcgggaagcagattcatccggtacatgttatatatagatatagatcgttgcttaggttcttctcttcttgtttgatttcgtcggagcaagaaatgatgcttgcttcttgtgattcaggttgcattacggcggcgaggcgagggcgaggatggatcgtcaccatcaccaccaccaccaccaccaccatcacatgatgtcgggcggcgggcaagacccggcggcgggggacggcggcgccggcggcgccacgcaggacagcttcttcctcggcccggccgcggccgccatgttctccggcgccgggtcgtcgtcgtcgggcgcggggacgtcggcgggaggcggcggcggcgggccatcgccgtccagctcgtcgccgtcgctgagccggtacgagtcgcagaagcggcgggactggaacacgttcgggcagtacctgcggaaccaccggccgccgctgtccctgtcgcggtgcagcggcgcgcacgtgctggagttcctcaagtacatggaccagttcgggaagacgaaggtgcacacgccggtgtgccccttctacggccaccccaacccgccggcgccatgcccgtgcccgctccgccaagcctggggctccctcgacgcgctcatcggccgcctccgcgccgcctacgaggagaacggcggcacgccggagatgaaccccttcggcgcccgcgccgtccgcctctacctgcgcgaggtgcgcgagacgcaggccagggcgagggggatcagctacgagaagaagaagcgcaagaagccctcgtccgccggcgccggagccgggccctcgtccgaggggagcccgccgccacccggcggctcggccagcggcggcggcgacacgtcggcgtcgccgcagttcatcatcccgtgagttcttctcgatccccatcgccatctccgcatctccattgatcgatcgagcctcgcagcaagaaattccaatctccttggcagaaatgccatcttgctttgccagtacaaggcatcatatctcttctttcctcctgaattggtttcgatctctcccattttgcaaaaaaagatttctcctctttttaatttcatctctgtctcgctttctaagctaggacgaaggtcatgcatgagtgagtacttagtttaattcttgtttttttccttagctttgggacgtcaattaattggtagctgctgtcttcgatcgatctcgtcccgtttggtttaattattttgatgcaagaactggagtaaatttgatgagaatctcaagctagctagcctaattaggagttgtaatatttgttttagtctgggggatttgcaagaacaaaagtagcagaagctgtaggcatagcaagctagctagtgttagtatctgtagaatttgttcttgtaatagcttgtcgccaagctagccaagtgcagtggcgtcagcaatgcttccttctatctatcatgtactagtgatgatgtcttggtcttcctttcttggttgagcaaaagggcaaaaagggagagatcgactagctgatgagatgatgagtgatttcaattggtagcttaattaagacagaaacaacatgtgttatgtgtacttgtcctgggaacagattccatatatatgccaaatgctttaatttgggctatgatctgtgtgcaatgcaatgttcttgatatattcatgatcaagtgctccctttggtcatcatgtgtgtgctggtagctagactttatacaaaaatatgttgcttttgttctttgctttgaacaatgttttgttgtgtagtgccagtttttgaatggtttacagtactggatactaccttctttcacttttacaatatgtgcaaagtggtaacagatgaagaaacaaacaaaccaaacaaaagaagaaagaaagataggagtcttttcaaaaaaggagagaaaagaaggcagccaggcaccaaaaatatataaagggttcaattgggtgtgcactagtacgattgggtgatccctatttttgcccatgctttgatgcttctgattcctttccttgttcaagtttgaattgctggatttgacttgatttaatttgtcttcacttgtttattattcctgatgatgagtatatatagtagaactgacctgcacatatatatatgtttctgtaacaactcaaatgatcaatgatcagaggttttttcaaaaaaagagaaagaagggagaatgcatgttcaggtagctagcagacagcagtaaaactacaattctctttgtggttaaagttagtttaccacctttgttagaacctgatcagatcattctttttgcatgaaaactattcacttctaaagtcttttgtgtccctatcaatgcaacagtgccacacacatgttctttcacttcatctctgctgtccccatgtatatatatgtatactatatgatatggcattgctaccagcttagcaggagggcattcaagttcctgttttcacacagttgatgcatctatcactatcttagattttgcttgtcctttcaatgcatatatatgtgtagttgagaaaactttttctttcatatatatatggaacagacaaattaaagtcgactgttctatgtattgcttctatttaatttattcgacaactttgcgtgcaactcaatctgcttctcttttttgggggattcaaaagaatttttagcacatggccggcttcaatctttatgtgagtgatatgtctgattgatatatatgtactgactgactctctgtagccacagcttgcttgattgtggttgcataccttgcatgcatgcgtgatgagtttttctacctaattgagctagtatatatactgtatattgattaggtatcacagtatcgtcagtgttttatttgacccctaggcctcctttggaatacgacaattactaaatttccttcgttgcattgcctatatatatgtgcgctccacttagtttgatcaatacatttttatgagtgcttatattcatgaaaacaagccacaatattggctctaattttatacatttggtttctgcaaaggtgtataaaaatatgttttagcttatatatgtgtgtgataaaatttatgctcttttaatgcaatatgattgttttttgtttctttgattccaaatatataggtaataacaaatactaaacattgtgttgtctaaatgcaaatatagttatccacataatgtctattgaaaaaaataatatcaatatcaatggtaaacagttactcaccataaaacaccatattaggtgtgtgtttttcatcattgtttattttcttaagcttaattttatgttttttcattatattctattttccagcatttgcccttaaaccgctcatagatatgaaaacttgtccatgaattttttttcttacttcatttattttttttcgtgatttatcagccatatagctcaaacaatcataacccatttaactatagcaacaataaatgttaaaaaaatatgttgattacatgcacctttaattttatcccaaaactgcattatacatcacaaaaaccattcatgtaggtttcctgaaaataaaagggggcactcatgcttttatctatccatggttttcttaattttcagcagctaacaacccatagaattatgtcaaatttcttaactaaacataagcatggacacttcctcccaacatagtgtcttaaaaaatgtcaatcaacaagacatctaatacatttattataaattagaaaattatttcgttcattttttttgctacaagtcaagtaatcaactaatttaatacaacacttgatagataaaggtggtatttaaatgtaaaggctagtttaatttcacactttcgacacgcatcacactcacaacacgtatggatgtttttttaccgtcattttgggaggtattgagagatagatgtttatcatagctagcgttaatcatgacgtacacaccaggattaattatcacaaaagaactatatatatgacataaaagacatgttatccatgcatagattagcatccacaaataaatttagcagatcatggcgatggaacattttcttaattgtagtttagattgttgttgctgaaactccttggattaatgcatgggaacctgatcaacgacaagtgttttgttgtccctcaattaaattccttactatgcctccatgaacttcttgatcaattaatcatctcggtataccttgttgtaactagtatagggtttaaagcgatctttagtcctcccttggatgcatgtatgcttaattttggcctttaattcccatatcttctgttgaagtgaatattggccatggcacatctcttgtccacattattatagaaaatgaaatataagaatagatctaatacaagcatatatatccatgtgcatgaattgtacatgaaaaatgaaggtacctgaaacctctactagtcattctagttattcatatcttatattttgcggggtatatatatatatacacacacacgatcgatgctgaccaaattaacacacaccttggagcaattaacagggatttattcttacattgcatatagcgatagagctatatatgcattatactactttggcttctacttcaaataagacggacaataatcaaacgttggatacagatacacacagctgcgtttaaaatgggaggcagggagtagaagtatttaagcatggggatctgttcattgaaagaagtagatagaaactggaacgggtgggcgccaaaatttggcgaaacaaattcccccctaataaatgaaaaatccctggctcgcgttctattggttcatgttgcctgctctactgatactactttgcatgtacccatgattgacgaagagtacgtctagctagtgcagggccgaagaggctactgaaattaaggtggcccaatcgcacagaagaacaaactcgcacgtacgctgatgtgtcgtaatctgagaggagaaatgtatatctagcagcagcagcagcaactcagtttgcaggctcctttgcagcttctgatgcatgcagctgagactgataggtgagaggcatcaactagggacgagtttagtttcaaattttttcttcaaactttcaacttttccatcacatcaaaacttgtctatacacacaaatttccaacttttccgtcacatcgttccaatttcaacaaaacttttaattttgacgtgtgaacgaaacacaccctagctctgaatcgctctgatcagcaatgcgaaggaggaagaagaagaagaagaaagagagtgtagaaaaaatactactacactgctagctagctgctgctcgatcgatcgtagaaaactccatgagagtaatcgtccatggatcagaaaaatttagccgcgggatagatctgtggcgtttgtgtccaggacaaagggccactgttggcgatgtcattcaattcatttccaccgtactgtacctaccccgctctcccttcatttactccgatcctaacgtacagtatactgcagtcgtgtatgtgtactccactacgggaacacggcttaattttacccacacgcagtgtaccaaagtgcaccgtacgtatttcatcaatcttactactatattggttcagtgctttagtttagggcaatcacaattaatttttgttcttcattcgtcatcactgctttgtacgtaccaggtacgtacttctggtatctaggagtttcggtttagaaaatgtcaagatatgtactatgtttaacacatgcatggtagactatatagtacatacgtcctcgttccaaaatatagaaaaaataggatttaaatcttatgctataatacaaggatttttagcactattcacagtattacttttcccatcaatcatttaccattaaaatttctttccatcttaccccctaactaacctcccaccgctattcgttacaaatttattgagatacatcgaagcctttcttttcttaaccttaatatctactaaataatctagaaatgcttcttgggggagtatcttcacccttctcagcgtaggtgccctagcctaccaaccagaggggactctgaaggaggcccggttgaggccttggtaaggcctccaggaaggacctagtctagaatggcaccatcctcgaggtggctccggcaaaatgcgacttcacgaagcatctatgacgagaagacgggccatttagggtgcattcaatgaacccaaccatcaatgacgtatccgcggcgagagcaagcaggaatgccgaggcgcctcgatagcgtgcctcggcctcgagctgtctatcccgagattcgtcggaaccccgtgatggggggtttaatggaggcagcccctttctggtcgcctagagttttaccttcttgctctcgaggccaagcctgccagccagcctccacgtagtgggcggaggccaaagggccccttcgtaacttcccatataatctctagggatatataattgtaattcgctcctcgaaagagggcaatggagacaacgatagagaaatcgcgttgtttccttggtagactctcaatccctgttggattttattccaacaatgcttacagtttggatcggatagagcaaaacatttctgacttagttaaaatgctcatggttgaccttagaaggtcttttcggttgtgttgctgtagcttgccttctacgacaagtgccaagtagctagacacagggtagaccagaatgagacagaagacccgtgtgacagcaacaaaagaattattattgtggccctgtttttccagctaccagattattgtcatggattatttgctccgttccttccataatatatttttttagagaaaaatctttattctaatgcattacctagatatcttgttatggactattaatttcaaaatatttaatttatgtcaaaaaagtgtaactataattcactgcaataataacatggttaataattcgttttaaactactaggccttatagcgtttcaccaaatcgttttcgtttcttccaaagatctgcgtggtacaaccgtacaaagcaaccctagtagtcaatttggtcaggaggagcagcagcagcagaagctggaccagtgggctgcaccggtgacttggtgagcagtgctgctgctgattcaggccagggaacagatctgcctgcgtggggcctacatctacagtaatcatatgccattttgggccgggatcaatccgtcaggcaggccggccgttcgattggttcgtttagcgaagagttgaatccagacggcccataatctgttgcatgggcctagcaaaattgaagttagagctaagcccaggcccacagtcagatgaatagccaagcccattagtgagattccctgtgatcctgccatactgggccatacttttcggcttttcctttggcccaacttaagaggcaggcccacggtcaatcagtcactccagctggttaggtgatcttactggaaaaacgtaattaaccactgtagtaagaaaagtattcctaccagctggtcaaaaaaggtaaaaagtaggctgacatgcaagcaaagcatatgcatattgcatggagtacatgggcatgcaaggttgggcggtggtcaagccaacaaaagctggccgcttttgctaacactgacttggacccatccatatgccaggctgcttgctgcctgcctagcttcaacccttcaagcatgctgcaccacacagcagatcgatcgccgatatatgccgcattgtcgcgatggatggctaaaaaaaaagggttggaaggagagatgcccggccctccgaacattttcaaagaagaaattacgaacgggttaagaattaaacacgaaacctcaagattaaaatcatacaccccatgtccccatatcactgtattatcaagcgtaacatcgataatataacctagagctgatcaaaccggtaatacgaagtactataactacaacagtccatgaattggacaacgcttgccaccagcaagagattagaaaaaagagtccattctctcatctctatcctatttacggtatgaaaaatttagaagaaaagaaatcatatatagtgttagaaaacttgcaacgaatttttagcagcgaaagttaaggaggatgctaattaaaacctgagccctagcaaaagcaaaattactctcaaaacttatcctttagctttgtttatcttatttttctctggtatatttaacaatattttggtgcactttagatactgggttgttaaaaacaaaagaaagcaaaaatgtaacactatatttgccatgccatccccccatgcatgtatggaaaaaactctacgatcgagtgcagcgtacgtttgatcgcggctgtgtaagcttagaagcgaactaaacgttttgtttgtttttcctctgaaaatgggtaagccgaagagcagtgaagcaaactataattaacaccaaatgataacacactagatttgttgccgatcgatcgagattcgagcgtcagatcctttgcttggtttggcaaccaaaatcatatctttggcttagatttattctttctgcttctgtccaaacgcctagcaacgactacgctgcttaattaaattacgtgcagcgagacgcaacaaattgggacatgtgtcacttttatactcagtactgtaggtacacatgaacagtaccttctagttaaacaaatcttgatcccgacaggaacagtgagcaaagtactacatttatattagggtgacatgctaattaacaacagggctttgcaaggtcccaatcctcttgttctggcttagcattactgtatatattttgctattaattattattttttcgccgggctggtattaattattctctctgattttagataatatagatgataccgttgactttaaataagtttgattattggtattattcaaatacgcaaaacgtttgaccattcatctcgttaaaaagttttgtataaatatgtaaaaatataaatcgtagttaagaacctttagtgataaattaaacaagtactcacagaaaaataaatattaatcaagtaaaaagattaaaaagaagaatcctcaaatgtatatcaaaattgattgcgtcattcattaaaaaccgatagtacgtccaaactcgatctttctatcagtacaaaattttctatcagtataaattaaaatgctccaaaggatctcagcaaaagttagatagcttttgtatggccgccatctgtataggagcaatagcttaattaattaattactacctagttaaacctaccttttatatagatcatatcacgttacgtagtcagtgtgctagttcggtactactatccaattaaggcactgctcatcagtctaccacacctatggtgattcaacatataataaaactaaactagctttatcatattaaactacattgcttcataatttatatgtaaactacaactacggtatgaaggattgatggtaactaattaagccaggtagcatcgatcaagtagaaattaaaactgtcgacacagatcagaatgacgtagttacgtgtaaacagcagctatccacacaccaacttgttttccagcagctagctagctagctagaattcatcctcatcctcagcatgcatatacatacgcatgcataccggccaaattcaatctggccagaacttgattttaacggtaaatagtatagtaattaacatatataagaaagctatcccaaactagtgaagctttagcaatgggcaaaataattaagcaacaggggatgacacatgcatatggcctgatctgcatgcatgcacctactgcatgctggacattctgtcggcatttttgtattactatgctaatttaataatttatatggaactatggaagggattgaatacttaattacaaattaactcatcactgcaatatagtataagtacactatatatatccagtgtgctcagattagttgcttctaatcaaacatctcggttaattgttatattgaaaggacacttgcgctatagctaatacattcggaacagcatgtacctaggctgataaactaattaattagctagctagctaggtcatgcatgcatacacacatatatatacatggtcgatcattagagcttgcaattgtcaattaagctagaagcaagcaagttggggataaataattaatcatcaagtaaacgcggtatattagtcggtccattagctgcatgttttaattactttacaatatcgtctctgatggaattagttaggtaaatattaacaatatatgcacatgccatttgaatatatatacatgtatgcatcacgtactcgatatagctcatgtacgtattgtacgtaataacactgtgtacgcattttcaagctagatagcaaattctcttttagtttccttcgtggattaattttctcttctactttaggtcaacatatttgccacacttttggaattgatcgtcaaggacctttttatccactttggataacaggattctaatacagttcatacttatgcttttgtacttaacgtaatatttatatatatacataatttatatgctcctactttgtacattttttttatctcatggccggggacgggttttatttcttactgagattattttttttaactcaaactagctttatggttgtgtgtatcctacattcaaagatagaggatataactatatcttccttatcttaaaatggtcaaggggatcccatgttatatatctatcagttagaggccacgtaaccgaccaaactttgctgctgttaatttagtaaccggatgacgtaaccaatcgacacagccaatgatcagcaagacagcaactaatctgcaattagtattagattagctatgctctgcgtgtcttgcgtatactgtttgtgtaatatatcatttagaaatgatatgtggtcatgtccatagataatttgttctttcttaagtgcatgcgaccagatttcgatcaacagtacaggtctgcatgcatgaactcgtcacatgcacacagcaaattggttgctgcagagacgacaaattaaattgaaccgaacaaatcgatattgcaatccacccgttttgctaattaaacacacatatatattgcaatccatccgatatatccatatctcaaaaccaatcagtttacaatcatgcacagagtcaacatcaggaccagtacttctgattgtgaataaacataaagctgcacactcttcatgatgcatatatgcctcaagaagattccataaagatcagtggtctaattattccttgatgaaaaacaaatgttttttttctgatgcatacatgtatgcttgcattagtatagtgtgtggtcctacccaatctatacatgatatatatgtaagaaattaagcagcaaacgatcaatgtgtaggggaacacacatgcatgatcgttcagaaaaaaaaagttagtagtggtcctgcctgctctagatgctatgctatttattatgaccatagaaattaagctagcagaagcactgtttgacatgcaattaatcaatttgcatgtacttaattttcagtgcacaatgcacaattaggcagcatctgatggatgatgagatccctgtgcccttagcttagctaactgccaaaacaagcattcagaaagcgtggtgatggatggacgttgcgagataggggccccggcgccgatggaggacaagacatcagatcatatcacagaaattaacgagaaagagaacaaacgaacctagacgacaatggccggcttgggtcgttgtgtgtgcttcgttcagtactactgttgtgtgacatacaagaggcagcctgcacccacatgcatgcagcagcaagactgatatgattctcctgacttagcagcttgcatactgttgctccttcgatgattgttgtttattttctttatcagcttaagcttttaagttgaattagttagtgtacgtaactcaatatgttagcgagaccgaaaatctgaagttcaaatcatgtcagatgcacaattaaatcaataattgtagctcatttctatttcagtctcgtctcgaggtttgagggaacctcgcgtagaggtgagtgttggcatataagccggttgaagtaatgaataggttgtgtttgttcacatgatattgagaggagaagatttacctcatacattttcttttccgaactaataaatgatgtgttgttcttaaaaactttcaatagaaatgttgctttaaaaatcatattaatccatttttaaaattaaaataattaactatttaattaattatacgctaatatggttcatcttattttgtgtatcttctcaatcttccacttttccctcctctcaactccttcctaacagtgtttaattaccttgctggggttgtcagtcaattgtgggttagatcctatattaatggccactgcatatttacagcagtatgttgggcaaattgttgatgattctacaattacgtgtataaaactagctggctctcttatgtaggatggttaagttcctctgttaatttgtgtggatcagttagttaagtttgaaaattccacacagatacagcaatgaactaaaactagctctcttatgtactaggatatataattaactaaaaccaggtagctaatattaactacctgcagctgttaatttgtatggatcagttagtgaagtttgaagcttccacactgatacagactgaaagatacagcaaaggactagaaaaagggttccaaattaagtactccattaatatatccacccatcaacagaaactgatcattcatacattatatgtacacatgcatgacgacgtctgctactactgcaatctcaatcaaattaaaggctaagatatataatttacctccaaacaatgcaacagcgctatacgacgtaccactataccctatacacaggtgcgcatgtttgcatgcacaatcaacgaaatctgcacaagctgatcgatggaatcgatcaccacgaaacaaatcagatcaaacaatcgaggtgaaaagaggttattaataataaacgctagctagctgcgctgcagaactgcagctagctagcagctgggagtgtgtgtaagctagctaagctagcactagcagcaccgacacctatggtggatcgtcacatcggcatcaggccgttgtaattgtagtgctcctcgagccctagctccatcagaccgcactgctcgccgccgtcgaccctcgatcccgccgccgacgccgacgccgccacggcgccgccgtcgagatgctggctgaagtcgaagatgctgctgtacagcgccatgctggtggtggggatgaactcgttgagggagccgccgccgccgccggtgacgggcatgtggtggtggtggtggtgatcgggaggcggcggtgggtggctgctgtagtggtggctgctgctgcaggcggcgagcgacgccgggaatggcgggggcgagtgatggccggcggcggctgggtcgtgagacgaggaggagttggagtagcatccacccgccttgatggccgcggcgctccgtgccatggcgatcaccgcctcctgctcgttctccatgctgtacgacgactccgtctccgtctccgccttcttcttgtagaacactctgcacaacacccaatcctcctgcatacacatatgcaaaattaaacacacaaactcaagctcttgattaaccaaaagttactactatactccttcaggttataacacgttttaactctaataaagtcaaactatttcaagtttaactaattttatagataaatatagtaatatttatgatactaaattagtttatcaaatcaataattgaattaattttcttaataaatttgtcatgggttaaaaatattattattttttctacaaacttggttaaacttaaaacagtttgactaaacaggtcttaccataacccgtgctggattttatttatttgaggatgaaaggagtaaggaaattattggagaaattagttggattgtgaggactaaccttgggaggggtgtgagggttttccatgcgaaattcgtgcatgacccagttggttttgacgccgttgggggcgcggccgcggtagaagacaagggtcttgcgcatgccgacgatggaggcgcggcggtgggcggcggcgtgcagcttggggttgtggatgacgcggtccttgccggtggccttccagtagccggacttggtggcgcggttcgtgcggagccccgtcgcgtacttgcggtcgcggaagctgaagaagtaccactcgttcgtgctcagcttcgccacatctgcatgcacaccataattaatttttcacatcacaactcgattaatctagactaatctgagatcaaccgtaatatattcagtatgtggtataatactagctacttgattaattgttcgatatgattctgattaaacttgttcctgcagttttgtaaagaaataccgttaattattcagaaattttggaaagcagatcgatttgattgagggaaattaaacaaaccggttaatttaatctttttcaatattatgtatatttttattgttctcagtttttttttttttgagaataggatgggccggcgcgcggggaaattaaggagagtttatgcacacatatagtagtatgtcctgaagaaaatgttgatatggaatgaaataagttaaattttaaacatgtataaaaattgatgggaaatttgatcgtaatcgtaagagacaaagagaacaagctatagctagagcttagatagcccacttgcagtcataaagaaataaattatagatataggtatatgtatgcttgcaccagaagcaatatataacacactgttgcacatacgcgcacagagatatacgtgatggatcgacccgtgccttgttggttaattaacaagggggaagaataacgacaatcctaattggagccaataaagcgtggttgcgtgcgtaattaatcattccatggaaacggaggaaccatctacgatttaattaaccataatcatgcagaagaggggagagagagggcgcgtggctaagagcaggtacaatagcaagctataagccagctataaacatattttaaaaagataaaggaagagagagaagagcaggagactataggtatatagtcagctgtagcacggactctaagacgtaatatgtgtatgacaggtaggaccaggtattaatagtacagtaagcaactattgtatgaattgactattacattagctataaatgatttggagctagtgagagggtcgcttgtgggagaggaaaaaggagtagtaattaattaattaattttgattgagtaagtgattacctggtagctcccacggctcgtgggtgtggaggtccacctcgaccatggtgccgccgccggcggcggcggctcctccaactccggcgaagcgatgctggttcaccaccttgttatgaaggtagtggcagacaagctcctcgtcgctcgggtagaaccggaaccccggaggcagcgtcagctcgatgtccctcaaccccatgtggctatcacctgctaaatttctttgatgatctctctgtctatagcaatctagctatatctatatgtgattgatctctgtggagtattttggaagtggtagctagctatatgtacatagctaagaattaagctgcagattgatgcagagaagaagaagaggaggagagaaattgataggtaggaacttggaagtagctagcacatatatctgtataggttggcgattgtgtgagctcgggaagaaggcaggaggcaaatatatatagcttggcgagggaataattatatgcgcagctagcagctgagagagagaagtgtagggaagcaagcaacaaagcagcagcaggagcaaagggtactactatactatggctagcaatagcaatagctatagctccgatctctatctctgtgtgtagtacgtcggtatgtaagtatcatgtatatggcagtgagcaatcgatcaatcggtcgagagctctatctgcagtaatactgttgcgcctgctgcttgctagctgctgcaagcaggagatggcgctgtcacgtacgcagcgcgcgggaggaggcggaggacgcgggagaggacgcgtgcgcggacgacgtcgcattcactgacgacctctctctctctctctctggagagaagaggaggaggagggcaggtggggttggggaggaagaggaatcaaggaagaagaaggacagagagagagagagagagaggagatccagggtcgcaagaaagatcatcgccacggccggcccacttgatgatggacgatcgatatgtacatatcccccaagtgcagcgacaacggcaacatacatggcactatcaatagagacgcatttggggaaaaaacgcgagctcgatcgatctctagctgcccattatcattgtgtttgtgtgcatatcaattcaaccgcgtgcaagatcggggagccatcgtttcggttattcgtggtacaagtaaaacggcatatttgtaaatgaaaaataatttttaaataaaatttttataatattcttagcgatcaaaaatcaaaggctaaaaaataaactttgataaaaaaaacctcaaaaccagatccaaatttaagattaaaaatttaaattttgactgacaagtataagcgaaaagatgaggacatacgtatatgacacagcttagctaggcttaattattgatccgtcctacgtacagcatctcctcctcgatcccggcctctagtatgcatctctacatgtctctctgtctgtctatgctctaagcttgttaaatttgcttacaagtaagtgcatctatgtgtgtgtactgtgtttgtacagtgcaggtacatacatgggtacacagtgtactgtataggacggtgattaattatgcaaaatgcaagccaacaaaaatatcgagacggaggataaaacaaggatcagcgcccctgaatatatcaatccgcctacacttgctagcttgcgtatactgtacattcagagaagttatcgagcatgttgatcaaagaaatatcatggataacaagtctaggtattaaacctgtgtgtgcgtgtcgtcttccgtgtaattgaaaagagaaattaacggcacgattaataaggtagtctacatccacatacaacttgcgaaccgcctatgtaggtgtatggctaaataaaatggttcaaactaacataagagaccacatcagttacaacttgataattattaatttcagaattcggagttgttataatagtaaaatcgagagatcaagacgaatacaatcacatattaagtaatgaaaaccatttcgctggactaccccctcaaattatttctttctttctaaaaccccttcaaactatttcagcggagcacttagcccctcaaaaaaaatctcattcgcaccgccaaaccatcaaaaatgtttcactttacttcctaacatatttctcttttctttctccctatataagtcgtattttgtaaataaaaaaatgttaggatgatgaccgatgtattgcaacttacgtctcaatatattttttatttttatcactgttttcatagggctgaagcacctaaggctgatttaagcatcaagattctaaaaccaagcaaacaatcatgaagaaaattaaaaatacttttgaactttcatagtggtgttatctatggcactataaaattgcaacttaaaatataacttatataaaaataaaaaaaagagaaatgttattagggagtaaagtgaaccagtttagtagtttaggccaaatatgagaaaaaatattttttcagggagggattaaacgatccataaaatagttcgagcttgtaaaatagaattatttgtttgtttgttttaaattttaaagatattaaaccattaaaataggaataataaattttggactacgactacaaactaaatacaactttgtatttattaattcgaatttcaagattatttggaaaaaaagaagcaaatttaacatgtatatgcaaacaaatgtcccgtgcattctcaacttgtggagattattactagctaacagtacgtgcatcttaagcaaggtatacgtatcttagcttgattaccgataattagcagggagagaggctgtcaggaactagctgcaggtaatcaccgtacgctgcttcaccgcttgatcgatcgatcatgcattttgatgcgaatttaatcatgagagaatcggaaattatttcttctactccaagaccagaaagcgacgagagagatgattatattaaacaaacggtagaggtagtacaggcatgtcgaaagaaaaggaacgacggagataatgtcagaaataatgtctgttcagcctgcatcgatctctgtacttctctgtagtctgtacactgtactgccgattaaattgaatcagatgataatgatatcacgacggcaaaacgttctctaattgaagtagtagcagtgcataatgtacaggtgtattgttgatgatcaattcaagttcttcatcatcatcaatcgagaaatgcgaggtacaatcattgtgtacatgtataataatactttatacgtatatttgccgtgtttgtcgtgtgctctctggcgtataaaaactgacgaactcctgcagtagtactgtacgtgtgtgtgtcattagggcacatgcgtatatacgcagctagagctatatatacgttacatattaattaattatagctaagtacctattccaaaacagtgggatgcgacttatgcgacggaataaaaggaggatatgtacagtacgtgtacaagtacagtacgtgtaattttttttgagatgaaaaaaagtacagtacgggtattcgtgatcagtatatatcaaaagtacatgtaccatatgctagctgcgtcgtacatgcatatggttgttgcggcttaattatccaaaaattaattaagttattacatccctcccctgatcatcaattaataatctactcttctcattaataatctctatatagctaagtaccttgtgcagaaaaaatatccatctcgatctaggctatacacagcaagaataattaataaaagcggcatgtatgtttaattaattactatatacttgagtatgagtatgagcctatgcaaaagtatatatgttgggaattaaagtagacgatggtcggcgatagatttgatcgatgcaggactacaggtaggtaggcacaagcaaatacatgggcgatggtaaaaaaaaaagagagagagatatggatattgtttctgtgtgatatagcagtattctttgtgcgagttgcagttaactaaaatgattggcttagagataaatactccaggtcaggacaggattgatgagagcatgcatgcaatgcaatttcatggcagttggaggcaggatagataaactaacttggggagatgattgagtgacgtcatgcaattaacaccaaggaacagggcataggacggaattaaaaaagaggcgatcattggctttaaaaaacgtgggaattaatcgtggggaatttttcgcgaacgctgaataatcatggggaataattagcattaactgcttgaattgatcaccctgatgtgtatgtatgtatgtatacgtatagtactccctccgtcctaaatgtttgattccatttactttttaaacatatttgattgttcatcttatttaaaaaatttaagtaattattaattctttttcctatcatttgatttattgttaaatatatttttatgtatacatatagttttgcatattttataaaagtttttgaataaaatgaacagtcaaatatattttaaaaaattaacggtgttaaatatttagaaaatgatggagtatatattaactgaggacgagatggatgctgcgcttaagccggcgactcgatctggaaggtgtccaatcccaatcacccaatgacagcgatacctctgcagctgggacctagaacaagctaacctagccagagtatttagctgctacaagctgctcctcccgtttcatattataaatcatttaaatcttttactaatcaattttttaaaaaaattaattaaatttataaaaaatataatagcattttcaacacaaaataaatatattatcgaaatatatttaatgttaggtatagtgaaactaatttaatattttagatattgctaaattttataaacttagtcaaatttaataaaatttgactataaaaatattaaacaacttataatataaaacaaaacggagggattactaattaacgggagctaggatattacatagtagatttagctcagaaaagattagccaggagggaacaccgattcagacatctcctgcttagctgctggtactggctagctaactggactttttctattttcttcagagcctgaaatcgttggcatcttactccaaaagggcagtggaaaagagaaaagaacaagaccggtaaagtactacataaagtacttgctactacatattctgacttgttatgaatgatgcaaacaggagattaaaatcccaatttgttaagctatggctgatgatgagtcgtagcgaaatgaaagaagcaaccaaaaataatttataaataaatctcttatatctatactattcatggcttaaaaataaggctgaaaaaaagatgctactacggtgaaaaaaaatcataacataacttttaaaattaaattttgtttgtggctgataagccagcaaacagacgatgcatgagatctgtttgcagtgcagtgtgcacgacggacatatgtctgagaaaattaaaactgattagcagcagctagatattgtcgcacaagtgcagcagagtcgaaaatccagcaagaaaggtatggttcaggcagggagagaatcagagaatcgatctggtccagaaacagtctcagtgaccatgctgcatggatgtagctacatgtctgaggaacaagtcagtcatggggtgccatcgagtgcacgcggaaaagcaaacgcggcatccagtggagatggagagcattagagcactgtgcagtgcttatgtggagtgctagcttgtgtaatccaaactttccaaagtgtcaatcaggtctacagaaatgttaattatgctttgttcgttgtcaatgcacagtacattaccatcccattatcggataaaaacacacagtatattatccatttcttgatagtactaattgattgatcctgctgcagcttgctatcaaggattcagtgaaaagctcctgtccaaatgtttggtggtagagttgttcttgtacaggtaaaaggtgctggaaaaaaggaacagtcaagattgtgatttattttctcaccaacaattcatgagtttccacttaagtaggccctatatataatgccaagatatgcatatataaatgaattgtttatgctacttctggaggcatcttaaatttgtgagttgatcccctgtccttctctgaacagaaacagagaaaagacagacgacgttgtgatcgtttctgctcttaatcggaagccaatggaggagatagggatccctaattaagaatactactgccacaacacaactaaaaagcataaccacatttgcttagttattaattactactaataagcttcttaaatggaactggcccttatccctttctctagaaaagaatataacggacacaatcatcatgagctgatggcattctgtacatatttttataattattcagagatttcttttttgtccctgctggagtttttctagggttgtttataggaagagtgacggctccatactccatttcttccaccaattccttcctactaatcagactcaacactaacagtgccctttttcaaatcctaagaaagcgacagaaaccaaaagagcacccccaaaattctcgcttttaaactagttttctctcgagtagtagtatatctcaaagtctacatgaacattccattgaagcattgactcacggaattaaaacatgtaattgcaactagtattatattgtcatgagggcagggttaaggctaaagcaaagtacgtacgcatgcaaccgaagctgcatatgtaatctgccatcaatttgcacattaagaacaaaataaaaacactaccctccatatctctcaactctagctgcttggatgatgttgaatacagtatatatgtttgtacgtagggagtatatatggaagtaagtaactgtaggaacctaattaatactgtaacattatacagacagcgacagactgacagtgtcggattaatcaagttggctagctattgcagtgcagcatctaccagcctgatgcttggtttttggctgcgtactgaaaatttatgcgagatcaagagctcaatcaagctttcctccccaagaaagaaaaagcttcgcttatccttcctctgtctcttttccttgctaccattaggatccaaattacacgaaatcatcaaatgtcccatcgatggtatatgcatgatgtgcaaaacggccatgcatatattttttttttctatgtgcagtgcttgcattgggctcctctgatctccaagaggaattatgcaacacaaaaaacatatatgtactgtggtgatattgagtgggctgtgtgtctccatttcaggaatggcctgtgcactatgcatggacagcattagttatgcttaatcgttgagtcattttcaacgtcgcatatacaccctcctaagctagcccagctctctgaaggccagccaactgctgcatgaaccatgcatccactgcatgttgaggtaggttaatttcattttgttcaggaattaatgaaagcaaatatatatctgtataacaagtagtcagtctgatctttcaggaggtagtagtagtaactaaggctgtgtttagttccagcggtgaaaagttttggcgtgtcacattggatatacggacacacatttaaagtattaaatatagactaataacaaaacaaattatagattccgcctgtaaactgcgagacgaatttattaaacctaattaattcatcattagcaaaatgtttactgtagcaccacattgtcagatcataaagtaattaggcttaaaatatttgtctcgtaaattagtcgtaatctgtgcaattatttattttttaacttatatttaatacttcatgcatatattgaaacattcgatgtgacatagcgaaaatttttatcaggagatgtaaacagaccctaagttaacctgagaggtttaaacttgtgccatctgccatggatgcagaagtagcaagaggagacgaggacgcggccgggcggggagcagaggcggtggtgaaggagaggtcggaggaggcgtgcggcgaggccgtgtggcaggcagccgcaatgattgatacgactcgtcgtcagcaaatattccctcctagacagcgacctcgtactatactacactttgcagcaaggcacgcgtcctaatgttaacccgtatgcatgcatacagattagcacgcttaattagagcaaggataatgtgagctactccctccgtctaaaaaaactcaatctcaaataatgtgacccctcctaaaacaacaaatctagataaaagatagttatactaggagcggtcaaatcctctcctagattgagttttttttttggaacggagggagtataaacctactgtaagctacttcctccgtttcatattataagactttctagcattatcaacattcatatatatgttaatgaatctagacatatatgtatgtctagattcattaatatctatatgaatgtgggtaatgctagaaagtcttataacctgaaacggaggtagtagcttacgtggaggagaggtgtaaaaaaattaaggatgttagctctcatacaagagctagcttaatataagcttgaagacaaatatatcaaatgtataagtaagagatagaaagaggagaaaaaaaattatagcaaaccttatagctaatctctattatatatgttagctttaagataaactaatgaactctactattattcttgctcttaatattttctctattataaaataagtgcaccataaataagtgcatccgtatattttaaatttgaactacatttaagtcagagagagtattattactagccaattaccattgtgactacgtttaccgtggtatttattggtagcattttattatccgtatatatattattaggataaataacctttaattgttaatgtatgagttagtatatgatagaaaattaaagttacttctctatggtactgtggcagtataaatagaggagtgaatttaaactctcgacgggggcatttcctctttatttatatgtcatttaaatagttataagataatttgaaaagatgaattaatatgtgatagatcacttcacaaacatgcaagttaaaaatgtaagttgagaaaaaaaatatagctagctaacatatattcacagtcaaattcatttttttattacatgtttgtgaagtgatatattacatattaatctatctagttgatttgttttctaaataaattataagcatttagattacatgcaaataacaagagaaatattctcttgaaagtttagaatagtaaacgtatattgaattaaattaggaaagatgaattgtactacaactcatcatcgcacatgttatatacgtatacgtatatgccgagtagtggatacgaggcagagagagggtagagcgtatcgcatacacatacagagatacagggaggtggtggcatatgcatgggggtgggggggtgggtagcttgacggggtgggaaaacggttgtctgcaagtaagctccggtggatcatccgatcgttggatggcaccgcacatatggcatgcctagcttccaggcctggacactgacccctccacctgtccgcctcccattggtcgcctgcctcttccttgattcatttctcttcctattctctcatcgatcgatcgatcgatctcttcctcgtgaaaatcaaggctccttcgacatcgcctcgcgacaaacctcgcctccctatcacggccgatctatcagcacactaatccatcatgtagatttttattagtatcaattctgtttcagctaactcgtcagtctgtctgccaagccgcgcgtcgagcatgcacgcccccctgctttgcccatgatatattaatttaattaactaattaattggtattctatccgtcttgaaatataaaaatctagtattacacgagacatatcatagaaattctatcaagatttgcagaattagaatgtactccatatctcatttcttactccatattttcggataaaggtagtactatcagttaattaaaccttggatgcacgaggaataagttgatttgatcgatcttggtgaccctttttgccctgtattgaatgctaatttgctttcaagaaacccccaaaactgacgcggccgatcgatccatcgatcgatctcgccgccgaaaaggagggaaaggagaatgacaccaactgcaagagaagagattaaatgtggagaggttgacagcatctgatcccctccactaattagccagaccgcgagctgatcgatcgagcgagctcagtcacagcgatcgctccagcgacaaacgtgtgggggatttgatgcttccatctccgtcgatcgccctaaagctcaagatcgatccaaatccagctcctaattaagattaattagctatggatgttaagggagaaagagacgtccatggcgatcatccatcaccgacgcaatctcgatttcctatctatctatctaggtccagatccatctgcatgcccatgcggcactaacagtacaaaacagtatcattactgttaaactaatctttgcgataatccaaaacgaccactcttgggaaagagtcaagagctaagatagcagctagcctgcaagatcacacactggatcatgctccatccacagataccaacaaacggttcacgggtcgatccaaactgaacctgccattcgattcagagttcagaaaatggccaaaaggccttgctgtgtttctgatcacagattctaatatagatacagccaggtgcaagtgcaatgccgatggggatggaatcatcctcgccgatctgtccggcgaactgccggctcggcgttgcaaacggacatgctcgtcactgtggactgaatactgaactaatctctgaataatatgcggcggcagctgagcactcgatttcagaagggagggaaggggctgagacccaggtagatatatgcaggaaaaacggtaggtgaactaccctacaataatgccgacagcaactcgatctcgattcgattgatagatcgatcgatcacacagatggtagcacatcgatcaacagcgaatcaaggagaaaatgatgctctctctctctgtggtccagggacatctacttcagctctctattggccgataagaatcaaaaacgctatctttcagtttggtcggttcagtacctcccagtagaagcaactgctggttcagagctcgtggtgaaagtgaaatcgatgacatttggatgccagttttattttatttttttgaaagttcagtaattagcaagaaacacatatttgcatatccaattaagctacaaattcagcattgaattgctgcatctatgtcatatgtatacagagcccacaggttcagtagaaacgagttaccgatcacagaggaaaggaacaaggcaccagctgaccagcatctacacacaaatacacaatctcttccgagtgtaacagtggcgatgagtggaatgcaacaggtgtcaggcactcaggctatcagagtgcagcaagacgtaaagggtggatgcaagtggcccacttcaattttcatatatgtgctgaatgatttctaatccaaagtgttgcaggagatgtactgctagatggatactgtgaacagagaatatatttgaaagaacaggatagaccactgtttctgaaagttccttttcttcttgggaataatctgtttctgaaaattctgaaacttgctactgtatctgaggtggatgccacttaagcagccccactataattggtgtaaatgtcatgttaatgtagcagatgtatatgtatgtttgcacgaaaatgaccaagcatggacaaaagattataatatgtggaataatgtggaatgaagatatttacagttcagaggcttgccccaggatggtgtattgtcattgttggcaatgaagaagacaaatgacaaatcttctttgtttcatagatggtaatattctctcattttactgaaaattaagtttctccgtccttgatcaccaaggtgcagacaaactgaacatagaatgcaaccagatacctatctagcatcttctatatttgttttcgtcatgtctccatctacaggacccgaaatgatgaactggcatttttaaattgagaggagttacaatatggagtagtcaattagtgatcactatgatcggtatttctgaaataatacaaataagtataaaataaaactaatacacggtgcaacacaaaaagaagatactgtaaaaaagagagagaatttacaaatgcacacagaggcagcttggtagagtactagagtacactgaaatataaacttactgagggcaaatgtggggaaaggtaagcccaagaggcatgtggaccaggcgtggaaaaaaggcccatatggcccgtgatggaagcaagaagcccatatggtcggcttgcggatgaactgatcggcccgaggcccaacttgacccattataacattagtatacagtacaacgtgacaggccgtcacttgttttctcggcccaactctacattacatatacaaactctaacgccacaaaaataagtacaaaataaaggaataaatgatgtagaaaaatcagaaaagaaaagagaaaggcccatataaattcttcctagttgatggcttctcctgcaagcagcccggagtctagacgaaaacctcaaatacaaattcgaaatcctccccccatatgtttcgtgcttgccacgccaaaaaaaaaaaaaaaatcagcaacgagagagcgatcgcgcgttgcagcgtcgcctcagaagcacttgtcgccgtcgtcatcccccgccgcggccggcctcgccgccgcggaggggccgccgccgccgcctaccgacgacgacttggaccgccccgacgaggtgccccccgacgccctcgccttcctccgccgctgcttcggcgccgcccccgcggcggcttctccctcgcagttgttctcccccacctccgtcttcggcggccgccgcgacccctcgctgcctccgtcgcgccgctctttgccccgccccgcccgccgcggccgctccgcctggtccgctctgccgccgcctcctccttggttctcctccgcctcgccgccttccgtgccccccgccgttggcttgaactcgttcatctgcgaccagtgatcggagcagttagagacatgggagatggcgcgatcgggggggaggagcaaggcggcggcgatcacccagctgggcgcggtgacggaggcgttgtcccagccgatgtgcgcgacgtgcttcacgtccgtcgggttcccgatctgcatctccggctccttcacgctcggatctgcaagcaaccaaccccacaacaccagcgtgcgcgggcatgcgcgtgttcgtcagacaaggtacacaatctctcacaacgccatcccgtaatgcattttgattttcgttgtgtggatgaatgatgatgaattatcaatgtgtggcatgaacaatgttgaggtgaattggattggggaattggggaatagggattcgttagacttggaaattgatggtgttcgaggcgtaccgaaaatttgtgagatgtatcggaggcccttgagaaggcccttcatcttaaccggttccacaggcggctgcccgcccgcggtgctctgcgaggaatccaccacttatatgtttgtcctccaccccttgtcccttgatctagccttcacaagtaagcaataacattacaaatttttcgccgggccaatatcatttaaaaaacaaaagtaagaactaacaattctatgaaatgggatacaacctattgaccataagcttgattttacaaatatgaaataccaccgtgaacagagataaaaaaaacgagaaaagccatctgaatgtttcgtcaaaatacaatgttgataatgctataggtgttggggtgagatttacatctaccgaccacgtagcattgaaaacaaaacaactattgtggtctatcgtaatatgatttgctggaagatgaagattcagcaatgtatatatttgttcttttcaacattctgaagttcagtttctatttgacacacacaaatttgtggcgcctaattgaatcagactcacataccttgcaaagcagatttaagagggtgatgaagcatgatctaccgaatttcatcttctttatgacatcttcattgtgtctgcagcaattctcttcacctattgctgtttgatctatcacaatttagtggaattgcaatcccttccaaagctcaaacaggaacaagcatagattctctcttccaagttggagaaatggaagggcagaaagtttgttgcctcgatctatttatggttccctatttttggtctaggctccttttggttgaagttcattttgacatacagcagtttgtgaggccctggttttgcttaactggtctgcagcgcaaatggcggggatggacaactcagaacatgaaaaaggggtcatttagctaacaagccaatctgcctcttattttgacaatttccgatcatatcccatatcctttcgtaggtagttaacgaagcttgcattggagcttgagttcagcagcgcaaaatgatctaatacttgattcaatcagtatggagtgtccggtggaaaacaacggataaagtatcggtgcaaatgttttgatatatagtatgattatcgtaggtttcttagctttttcgatcaagactttcaagcggcctggtcatgtttcttaatgtagccaaattgttttgccacttccgtctctagtccactggaagctacaacaaagaaaatgaaaaataatcctttaaacaatatttacacacatggtcggaatccaacaagttgattttctttttcctaactcactgtattcttaagaaatagtgaacaaatttattgcagtgtcaagaacagtaggaaagaagaatcatgacgatgttattgcagcataattccaccgataccaaacatttcgtgatgtacctttacaggattggcgttcctttcttttgtagtattacaaagaaaatcaaagaattgtataatacacacacgtatcaaaaatggggaaaaattgcgatgtagctgcttctccagttcacaaaaagcccaatcgaatatcgtcacttaagatgtattaataaggatctgtaaatgctactatcatgcttttacctgcagtttaggaaagtagagagttattttagttttgactcctgactcctgagtgcgtctaaggccatataattatacaaatggattaacagaaatcttactgtggttaggtatctctcatgaatcttcagtgcccctctgcatgccttctttgcatccagacttccagtgatatcgtttaatatctgtttgcaggggacaagcacataaacaacataatcgtgtatagctttctacaatcatcatctcatgacacacacatggagagagagagagagagagagaccttcacgacatcgtctagaccttttgcatcagtcagtatctgcttgtttctagcctctatgacactagccacaatgaacacagatagaggtatctgctcttcctttttagccgcctgtaagtttttctgttcgaattttccacactgctttaaggcattttcatcttttgtgtttgcttgagatgtactgttatcactctccaacatagaaaagagacctggattgtactccatagaccacatgagctgcaacatttgtaaatcaaggaaacagccttataaaccttccacagtacaaatcaatacttgattgtaagtagaaaccacattttgattatgctttattaggataatcatgagataataattgaaaagtcaagaaaattcttatggtgcagggaactaatcaacacacctaaaaggttaaattatgcgaccttgttgggaagcttacctcccaaaggtacattgtgtctacaaaagagaactcccttcggaaaagaaccatcagcatacggaaggcaaataagtattcccctccatcaagattttctgcaaaaataatcttttgatcatggaataaatcacgctacttatagttcaataattcagaaagaaaaggcattgttcctttggccattctaatgaacaatatttggctccaaacaactctacctaaatgctcatgtagcttcggatcaacggctttcattacggatgacaatatggtcagttgagatcgaactccaatggaggttgaactactcacgaaatttcctcgctgcagagttagcatgtacaatatcaatctctcagtatctgtagaaaaattaacagagacagataacacatgcagcaaaaccactataatcaatcttaggggtttttttcccatataatgttcattagttcatatcaatatcaattattgttttgataggccatgctaagttgcaaaaatatttccagaaaacggttctgcatattacagcgaccatattgaccttttaagtttactgtaacattactgcagttgtgcacaacttttaattaacatcatatatcggaagtataaattgtacccttagcagcggcggagtcaaggcccagccagccatggcaaatgcccaggctccgcctaagatgctgcagtagattagcaattcattaatcatgcaaagttagcatattttttaattaattaccttaatgaatgctagattagttgagaaaattagcaaagcatataattaaggctcacaccatcacatgtttgcagtctatcagccccatctttttgcttatgcttatgcttattagccaaaatttgaattttcaatcttaaatttagagttgattttgaggtttttttatcaaagtttatttttcagcctttgcttttgggtcgctaagagcacgtatattaaagttgtattcataaattatttttcgtttgtaaatatgttgtttggcttattcttataataagccaaacgatggagccctataggccatcacagcttatatactgcaactcgtactgttaattttacttgtgtcaatggtaaaatggtctgtagagttgtacaagttcattttcatttgtacagtactgccagtggcttgcccggggtcaataaaatttctagatccgccactgacccttagggtaaaggatctggatatttcttagtgaataaaaggctacatgtgtaaaggtgcttaccaccctgcgcataagtcgctcaaagcaccaaaacgcatccgcttcgtgttccaagaggatcgacattggtgagcaaagatcactcattcctgcttacaaacaagaggattttatgggggggaacagcaaaatttacataacatgacatttagcaagctaacatggttaagtgttccttttccttttactatgactggatttgcaaaaggatcagttttgcttctgtaacgcaccttgacaataaccgatgtccttgtcaacccatgaataaactgcaagaatgtcccacaacctggccaagttctcttggctctcataatagactagttgacgatctgtacgattaacatcaagacctatagttgaatagtggaataatcagaccaatgaaagtataaaaaaatataacaatatgtgcccagtgaactctctcttttttttaaaaaaaaacataaaacggattgagggatgctgaaaagagaggattagtactcaccaatctggtgcagagttagcttccattgaattacttcctttggtaggggtgtgtcactagcttgttgttctgcatcaactgagttaggatcctgtataggctggccatcttctgttatgacaggcatagtaattacccttccgctaccgactgccgtgtccatttctcggcactttgttttcagtttctcatattctaacctataaaaaattagaatgagatattagaatgaatatacatgatcaaacaataaaggtgcaattaagaatgaaccttcgctgttgtcttaattggctcttttgttcagtattgcttttagggtcataacaacccagcaaaaactcccaaacttctcctttgatatttgggtgggtaccctgtttagccaaccaaaataaacaaggccttagtgtgaggtcatgattcatgaatgcaggaagaaaatgaggaattcctgatgtcccatcatgtttggatcatctgtcaaccattgtctcattgacatacggacctaggcttgtgttgttagtgagaaggaatttttgcaaatatctatatattactaaattattaaaacaaggcaaatattagcctccacatttgcacttcatcaggctacaatttaccatgttaattggagaaaaataaatagttcatagttcacattgttgattgtgtaacagatccatattagtgtagattaaaatgaagagtcaacatcaatacaatgtaggataactgaaaatctcagaataataaaaaaaactagttatttgatttctaagcatataacagtataattctactttctgaaaaagtataatttagcctggcgctgtggtgcaatcacggcgtaaattcagctagttcggagcatgcaagggattaatcgaaaagtatagctcaccccacgctgcactcttttgatcattccagctatgtctaggacaccttcttcattgtgaagcagcttccatctccttggacttagagtgaggccaggctgccaaaaggaagaggaaacagcacacaacgagtcaatgcacttcataatcaaatacatggctggcactaatctcgctagtcagaatcctcgatgcttccgctcggcaaatcgatctgagacaacaaaattctaccttcaaactaaatgccctcatcatcttgcaagatcaatcgattggccatctgagcctaattcagctcatccaggtaacagtaacagttaagataaaaaaaaaggtaacagtaacagttgataattagatactagatccaatccagcgcaagatgggcactgtcaaaatggggacgggggcataggggacgcggaattagattaaaacggagaattagaaatggatagaatgaatcaattaccctgggcttgaatcgcgtcttggcggcgtcttcgcggcactcggggcggatggggtagaccgtgtccggatcgatgagcatgtccggatcgttgtagcagcacgccatgaacatcatcctgttcatcttgaccgcccaaatcgagccgcggccaaagaggcaggagggatcgagacgagaagacgccggccgctgctggtgatcagctggaaccacacggacgggggggcagtgcgcagtgaggacgaatcaagatttgttcttcactccctcctttcctctcctttcttccttcctttcctgatttgtttgatgatgtgccttctctgtgattgagatccttggccgtagagagagagagagagaggagagagaacggaaggtggtgtaacggctaaatttggggggtcgggaggagagagacggggagacnnnnnnnnnnnnnnnnnnnnnctgcttggtttgtatcagggcttcgtcgctgagatggacggtccgagcttgagctggtcgtatatttctctttcgaaactgatgagttttcttgattgttccgttttatataagcgttctaggacttgtttgttagtagttgccgtttctgttggctgattgagggaatgaactgttgaggatacactatttaaagatttttgttagattattcaattagtaaaccgttggttcgaagagaaaatcattagttagataatctggaattcttccgttaataatcgtaaacacgagtgcacaacaacttcttggatcttgggtttcggaatatctgctatctctctcctgacttggatagacgtgcgtgcttgcttgactaccgaacaatattcggttgaagttttccacaccaatctctgaatggatcgtccaacatgcaactaaggtcaatcaagcataaagaagcaatgtactagtaactgggggtcagtacgaaattgtcaatgcaagcttcaggaccgctaatcaggcccaatgtttatagtatgtactatcatatagtgtagtatcatatgataaaacccacagaaaaatgtcgctgctaactctatcgcaattgtttacctaatgcatgtgcaagccaagttctggcttagactggagatgctaaggctccaacctcccaaaaggccaaagaaacgaactgcatttcagcgagtaccaaacaaatcatgcacgtacatgcgcaagccaagttcttgtcttaaactttcgaagctaatagctcgcatgatataatgtcgcttaacgatgtgaagcaaccagatgccgacactggcacgatgttgaaaataggaaccccatcaggtgtgcaggaaccaacaccaccttcttcaagctcggcgaatgcctcagaaaatacacgggacatcacatccgcagtcactgggtgctctactgaatagtagaatcttaacatctgcagatttcagcccagagatgatggttagagttcgggaaaaggcagatgcaaaatgattacaggacagatacgtaccgttaggttgtcccaggaaaagccattatctatcagaatcttagcaagctggaatgcacaaaatctagccaaagctttcaaatgctcctccgagtggtatagttgttcagttgtagaacagattttcaatgcaatatcatttgtgactgaaacaacagcagagcaaattttcccaccgattgtgtgcacctggcagcatgaatcatccaggtcagagtattgtgcgctccaggcactaaaagcttcgcttgatgctggcaatgaccctccagcctcctgttctctggttgggactccatcatcattagtgggactggggacatacaatattggttttatctccacgtatgctctgaaaaaatgaggaaaagtctatcttaacttaagaagagcacttgacattgtggtgcttcaagtatgagagtccagacagcactaaagcatttctctgagaaatagaatgacggatatccttacccttttggaagatctgatgcaaatacatagagaatggtgggatatgatccggtatttgagcaatccaaactggtgatgtacgaactacgaagtgtatgttcaacttgttctttttcactggacgtcaagtgtgcagaacagtacaccagaaagtgtattgccgaagaaaaaatggagcaaccaaaggcattagcaacagcttcactgtttcgtaatgcgaattctagttcagccgttgggcccccaggacagagcttcatcgtagggggatcaagccccagctgaccagccatatagagaatctctccatgaagtgttgcctaagcaaaattcaaaaaactttaacactgagaatgtacaactgaggagaaaaaagaactggtagatttggctagcaactaatctacaggaaccttgcttatgaattctatgtagaatattgtatagaagcatacaactttcaacatacccatgacatataaccacatagtgcttctcttacctggctataaggtccgatgcaactaggagcccagcatgaaatgctttgtacatgtagaactctcttgacttgctcctttgtaactagaacttccacatatgcatggcctaaaccaacctgaactagtggcaattcaactgtactacgtgaaggaacacccagagggcatttttgttcagtaataaagctcacataaacttcattggccaatccaaattccttcatgcttgaaatgaagaggtgaacatacagaacattcatccaacctaacccttcttccttgagctgattctcgattctgctcaaaactgctactagatctgtcttcaggcctatagacataaggagatattaaatggacgtttcccacaaatgaagatgcaaaagaaaggagatattcctgtcaggcgggactatggtcaatttaatgttacacagaacaataaggcacaagagcatgcaccttctgaagtaccacagggatcctgaatccaacaaccaatggagaacaactttttgccagtctttgagatgcataggtctatatttgtgcaagcatcaacagttgtaactggactcaaggtctcttgtttcttttcgacatcactgtgtgcaatagctccatctacttcatacaaataactagaattctcttgggcaatagcactatcaccaacggtgccaaaagaatttggcttgtgttcaagatgaaattttaacgggtgaagaattcctactggagcgatggaatcaggcgagtggagtataacttcaaaatcatcaagaacaattcttgcattctgcagtacaagaaactcatcagttccatcttggtaacaaaatgcttctgctgcacatagcacataatagtagtataaattatgaaatgcttcagaaatctgataagcatgctcagaatatagtcaatagccaagttacagcgtttcattgaatgtgattcatgcttaaggactggtccacatgttcagacaagtggcatcagattattcacattcagctcttatctccttaaacttacacggaatagagggcagtcaagagttagtgtttcatattcgccaccttcaccacagacattgattccataactcctagtgggatatagaaaaacaaaaggagaaattacaagctgcacagatgcaagtgactagtattgaccattagtaagaaaatcatgagaacagacataaagagagcgatatgttgtgatatgtttcttggaaaccactccctcattgatcactacgagaagctaaggcctgggtcattaacccacaagttataacaggatacaaggtcttctaatacatgaaacctccaagaggaaaatggctaaatgggatctatgtaggcagtggggaacatactcattcagttggagcagatgacacttaagttcagccagttctttccctaagtgagcagaaggtttgagccccattgcggcaacctataaagtccaaacatcagatattccatgtgataaacagttaaatacatacttgcaaggaagttaaaaaaaattatgtaccaagagaacaaatgcatgagtgtgctgtatataccttgacgattatagctactatgccccttcttatctgcaaacattaataaccaaaacagaactagtaatttgagtaaacagtttctgatatgccagacaatatgcagaagaagaaaaaatgaaattgaagttaccatttcatcaagaagcaaagtctgatcctgcttccacaaatacgccagcgataccaggcccaaccttgagcagacactctcaacacgaagcctctgataatcagacgcaatggcgcctgaagacactgcagtgatggatgggatttgccttttaacctcgctcaagagcgcaaacatatcctccacttcatcgcctgtggtaacattatatttaagaccctgctccctacaagcaagtccaatcaatgaaattgcatcaaatttcatctagataagaacagtagcagcatataacaacaataaagacaatccctgcacagatgccttgccttgaggatccacggatgcgcctccggaacagaggcaagcccatgcatttcgcataactcacgacaatctggtgcccaacctgaagcctccagccacatcaacaataggcatagcaatcagcgaatttgacagaataccagcaacgaatggccacagcccagcgctagaagcagctgctaatcagctaacgatgagtgaagagaggagtgcatacagtttgatacatgtagctgtcgagctcgtcgacggcgtcatcttcggggatgaggttggccagcgcaacaatctgcaagcattagcatgtcaatgaaaaacggatgatagaatagaactgggtgattgggttgcgctgcggttcgttgccttgccttgtggccatagtccaggcatcgcatcatggcgaagcagctgtccttgccgccgctgacgagcgccaccacctccatctccgccgccgccgcctcgcacctcctagggttggagctcgttttgttcaatttcttcttccggtcaaaacgctactggattccccccttcttcttcttctcctactggatttggggcggagcgaggtttgtgtaggcggctgcgcgcggcggagcaggacggagcagggcgcggcggacggtgcggcgagtccacggcggcggcgcggtgtgtggactgtggaggaggcgtgaagcgtgaggtggtgcgagctcgaggctaccgaggcccagagaccgagcccaatgttttggaaaattttgtggcccatcagaagatttaccggcccacgtaagtgcgttcttggagcccaggccaaaaatatttcctcattaactccggaaaaagaatgttaacacaaacagaaagatgtgtgaactacaaacttcatcataacgcttacacaagaaggaaggtgtgccaactttctttgccataaccaccgacaagccacgttgccgcaacaatgagactgggagctttgcacaggggagatcctttttatcaacttctgttgaataagcaaatccagagttgaataagaagggggggatacacgaatacttgtctctcaggaaaagttgccaagtccagggggggtaaggtaaagaaacataaatatgttgaatcttgaccacctctaaattaatcatcacaaagctaggacttggccctaacgcaacagcgaacacacacaacaaaaacaaattattgctatctatgaagcaatgatacaacagggccggagcaccatgaaattatgggatgctcctggtgaactgttgacaaataggtgataatcctgtcatttacagagtcgcaaacagcgtttcttcctttctctttccgttgtggagattcctctttctcttgccatattatttcctcttaccgccaccaagggacagcagctccaggctgcggtggagaggctcgtcgcgggaccctcttgcaacggctgctcgtgagagagaagtggcccttgtctctccaaccgatggattaaccctctgcgtgctggaaggacggcttccactgcttgagaacaacctgcttgtccggctgtattgctgctccattggttccaccgatgaacctggcctgctgcttgacgcaaccgctctccttgatgcactgcctgtacgggaggatgtacggggtctttccacggtcctttcgccggaccggtcggtgctatgcatctgagaaggtgaaccatttcatgatcgtcaaattacacgtaggagagatacacaaggggaagacattatacagcataggaactggactcctatctcaagttcatgcggggacggattcaacttacgatttcctttagtgacattgacggccgttgtgcataattgtcactctgattcaaagaaccagtaggattccttctgccagatgcttcacctgcttaaaataagatgttcttacgggctgtattgtttgtattatagttttgttaggcgtctttcatgggtggaagaacagacctggggccttttccatcttctccatagaaggtcccgcagctccactggttctttcacttggctgaatcaacaagaagaacaaagtcaaatcaagtgtatcaaacaggagagcattgtccaataattataacagcagaatgcataccctcatcagtggtttggagcctatctggggatatttcaaaatggtccagtcaaatacataatcaaattgatatcctgtatcaatgatgccattagaaatgtgcagaacttatcctcagtttaaaaaaaacactgagggaagatggaaagaagtacaatttatgatcatgaggtaaggatttatgtttaagagaacataccctcccggataaagagatcacggaatagcctctttaagtaagaataatctggcttgtcttcaaacctcaatgaacggcagtagtggaagtaagaaatgaattctgatgggtaagatttgcaaagaacctagctcaaaaaacaatataaaagtgtcagtttgatgcagtttgatctttgaaaaaaacaagagcagataccaaaagtatatatcatgaattacctccacaggagtaagcatctttttctcacttattttgtcgtacttctgcttcttagtgcctgctttcagcccctgccatggtaggctgttggaagttgaatgatagcaaatatttagcattgtttacagaaaatgatgtcaaaaacattacaagaaaaccagatgtctgcaatgctgaatatcacaaaccaacctgcctctaaggaagtacataaggacataaccaagagattctagatcatctcttctgctttgctctgtatgaacataaaacttaaattaggcaaaagctcttatcaaatgtactccatcagctagaagacacagtaaactcaccaacaccaagatgggtattgacacttgcataccgagctgttccagtgaggttcttgttctctctgcataatgaacatgacatcaacataaaaaaggtgaaaagagaagtgcattgagatatttgccaatgtccttataacattatacaattttgtgctggataacaaataaaacaacagcatatgcagtaggcataggcgtaatttaaagttgtacaccaacctgtatgggatgtgcttgtgagtctgaaggtccctatatttcttcgcaagcccataatctattatatatacctgaaacaaggtcaaaaatagtcaaaattaactggattcaagatttgctaaccaaatcttgtttctttctatcccacaagttatctacaattatta

SEQ ID NO: 28496 - DNA, 1013 bp, Oryza sativa
caggcccttaaaacccaagccatatcattctactggaacatctttttggaccttcatagcaatgaagagcaccaagttacgaaaaatttaaggcgttagggcaccactgtatcaaatggaataccatgaaactattgatgtggttaaacatgcagaaacacaaaatggtaatagccaggtaggaacgcaaacctgattggctttcctaccaagccccataaggaaattatcaggcttgatatcacggtgaagaaatcccttctgatgcatgtactcaactcgattgatctggataacgaacaaatggtgttacgtcaggaatctatatagggcaagatacagataccagtttgattctacaacgattaacaaattagaatatatggattgaggaaatttgaaaataaagcatcagtgtcctcaccatctgatcagcaagcatgaggacagtctttaacgagaatttcctactgcaatagttgaataggtcctcaaggcttggcccaagaagatcgatcaccatcacattgtactctccctccacgccaaaccacttcaagtgcggaataccagctttagccaagaaaaaaggaaggtcaactcaatcataacagtcatagaaggcgataacaaagtaacatttcaacaaaacggatacgctaacaggctctaggcgcaaacttacttcctccctgcagaagcatgtacagcttcgactcataatgaagctgtgggtgcttcgtcttaacattttcctgtgagaccaaagcaaacaggtcagcaacaccaatgtctgaaaggtttcactataaccaaattcccaatagtaccaaaatagtaccaaaggaccaacattcgacacaaacattttactacactgttcattcccatcccatgatctcacggtaaataagaaattttatcaaattattcttcccccaaagaaaaagaactcttctaggtgcatcgaaaatggaggacagaatccaataccaatttgacggcgacttcct

SEQ ID NO: 28497 - DNA, 777 bp, Oryza sativa
ttttagtttatctctatagtcaagtagataatccgagacaataattcacttagtaatctaaattaaaatggtccatcatctccgccatgagtttcactcttcaaatatggcgagttccatcacaatcaatcatgccataacttcttgtattttattaggagttgttgcccctagacaattttttctctactattcgtaaaatctgatcccgtccttgatacattgacatgagcactctcatcgccagtttcatcaattacagagagtccttaccatgctcgtgattgcatcgtcgtcaccaaaatggcttatccgcctacgtatgtacaaggtcgacactataaggacatgttttcatccgcctatgacatggccaccatctatctcggtgctagggttctagacattggtcctactccagaaccactgaaggcataggcggaaaaaaaaagacaatgtccgtgagcataacatccaaccaaccaaaaggaatgatgtcgtttagcggagcaattaaaacgagtcaaacaaaacagttatagaataaatattatatcgacgtggaaccagatcatgtcgtatcccattttgagatctatacgcacgtcaacccttatcctaagaatgccctatcctacctttagaagccacctaaatactcatatgataacatatttacacgcgcgagtttcaattctcaccgtacaaggcattcgaaggagtaggatattatgattttgatttgtttagagacacaaatgcactccttttatcaaa

SEQ ID NO: 28498 - DNA, 683 bp, Oryza sativa
atgggctggtatcctttccacgccgggattttccacggggattagaccccgatcccagccgggaacggcccaaccgaacaagccctaacggggaaacttaggctggctggccacagcatggacctcactcatctacagtaaaaatggtcggagacaaaaggaaatcaaccgaagctggccaatacaaacaatctattctcagggatgcatgcatggttgtgaagataactgagaatagaaggcaaaatatagaatctaacaactagcttgagttcatacggtgtgcttgaggtgaagtaaatacatgtttaaatgtcacaaataatttaagaagaatattaatggaaagaaacggcaacgtaatggagagaatacaaatcacggatagactttacaattgctcttacatgcatgaaggtatatttaaagttgaatgtgccataattgttggtgaaacggctggggctctaataatagcagcaattggagagcaaataaagacctatgattttattgcagcattttttaagactaagctatatatatgtggtctccatatttgcaggacaaatatcctataaatcattcacagtcaaagattctaaagtttgacatcagttatgataagtattaattatcagcctggaaggggaccatagtaatatccttaggatatagctaga

SEQ ID NO: 28499 - DNA, 654 bp, Oryza sativa
tctttaacaaggtaagagtggcttggctttaaaaaagctaaataaaaatgttgcttatttgtttatgcttaaacttcttagcttataaatcagtttatataagcctaaacaaagaggtgttattataatatgaaatggagggagtactatttaggagaacatttgttgaaactcttcaaactttaatgacaaatatttttttcaaatgcttagttgaaaagaggcatgcgtagatttgctttggtgaacactatcagaatattataaacctatatatattagaatttacagatttattttaatgtaaaattgatggtcaaagttttgaaagtttcacttttctaaatatcaattattcattaagagaggaagtatcggtatcttaccgctgctatgctcacctagggcgtatcggccagaatatatttgtgctcggacaatgcagatgagatttgctcgatccaagaaaaaatatctcgttggatgtaacaatgcacatcggaaacgatttagtaccgtgaggtaccagtacttcaacatacattttgctggaccagagcaaatctcggatggagatagctgttgcaactgtctgattctttacagtttgtagcatttcaaaatatattctcaaagcgtgtttaccatggattg

SEQ ID NO: 28500 - DNA, 730 bp, Oryza sativa
ttagagctacacatttctagttttgtggttaagagacttcaaacaatctcgctgttaagttgagggacctccggcgaacttattccaaacagaaaacacgcatggcctgcttggcaaatgataacgaacaaatggcccagaaactttcacagttgcttggttgctgcttccgcttgtagcttccatcatatagatagtgagatgttatgatctcaacttaatgaaatgaatggattggccaattatattgtattgtatactgcatggttaccgtcacaaaagatgcgtgatccgctgatccgcatcatccagagttatataatgggagaccaaatggaccctgaacaggtaaaaggaagcatgtcgggagctgcacaatatttcttctctttcgttctcaagcgcaatacacatccgatttgtgctctaccacttacatcaatcatgcacacattcatacgcgaaaaggaaggaattgcttcgacgagcttgaacatgcctatattattctcgtcacacaaacacaaaagtcaatcatagcgccaccggaacaacgaggagccggataagatgacttcttcatcatttcataatagcaaacaggacgccagccaggcaacgtcaaagaaataaaaaacaggagcagacaatatcgtgcatgcatgtcactttcagttttggcaagcaggcaggcaagtattccagcctttcttatttctcttcgaccaca

SEQ ID NO: 28501 - DNA, 1224 bp, Oryza sativa
caggtctcgggctacttctcctcgctgttccccgccaactccacctccccggagcctcctggaggagcagcgacgaatcggcgaggatcgagcggtggtggtgggttctccgcgacgggtgggcaagcgggaaccaatggctccagtacagttgttgccggtgagcagggaagaggagttgaagtatcaagcagcaatgcgggaggtgttccgagcggcaactccccatccggcaacgctactgcggcgatgcagagcaacccgccgcccaatgatcaagcgggaggcggtgccgcagccaataactccaccacgggttccgccggcgaggctgcagttccaagccgcagttcagccagaaacggcacgatgaccaaagatggtgcccctgatcggatcaatggcaccgacgtgatcgcgagttcatctggagatgtcaccgcagtgaaagctaatgcaagaaatgctgccgggtctactcaccagctaggtggtgcaagtgcgatcgtagattcaagcaatggaactgctgctccatccatcaataagactgggaatgcagcagtggccacggacggcaatggcgctgcgcctcagagaggaggagccccaggcaagaaccagactgtcccaaatccgccggctgcactcgatcagaacaagagtggaagcagagctgctgcttcaggtggaagcaatagtacaatggatgctacaccacaggggattgctagtaacaccacagaggctgctgtcgatgccggtggtaagaagaagaaaacccattggattgaagcaatggcgagctgcgatatgttctatggaaattgggtccgagatgactcataccctctctatcccgagggatcatgtcctcacatcgatgagtccttcaactgcccgctcaatggccgccctgataatgcttaccagaggctccggtggcagcccagcggatgcagcattccaaggtgagttgagactacttgagcaactctgttttattcagttcttggtgtttcatgtgacacagctgaaaattcagttccatgatgttcataacagattgaacccgagtgacatgttggagaggctgagggggaagaggctggtgtttgtcggtgattcgctcaacaggaacatgtgggaatccctggtttgcatcttgaggaattctgtcaaggacaagagaaaggtctttgaggtgtcacccagccaacaatt

SEQ ID NO: 28502 - DNA, 1523 bp, Oryza sativa
  unsure (1)..(1523): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctaaggagtattggttcaagtccccgttgaaaatatatgctattgaacctttcaggtttattttggtagtttcttgttggtctcagagtatttgccaatgtatttaagccaactagaaattgacaagaagtcaaaaagaagttgctgtttagcattgaaaatactatggatcttgggcatgataatgactaattgattattccatacttgtgaccttagcagattgaggatgagtctcatgaaattgatcatgcagaggaacaccttagctaggctggcaattctttgttactttctgttctgtttgccatcaatattgtcagtatgagcatcatttgatctgattgcactgatgccctttatctatttattgccccagttgcttatgtaaatcagaattgcatttttttctaaccctattaataaaggatattcatcgaaacaatttacacctttttatatcttattggctaatactttttttttgtcttctgttccttgataaaggtgatgatattgctggtcatccctaaatatgttgggttatcaactgcaaactatgctaagaatttactgcgtatcactgttcttcttcagtatgttccccgcatcatcagatttgtaccattgcttggtggtcagtctgactcatctgccaatggattcatattcgagtcagcgtgggctaactttgtgattaaccttctaatgtttgttttggcgggacatgttgttggttcatgttggtacctatttggattgcaggttagttcagcttctatttcagttttctgcacaaaaatattgtgtttattcatgttgaaccagtagtttttcatctggggaaattgatagtgtcacttaaatgttgaaatagggaaaccactcaaatcaacctttgcatccactcaaatattgaaacttaccagtatgccctccctttgtcttcttatttctccattctcctttaccccctcacaaagagcagcagtacgactgttccctctccctcatcattggtgccacctgctcaagcttcatcgtcatcacacacattgcaatggttgacttgtagtgctatctcaacctgctcaagcttcatcgtcatcactcgcctggatttttcacattttggtccttttgaaaaacttatttcgcaaatagacccctgaaaaaacttatcccagaaatggtcctttttggggcgtcagagtggctggcgccgtcatccaacgggacggcgccagcctctctggcgccgt

SEQ ID NO: 28503 - DNA, 16570 bp, Oryza sativa
  unsure (1)..(16570): unsure at all n locations
tccccctagctacctcagcatcgccccgccacgtcggcagggggacggcgccagccactctggcgccccaagaaggaccatttctgggataagtttttccaagggtctatttgcgaaataagtttttcaaaaggaccaaaatctgaaaaattcacctcgctactgttgtggccagccatgtcagaggtctcagaattggttgcagactagaggggttttataactcaatggctgatggagcctgtcagagtctaggccaccagaggtggagagcaattgtttggaaactgttggatttttgggatgaagagaaatggtgatagacagtggggtaggcatgcttttcttttcatatggctcgtaatcggcaaagaacaaggaattaaattaagaaatgcattttatggatgcaacactgactcgagtggcattttacaaattccaacaaattgaatgtcatattattaattgtttccttatatttggagaactatgccatgacaatgtgtgctttattattgctttattattgatacggagaaaacatatcttctgtttaatttgttgttttcatttagattgcattttattgtatacatgctgatttccttgtgttnttcgccgggccggcgtaagatacgcggccaaagtttattaagattgagaagaggttcaaactagtacaacagatacagctgccatggaggctaagagctgtacaacctctattgttacaacgatgcacatttgatttccttgtgttaaaaggggtgattgtaaattgctatattcacctgctccttttaagttgttcacgactcctttggtatttttaatagaggacttgatcatatcaagctactcaggagatgttaactaaagtagaggttcatgatgttattattccttttattttcatttgacagagggtcaaccaatgcctacggaatgcttgttctgcatcaaaaattccatcttgtgatggttttatagattgtggacgtggcattaatattgggaagcagaatcaactaagcagacagcagtggtttaatgattcagcctcaacagcttgtttcgacactggagacaacggtttccactatgggatttatgaacaggctgttttgctaactacagaggacaatgctgttaaacgttatatatattcattattttggggtttccaggtatttgacttttgttccttatattcttgtacttaagttgtgtctcatttgttccatttgatgtataaggtttctatacgtgattacagcatccatgctaacactgtacaattttgactaccctttactgatgttattttggtttgacgtcagcaaataagtacgctagctggtaatcttgtcccaagttattttgcatgggaagtcctgtttactatggctattattggtttggggctgttgcttttcgcattacttattgggaacatgcaaaattttctccaagctcttggaagacggtacgtggttatacatgcaaaatttgctagtgtttattgtgcaatattgtctaccttacaatcctgagatggacctctaattgttgtgttaatacacatcaggaattgacacctctatatagatataagctgtaccagctaacagaaaaaatatctagtcctgattctctcttcttctttttttggataggagactagaaatgcaacttaggaggcgtgatgttgaacagtggatgagccatagacgcctgccagaagatttaagaaggttcatctacataacttctaaacaaaattttactaatcttttctttaaaaaataacatcatatattccttaatcttgttgcaaatcgcaaccatttattaattcagactattaatatgttgttgttttttttgctttgtcttactttttattgtttatgtggctcctattattcagaagaagaaaaacgtgtacatattcaacagttatcaggctgcttttcttgataaatcatcttataagtggaatctcatgcaagctatgatctgtgttacagatctcattttgttttgtgggtaaaacgaatgcatgatatattttgaggaaacagatttagtggaaacatcatttgtttgatattgaaatttgtcaatttagttaccaagtttccatatgcagaagatgcacaacagtctcatggcaatgtcaatgagatacctgaattttggtttgctacattcttttaggatcattatttcgaactagtttatttgtgcggaaatcaatttttaactcgcccaaaagggtgcaattttatcttttctttgacaccaaggattgatattgagtatttgccactctaaatgtgcaactaaccaacaatcgctactcagtgtattctgtcgtctttaagaaaaatgagtgtcagtttgtgaaatgttcgaaataggcttttcctctttgcattctcttcttcatctccacaatcttaatcataccagaagttaaagatttgttggagagggagggaatggtaaatctggagtattcctataatgggcaaagaacacaaacttccccaggcagaacatgaacttttacatttgttggagttggcaagcaaatgatttcctctttatttttggactggaagattgtaatacttaatagttttatgaatgtccaggagggttagacgcgcagaaaggttcacctgggcagctacccaaggggtgaatgaagaggagcttttaagtaatttaccagaagatattcaaagggacatacgccgtcatttctttagatttcttaacaaggtttgtttatatgaggactctgactgttctgggagagcaagcactgcaactagttactctatcacatttttactttccatgctcatgatgcatttaaaatttgaggttgctgatgatttacccctacaattttcaaggaaatgctgactacaattattttgcaggtccgattattcacattgatggattggcctatcttggacgctatatgtgacaaactaagacaaaacttgtatattagcggaagtgacatcctttatcaaggtggtccagttgaaaaaatggtcttcatagtgaggggaaagctagaaagcatcagtgcagatggaagcaaagctccgttacatgaaggtgatgtatgtggagaggagctcctgacatggtacttggaacactcttcagctaacagaggtctgcagtttttgcattttgtgtttttattgttttctcttttctgtgatttatatttggtaagtctccatatttctattgtttcagatggtgggagaatgagattccatggtatgcgtttggttgctattcgtactgtaagatgtttaacaaatgttgaagcttttgtactaagggcaagcgatctcgaagaagtaacttcacaattttcacgattcttgcgcaatccacgagtgcagggtgcaatcaggtggagacttttttctttagtgtcacatgatcatatatgctcaccagaataattctctgattcaactagaattgtgtaggcttatgaatggtttatctgttgatttaaattaattttaccataagttagttgggaaaaaactaagggagttcatcatgcatcacagtaattgttattagctgggatatttgggataattagaaactactacggtactctgctccatgcaggtcatgcattcagttgtgtcagttgccgaatatctatcttctatgatatgtatgacaatgttcactaatgctggtgcgctactgttgcaactgcatccaacaggtatgagtcaccctactggagaaccattgctgcaacgcgtattcaagtcgcatggaggtatcggaataggcgattgaagcgagctgggatgtcgaagttgaacgatcaatcttataattctgcattggaacgtggcgcgcgtgaatgtgatgctcgtcagcatgggcgggtatgatttggatcgacaaggtgctaacgtttggtcacatttttatgcgctagagccctgacatccttgtggctatcttacttggcagaatgtattctatgtgagctacataattttttttttgccccacaattagatctggtagctagagtaccaaactggaggaactacatctcatgtatataatgacggctagtttttcactaataactgtttcattcttggcctgaaatcttgcctgcgtatctgctaagcaattgtgttagtttgttggttgcctgcaactggatcagggctcggcaagctgttgcgttaaagacgcttgtctcatggataagctctcgtcgcggcggggtgggaggccgtcggttcgccgttcccgtcgtcggtggagcagattaacggtacgatatgccctgctgcacactgatcgtagggtcatttttagttttgcttccctaccaaaattgtgcatttgcttttctctttctttttttttcacgcgtacgtttggcttttgaaacgacctcaaaccgctgtgttctggggtaaggattaggaaccaattagtgcacgattaattaagtattaacttaaaaaaactttaaaaataagttagtatgattttttaaaacatttcttctatagaatgtttatataaaaaatatataccgttttagcagtttggggaagcttgcccgcgaaaaagaagagccgaagacagcctaaactcatccgagcacaactctctcaataaaaaaaggaaaaagaaacagtaaaaagtgtgcaagcaaacgggccggggacggatgctgcggttgggcctgcctgggagcccgaagtttcttcttcaacgacaccagacgccgggggtcccgctcacactgtcgcttggctcgccgcatctcttccctcctcgcaatcacaagccgagcgggcgggcgcgcggcggagaaaaaaagccgctggcgctgcagctactcacgcgcagccaacaactccaccttgccgtgcattgtactcgtcccaagcaaacagcccgtgctgctctatcagcgcctccaaatttctggttcaggatcgagagatcgccccgccgagcctggcgaacttgaggtacccctggtgtcgcggtgaccacacgccgaaccggttgtaaaccatgattctgcacgcgtacatggtgtcccgtgtacatgtcccgcttcatctccaacacccttctccctttacgcaacgtgccgcacgggcgcgggcactgcccaacgggagctgaaggggcggatccaaagtagaagggctggtatcaggtgacaccgatgactttcgacaaaacatatagcgaaattgtttatccatatgttataacactataatctaagcataattagcatcctatgataccgatagacacgttatgacaccaacgaaacgattctctgaatccaccaccggagcttccagtaactgtgtcgcctccatatatatgctcacattaaggtggtgtttgaatctacttaagatgaagatgaacataaatattaattgtttcacgcaaaacgatgtggtaataacatatgattaattgaattttaattattacaaacttaaaaaatggattaatttcatgttttagaacaactttcgtatagaaagttttcgcacgaaacgaaccgtttagcagtttaaaaagtatatcacttttatcaaaaagtttatctagtttttattggaaaaaagaacagggccttacagttaagcttggtgtggctctcgtgtatgtatatttcctccatccaaaatataagatactttgattaatgtgatatatcatagtacgtattatatgttggaacgaatggagtatacgggaactaggataaagtttgtattggatcggaggtaggaacgttttggaaacgcggataaagtttgtattggatcggaggtaggaacgttttggaaacgctaacgtattcgtattcaactattcaaggtatagtcatgaattgatgcatgcgcggcaaacccttcatgtatagtactagctaaatacccatacattgcaaggaggttgaatatattcttttgttctttttcatagcttgggaatgaatattctgcgtgcttcactgtttattagtggcatcgacatgtcagctgatagtggaagtaagtgatgacagattcatcaatttctagtccccacatgtcagttgtgcgtggtgacgaattcacccctcaccactacgactagagttttaggagtataatatgcaactggtcgtattcagacggttgtatatacacaatgccatgccattaagcaacgggtcgcgcatggtacatctctaactagctccctcgcatacggatttttcactagctgcatattttcccttctattaatctcgtagcgacagagactagactggatgaactaaatcagatactaccttcttttcaaaatgtatgatacattgactttgcatacaacgtttaaccatttgtctcattaaaaaatttaatataagtatgtaaaagtataagttaagattatgttttatttgatgataaaataagttacaacaaaataaataatatttatatatatttttaatcagatgaatggtcaaacgttatgtgaaaaatcaataatatcatatattttgaaataaaggagtactgtattttcatgaaccactgtttcattcttggcttgaagcattgcctgcatccctgctcgcctacatgctggtagctgtgcaaactggtgaccctgcacctcagcacctggatcaggttagagatgcttgtccgttgctacacaagttactcagcttgtgagataacagtgtataccctattgcacgctagcactagtgcattttttttctcagcattgcagctctcaattaacaacaagggtcatgattcatggacacccgaaaagcaaccaaaaaccctactaattttcacaaaaagaacatcactatcgagtcacaactcacaacagctcatcaactgatgataccactaaacagttaggctgagcaatcacagattcacagtttgctggattggaatacgtatgtagtaacaatctttctacttgtcgcggtgatcgtagacatggccgtcgccggcggcggcggcgcggagcacgacgtggcgaatgttgtgtgcacgaactcctcccagccgagccacgatcgatccctccaccgccggatcgaagctcgccgagaacacgccgtacgggacgccgaggaggaggccgaagagcaggaacgccacccagagcggaggctgcaggtcgagtccggtcaccgcggccgccgcgcgcagcgccgcctcgccggcacccgcgccgcgccgtccaccgccacagcacctcctcctccgactcgaggaacgcgagctccccgtcgcgctcccgccgcccgacccacgcctcgtcgctgatcgacgcgtccgccaccagcagcgtcccgaccaggaacgacgcgtgtccgcgtcgatgagtgcccgcaggaactcgccctcctcgccgccgaacacggtcgcctcatcggcgacgccggcgtcgacgaggttcttgaatgattaggcgggggctcaccgctcacaagtgcagcacgccacgggtcaccagacgtgcacgatcttaattaggagtaccatgtaagtatgtttgtcatgttcttcggtccagttgattaacacttagagtcgtgtggtgatgttaagatagtatccgaaatgacctatgggaaagaggaatttacgaacattttagaaacgaactaactcgtgtgaagatttttgtaacgtttcagcgttccaaaggagccctcagctgcgagttgaatgttcttttagcataaaacggtcatgtacaactacaatctctattaatctgaatatatatatctgactacaagtcttaaaccactttactgagtatttcatggtttaatcgaacaaagtgctgtgaaatcgagttaattagtcagtgtcttcatcttctacttcttcctcatcttcgtcttcctcctcctcgtcctcgtcgtcgtccacttcgtcgtctatggaggaatgcttggccatggacagttcgctccagtggctagcggcgagctcccaccccaccagcgagcccctctccgcggcgttccacctcgacgacaggaacccgtagtggaaaccgagcagccccacggcgaacagcacggcggagcccgcggagccggcccaggccggcgccgcgtcgctcgccgcgccgtcaagcaccctcaggaacgcggcctccgccgcgaccgccgccgcgggtggcgccagcatccgccacatcatcccgcgcctcatgtcctccgacaggttgagcccgagcccgagcccgcccgccgcgcgccattcttggcggttcttggcgacgtcccccctcgccgccgccgcagcggtggtgtcgatgacctcgacgttgctggagcttgccaccgccgccggccgggcggtgaacacgccggcgacgcgtcgccggctcggttggtgaagcgggcgtgtggcggcgcctcgagaagggaggagcagcaactccatggccgcggcaggtgaggtccggtggtgcgagtgagtgagtgagaccgtacgtacgtttgtgaagacgagaaatgcgttatcctatcctaaaaggacctttctgggatagcaatgtggagatatttttttgcttagctttgcagtgacctaaccatgtgtcagttggcttggtcactgggtgagcttcacagtcaggccttctttgactttgaaacaaagtattgtgcctataagaaaatttcctgtttggctctttaaaacagatatttgaagcttttgaaatcctataaaagtcatttggaatggttcatgtagacttctagagaaattttctttcagtctttctctctcatctaactctatttttatttgcatcgtctgtccatctatttaaaagaccgtttctatgtttcttatgtgtttttagtattttattgtgtattattcctactaaaatcccttattttaccatttctatgttccataggggtctcaattttatttcatcaagttgaattgtcatttgaacaagtagtacacacaatggcaagctcaaaaaaaaattaaatgaatgatttactggatgttgcctcacaatcataacaatctaatgatgctttcctgaaaattttggagtcaagacaaatctatctctactacgtttgctataaaatgttacactttcaatctctaaattaatgctatatttttactgttcactcccagacgagcccagtcgacccaccagtgcctgaccatattgtcctatctagggattgacccttgaaatcaacggcacagataattcccctgcaaaatcgaacggatcagagtgcatttccttccattaagacataatcaccgattaatcacatgcatgaagctaagataataaggtaggttccccacactccaagtccattctgacacggtttttttgtcccaagcaacgatctcatgcactctctctggctagttgttccattgctgcctccagctagaagccatgcaagaagaggcaactgggcgatcgagctctactacagtggctagctagcttcccctccacatgcagctttgagatctgctagctcatccggatctcctctacgtgctaccatccaaaagcatctaacagacacatcatttttttgccctggccaattttttaaattttcttttttcttcttcttgatctcctgtgttcgttttgtgcctctcgtgatcatgcacaagctgccctacactgtgtctgtgtgtgtgagcgttaatgtgaagacggtttgtacgaatcctatgctatggcgagcgtgctttgatgagcctagaaacattggtagactagagcatgttgttagttactccctccctcccaaaataaatgcagccatggtttttcgtgcccaactttgaccgctcgtcttatttgaaaattttttgaaaaaaaaataagtcacgagtaaagtaccattcatgttgtatcatctcataacaataaaaatactaattataaaaaaatttcaaataagacggacaatcaaagttggacgcagaaacttatggctgcacttgtttcgggacggaggcagtagtagaagaggttatgatcaatgtactgtgagtacttaagtggctaagtactgccttgacactgacatccttcccctgtctgtcccggacaggcagccttgcgtcgcgtcaggctttatccggaatgttgcttccgctttccaggtgataattttgacgcaagtaattgctcgatcgatccgtgtggctgtagtacgtccatggatgtcggatcggagacgattgcacgacgcaaactaaatgcattctgacttcacgaattttttttgtggcttttttgcgtgtgggtgatcgatgaggaacagtgagatcaatgcggttgcattgcacccggcgagagtgcacaacggttttgcatggttttggatcctgggaatgcaaggggatcaatggaatctatcacgggaaattctggtcaagagcagatcatctgcagtgtgatcttccagttcttccacgaagacgccatggaatttgcaattcacagaaaacggaacatggaattcacattcatgattcaccaccaccaccacctgatatgcaccaccatcaccatagaacaaaagaatcttgcagttgaaccgatcgatcgatctcgcgtcgtctagcatggccgcacgaccggcggctcagccaccgccgccgccgccttgggcgccgcggcgacagcggcggcggcggtgttcttcctcggctcggtgcggccgagctggccggcgccgccgcggccgccggtgacgctccgcatccggcccttgccgaggtggtgctcgcagagggagtagccgaccagcgtcggctggctgcagcgccacccgcgcccgttcacgcggctgcaacgtgacccctccatcagcaccgccgggccacgccgcttcttggctccgccgccgccgccgccgtcgttcttggtctcttccttcgcgttcgcggccactggcattgcccggacgacgccgttgacgagacgctctcctgtagtactcctgatcgccggatcaggcttgctgtaatggccattctctaggctgcaaaatgcaagaacatcatcgagtcatctgtcaaccatctgacgaacaagcagctacagcaatgaatccaacccaatgcaatcagagatgcagcaacttatgatgccaaacacaagggaatagttcacgacgctcgcgacgcacatggtccatgtctgccgatcgatcagcatggcttgcacggttgcaccaatgcgatcatggaagaggacaagcaaaaaacaggctgtaagagaggcgatcacacaatcagccatagaacagccatggaagtggccgatcgaagatgccaagatcgagggtgcaagagcagtagtgcgctggatggattagcagtaaagaagccaagaacactagtagcagtagtacatgcctacatgagcagggccgtgtattaaattggttggattgatgtgtgtcatgtgtcaagctggcattgcccagtataaaacagtaaaaaccaagcccagaagatagaaaaagtcccttggatgctttccctttccatttattactaccccccactaccgctaccaccactactactgtcactcacacccacacaaatgacacaaatgacacaagttagcatagcagaggcactttcttgttttgttcctgttccagtttcagttgttcttcacatacctcctgtgaccatctgctgctccctgctgtgcaccaccacggggcctgatcttgctgcattccacaaccgcattgtcctggcaaaatggcatcaatccaaaaacatgggggggggggggggttagttagataaatctgggcatccgccataaacgggtgtggtgcaacctatgatgatagtaactagtaacaagaatcattcataatggcaagtttcttgttttctctgtcgttggagcagattgggatcaaagggggtagtgtatacctgcgggaacaacggcaatgccgcggccgcgcgcatcgccgccgacgagtcgtcgtcggcaagatccgcatttgggtgcaagtgcaaccgctccgacttttttctcctcctcatccaccttgtctaccgagagccagtaacgtccatggtttcttggtggaggctggggagcagtggatggatctgaggagggatgcagggaggagagagcctgcagggactgaggccgcctcctgatcctcatggatggatgagagagaaagagagagagaaggggtgaaggaggagagagagagagagagagagagagagggagcaatggagatttggggagggtgcaaattaaaggaggggggctttggggtgttggttccttggttttggttggccttttatgcctcatggatggcatttatttatgggaaccagtaagcacaataggagtagattggtggtgcagtttttacactttgcatatttgcgcattgttgccttgattggcttttggccttttgggtttgggttggtttggctttggcctagtaggagatgagatgagatgggtgcacttatcaagactccagaggtggatggatggatggatggatggcgtgagtggtgggatgggtttgtttttgcatgcaatacgccatgtgcattagaactgttgtataggagatgggatggagaggcaggtgagatttgtctagtggacagtattgctatgcgtacaaatgaacaatacatgtgggggaaaaaagaaggtaggtgtacatttctagatctatggtttgtggttttcagttggcatgtcttcgtttgaggttccaaatgggggaggtaaagactgaaagaagacttgtgtgtgaattggtgtgatggatgtcttacaaataaatgtttgcataaaacaattttgtgcatgcgtttttatatccacatggttagccttaactcgtgtccgtatttacgtttaaaactgttcgttgattgtgagtttgattatcttccttaaataacactttatcctagcacacttattatgattatgagggtaactctagtattggttcgacatgtgtggtccatccaagcaaacaaattttcggttagatcgtggcagcgtgaaaattgatttgtgggacccacataaagtcaatctcaatcttacctacatttgccctccctcttgtgtgaccccacaaaaaatatttttaattggttacgatcacttctcttttgaagtcaattttattaatgatatactatagattctcataatatgcgcggttggaacttttggtgcaaggttcaatttcagtcttacattggagttactttgatgtgtatacacagttagtatattattttttgaaaagaaaatgttccataatagtccaatagccattaggatttaagagaaaccaaaacacgcaaagaaaaggatggcaatagcaacttttctctctcttttttttacactgatttctctctctctgtataaagggatcgaaaacatcgttttcaatgggattttttttactatctaatagtttgctaatgttattttcttttctttccaggtaggcggtttatcgcctaatcttgttagaggatcctggtgcatgaagcggggttgcccataatcgtggaattatccatgatgtggaataaatgatactcgcccccttctctgaaatacatgctattcaacacaacggtcgaactccactaacttctattttatgagttatttgtgatacacaacaaaattatgctatcacgaccatactcatttctataggaataacatcgtatatgatatttccatgtgtctaacctaaatattgaattcttgttttttttttaaaaaaaagtcaaatacaacgatgtattcataatcagagcatatagatctagaccactcacatcatgcaccagaaagtataaacacacaggcgtctacgaggcaggtcggcatggccttcagacatggaccatcagatggttcggttctgtgaatcgatatgcagctgatgggcaaccatctgatgggcatttgggacagaatgcgcacatctagatcctgggcgcacgtcctctgtcggcatgcatgtacaggctagtacaggcagcacataatgctccaaaaacccagctagctaaatggactcaccaacagcagactgctaattaatcagacaccacgtcgatcacatgcttgcaaggtagtactagcagtatacccatatatatagtccataccaaacaaaagcttcagtaaattatcggcattaattcattgtccaatcagccagaaaaaggtatgtttcgtcctcatgatccatgtataaacccaaataaaatgcgtatttaatttcataccatctatttaaagaggcgagaaattaaacgatgccatacgacaagggaaaggaccagcaagaatgccagatgcatggtccatgcaaaatcaaggtaaaacaccactagcagacaatagcctgctttctgatttatgtccccaaccaaagcgtaaacaacgtttgctacagactacagtgtagcaactagtacgttcacatcaactgcaagcatttttccccccaaaggcgaaaaaaaattcagacggcaaatgttgtttacgatagcaacttctgaggcttctacctgaatttgcaactcgtctagtagcaatgtgcagaagcgcattctgaagcttctacctgaatctgtgactcgtctagcagcaatgtgcagaagctcatatagtcatattgctacagcctacaggcctaaattggaatatgaattaatgatgagctgtttaacagggggtacttctcaatattcaagagagataacagctgagttgaaaccagaacagaaccatgcagcaaaatagtacctatgcaggatctcatcaaagttgaaactgctatcatattcaggtataacagctgccgtacttgcatctgacagatttaaccgaaacttcagtagtactgaaaaatctgttgtacaatcatattacctgacaaacttacttacaaagaacttaagtacgaatatacacagaacgaaacaccaatcattcaggattcaagagattgaggtgtcaatacaactatttctctatactttaatatatccaagaagaactcaaatgatactacatcaccatgctaagaatgtaaaaggtagtggtcagataacaaaaatggcagggattcttggaagaggatcctatatataccatctcatgtatgctatattgttgttctctgtttctgattaattctagctagacatgaactttacatcataaaatcctatgagcctatacagaatacgtgttggtcgtatatcgactgtcagactgtgactaactgactacttctctctatgaaaggataccaaaatccttaacctcactcatacaaacaacagctcatgtacaggaacaagtaattcaacacacttgcctttattggtgcaacatttgatgctgtttaaccataatctgtgcgtagagaagctcattccaggagtcgggtactccagggaggcaccagtggctgcagtcctgatatatctgaggcgatttcttctcctcctcagtcaacttctgcttgcggtagacagaagggtgtgcctccttcctgtagtcagtcatccttgtgatattcaggtaaacaacaggtgttttcatcccactgagcacgtcctccaggatgctcatcttccgtgggtatggtgtgaggaacttctcatttgttattggctcggtttccttgtcgcaactgcctcctgaattccattggcccccactgcacaatcgaaacacacaataaacatgatgtcagcagctactccgataacatgatattgcacatgatcaaactaaacttgccagaattcagaaaaggttttgccaacctgaaatgggatgatgagtagcctctgaagaacacagttgttttcttgggatttacactggaatcaacccacttggcccaggtaataagagctttctggaaggcatcatcaacattcagctcactgtatacacggttaccctcttggtagtaatctttcctgtgacaggttcaacatactaacagtggtaagcaacacttgaaatgcagaacgcatggcatgcagatcttcagcaaaatcagaaagcaccaattccaacttaccctagagaagttttttcatgagtccaccagtgcccggtattgaagatgatgatatccgcatccttgtacctcgggaaagagttgctgatcatgtcaagcctaagagtttccttggttaaacccttcctgacggggaactcccattcctgaacaaggaaaggggagcggaagaactccacgctgcagttgtagtcctagacaacaggaaatttgcaaatgagcattcattccttatgctgaaattagcgcagatgccaagcatgagacatgatt

SEQ ID NO: 28504 - DNA, 4029 bp, Oryza sativa
gccgccgaggtagccaacgtgatcggccacgccgctctgcttccacgcgccgcccttcatctgatactgctcgcactcgcgcgcggcggccgcggcgagagctcccgagggtttcgatcgaagcgggagaaggagtaggcggtggcggtggcggtgggggaggaaaggaggcgctccgcgggtggagagagtgatctgcggcggaggattttgtaggggaggagacggcggcggcgccggcgcggcgcgcggtggcggcgagcgcgaggtggtgcggcgggttgggagcgaaactaactttcgcgatctttttgggtttggggggatttaaattccgtcgcgttttcgggtttagtaggaacgtgggcgacatgcgcttgagaatcgctcggggaatttgaatttggctgcgctgtcaacagcagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctggtcaacagtcaatagacggcgaatctagaggaggattatggcaattttaaataatcatcactgcgataattcacattgctagtgtacgtattttaaaagaatcttacaaacaaatatctcaaccattaaatctaatcaattgctggttataaaaaaattttgtaaggatttcttttagttcgtgtatcattttcctaaataacccccgtgcaatttaggctatgtgaaaaattctagcttaattttacagggaattaaacagcgggatatcaaatttcagctaaaaatgttggttaaataggcttttaatggaactggttagttaaatagtgttcactatatggcaaataccattgatatttcgagatatccatacttacttaaaaaaattaaaaatatttaacaagtcagattaatatgtgatatatcatatatcatttcacaaacatataatatcaaattcgacattcatatattataaaaaaaaggcaaattaactatgaatgtgccaatccatctctggccccctacagtttcatggttttagatgttctagtcctccatttgttctattcattatattttttggctaaattaacgtaaatatataatcccttatattcatagacagagggagaaactactacacgtatattcacaatatttttttacaacatataatttaacttgcatatttgtgaaatcatatattgtaatattccttaccaattttttcataatatgattttttcataactttttagaagacatgtaaagaataagtagatatctctccatgggttaaaatggttcccactacagtggcgttgcaggcttgcgagttgcaatttcagtcaaactaaaactcaacaggcttcttcaaagtttaaatcatggtttccttacataaatcatggtgaagtacagcaagcagcactatgtttgcatggttgacttcctcaaaagggaagaaaagaaacagaaccgaagataagaagataagagtggtacgtttgaatgcagcattatcgcgtgatctgcctccacttggacaatccggggactgaagtgctatttgactgttcattgtttggcaccgccacgtcatctgccgtagtagcactagtgcgaccctgtccgtacgcacttgtacatcatcttctttggcggcctaactagtaaccacccaactcaaccgggtgcaactctgatctgggccgtccatgccaaatctgacgcatgggacgtgatctattgaaatcaatttttttgccataccaaaatgttggcggctttaatagtgtcaaacgactgttaggtcttgtttggtttatttgtgccaaaactaattcaaattctataccatcaaatttggttatgccaaaacttgttggcacaaattggcttcaaaccaaataggctctttatgatcaccatgactacaaactgaagaaggtttgagccattcacaacaggtgcaggcgtgcagcttcagaaataaatcagttagattggatcgtgttgaatgcgccggttaaatgtgaaactccaggtgatctgatctgaagtgatctacttgtgtcgtttaattagcgtgcctaattccaatgggctattagctatgtaagtgcaaaggttagccatgtcgatacatgtatatgtgcacttggaccatccgcacacgcctgaaacctatcaacagattgccgatttctgataggagagggacaagtctgctacactgcctaacttccaagataagattcataaaataaaaccgacgattgcatgcagatcaagttggattcttttcaatttttaataagtttgaaattttcattgcttcgcaaacctgaaaggctgcaaggtgccaactgccaaggtgtccattttcaggtgagtgtctacccaatgacactggggaacagcctaagttccttgactgatcagatgccaactccatgatccagagattaattaattgataattatactattacaacactgtaaagaacgctgcaaagaaagaaagaaaaagattccggcaaaaagtacacggcctgcgaaatagtgaagtcgagcctaacaccacgagacgtgtaagtgtgcaactgaagaagttgcatgatacatagtcgcccgaaaaagaagtgaaatgaactatgacaaatatcgatatttggagagggttaggtactggttcactcgcagttgtagtaggctatctcaagaggattcgatcgtgtcaacaagacatttgcacgtcgcgttgtagcgttggtaaccagctacttcagaggcagtttttttcctctcccttttgaccaactccttgtcatgcacttgtgaactgccgtgcaggtcacatgcctgcgaaaaagagctccactagagactaaagactacagaggctggtcgccactcaccaatgcctgtttttatgtgaaagcaatgagcataaaccttaagatttggcaatggaattgcatgaagaagtcatttgaatcattctttcggtgcatggggcctaatcgtcatcttcttccgtttcttttgagtgatcagattattgttcaccgtagtatcatcataagcaccacgaactaatcgatcatggccaattgacgacgacgagcaacattacgccgggagttcctttccaacccaaaaaaagcttttacgaatttcggcttttcgtaatgcccatttttttccgaacggtcaaacaggttacttgacgttatattaatagaaggagattaagctcattgagctctagcataaatccttgatgagaattgaggccggcttaagtggatcccagcatagtagtactagtactagaacaggaggagaaacagtaacattggaaagggaagatccatggagtacgggttaagcaagggtccgtgccttttttatggcttttaatttctgctgctgcttactgcgggaccaatcaaaggcgtaacaagcatgccggtgaaagccacgcatcctgcatcctgcatgcagctatgcgaggacgtcagttcgtacacaaaagcagcagcagcaacggattgaaagtgttccgtcgtgtaaaggagtaaaga

SEQ ID NO: 28505 - DNA, 12629 bp, Oryza sativa
tttgggcctccggaactaaaattgggccgtcggggagacttgcgccgcatgtgacgcagctcgaaggaataagtccattttccccatatcattacatcaagtttaattcgcatccctagaccataacaccaaccacaacttacaaaccgggttaaattttatcctccgatattacatatagctggtttttactggattggaaagtgacctagtccactagtgttgactaggcgtttagcaaaaataaaaatgagtccacatgtcattctcactcgccttccctcttctctctttccaccctcttttctcaatatctcctcccctcatattaaactatccaaacaccgtaggaatggcgaaagattagcgtgccatgtcatcattttttccaaaaaaacaccccgttcttctggttaatcatgtttgagttccacctaccctagcgctgttcaattctgtgttgggatcgatccagccatccacctgggctacggtgccggctcttccaccaccatcagatcaataagaggacaacagacagtcaagatcttcccaacatatccccacacagccaaaaccctagcaacactcacggcccgcacgcatatggctcatccgccggggggccgccacactgccgtagccctcaacgcacgtggagggcgacacatcggcccacaccgccggttttccgcctcgcacaacggaccgagggcgtggtgtgcgtgcccgccggccgccgctagctccccacttcacgcccctctctttgcctcgccttctcttcttcccactcttctcgtgctctcgccggcttttctcctccgtcgtcgttggcccatcgatggtagttcgtccccaatcaagtgccattgtggcaacgtctatacaaagcatcatctcgacggtctgcgagcttgagctcgagatgcggtgtttccccatctcatgcgaatcatttgggccttgtgaatctcaactcccgaagtgtccagggtgaatgagtgtatccgtctccatcgtcagcctgctgatactcagacaatgctgatctaccatccctcctttcaaggtgaacacctatgcccaccttctcttccagtcctgtttcttctactttatcctcactctgtcattccctatttacatgaatatcattttgttcagtttcgtagttcaggtcaacattcatgacttcgacaaacagtctgccaccttcatcagctcagccactggggccatcaccatctcctacatcatgtagctactgatctgtaccatctttatccatcattaaaatttggctacaggaggatcgatttctgaatattttctaaacttggctgcaggaggatatgcacaatgtgctttgtacagagggatcgtgatctaggtgtttgcaaagagcatgcgtgagggtaacatatgttttcataacaaaaatatgttgcaattgtacataaatagtcatatcattcaaatgagacatttcaaatcgcaggctatataccattagaggagctcttacagacaatgcacagacaatatagtatttcaagcatcaggtaggctttcagtcatttacgaattagcatttttctttgtgtgtttgctctcagtacccacttggttcttcatgtagattctagacgatttaggtttggcactaatagaactagactttcagttaaatggatgatttatatgcaggaagatccaatttgcttgataccctattatctgtgtaccattttcagtacttttgttgtacgactgttatacctatcctgacaatgttatagatcattggatcaaatggactagatccttctttacacttttaattctcttagctggtagatcattgaatggttaatatggtcaattataggttgtatgctaacatggtgtatatttgtctgcaggattttttttcttccctttacccatcatcattctctgcggtgaggtattgttttttatttctattttactcatccaggccttctgcaataactattttgatgaaacaattgtagtttccacaattatattcagctctttgtcttttaaaactgaattactagctgtgagctcagaatagcaaagtatttgttgtcgaaaatagagatgatttcctacagcccactaaggagtgatagcaggatagatgtggctcttatgtattatggtgattcaccttgaactaaaaaaaatatttgtctagacaattaatgcctcctatttgcatcaatgaatagtcagtttaaatgcattgggtatattcgcccagttcattgtattgccagttgtttctgaatgttacttatttagtttttcaaaatatgtagagtaaatgacaccatagtgaaaattttccaattcaaccatatgctcatccattttcttcccttaaacgtggaaaacacttttactggcagttgcacttcaaagttttagcgagaaaagttatttcagtatctcaacttggccgttccttttcaccatatagttgatagcttgatattatagagagataacagaactcgccaaaagcgttataattttgattgaatgcaagataactgtagtatacttccctatgggattgtaaaattcatcattgcttaatctgtcaaccttcaaatcattgtcatcggcaagcatagactaatcttcttttgttttactgttataggactactagggagggagtttctgcggtaatatatgcaacaccaagcatatccgatatacttcccgtcagtgcaggagagtagtttagaggttgcataagtgcatgtcattgctggagtgtaccagtataaaatgtgctgaaattatttcgtagctaataaagtaaatttacaaccttttgtttatacgggttactggtaattagtaagtctctctgacgtgttccggctgttatgcttaattccatgtccagtttgtagttctgttggaccttcaagcaattatatattggttgttcggtgacatcttcaaccggcgcagcgtagcgcgccactatttctagtttctctgaaacacgatgcattgagcacaccgatagagagcagtgatcgggaggtgtgactgatgccggcgtggtgatcaggaggtgtgactgacaaggaagtagctcagggtaaggaggttcggtgcggcgcgtggcctgcttagcggcatacaaggacaaacctgagcaagaacaacctattggagcaagggcaccctactcggagcgggggctgccgaatcagagaagccatggttgtcatccaggctgggccctcccttctcgccttctcccccgagctaccaaggagcgacaaagaggtgtcgggccaggtcgccaccgcatatgtgatgcggagcgcatctcgctcatggaggaagatcaggaatttgcgggcaagctgggcagcgtgaaacagtttgatacggaaactaggatatggcgatggcaccactgcttgagcttgagttccgccgctaccgtcgtagcaccccttcctcatctctgccttcctccgccatcactgatagccgcgaccccatcctttccagcccgctcaccatcaccgtcgtcttcttgtggatggcaagtgagctcgagcttgctggctccttctccttcaccatcgtggactactcgaaccccctccgccaccaccgttgccgcttcccatggatgggctggccaaccgctgcccctctccctgctaatgagctcctgaaaaagagaggggatatgtggagagatggggaagggatgggataggtgaggagatccggaagttcacttacatgtaggttccacatgttttcaaattttctttttactgattaggatgccacgttagtcaaaacagtcattcatattgtcctacgacattactcgggcagcttttgttaggatgggagtgaatatttttaatattgcgatatactccctccgtttcagattataagactttctagcattgtccatattcatatagatgttaatgaatttagacacacatatatatctagtttctttaacatatatatgaaggtggataatgctagaaagtcttataatatgaaacggaggaagtagtgataccaactaaactcgaaaagatgaggggcggcaagtagacttatttccgctggaatatgctaccggatggtgctaagcccatgcagagaaacttgaccgagtcgcactaaaaaggaataagttcacttcatgacccttaaaagagacccgaatctaatccatgaccctaaaccgcaaaaccggatatcttcacccccaaactattgaaaccggtgcaatttgactcccttggtggttttggatggcggtttcgctgacgtggcgctgacgtggcagtgttgacctagtctgtgtgctgacgtggcgctgaggtggcatttcaattaaaaacatatatgtgggacccatttggcattcacacacacaagattgtggggcccactaagctgcggcccccacctgtcatctcttccctttcttcttcctctcgaacctcccctcctcctcccttctctctttttgttctacctctccacttcgggcgtctgcggggagcgagcggcggtgggcggggtctgaagcgacgcgaccggggggagctgaagcggcggcggcggcggcgtcgagagctagctggaacggcggcggccggagctagctggagcaacggcggcggcggtgggctggagttggcagcgtggggcgtgggccggattggtggcggtcggcgagagctgaagcggcggcgagctagagctacgcgagagaggacgacagcgccgacgccgacgagatcgagcggggggacggtggtctatgggccggctacagcttcggatccatccgcatcgccgggatcagagctcctcgtcgccttcctccaacacctccctgcatccatcctcgcatcgcgcgggacgtctactgcggcggcgggcgcgggatgtcgacggcggcgggcgcgggacgtcgacggcggaggcatcgagcgggttgagcggcggctccggcggcgtgcgggcgagcgcgagtgcgggaggaggcaccggcggcggcaggtgcaggacgtcgacggcggcggcgggcgcgggacgtctacggcggaggcatcgagcgggtcgagcggcagggctccggcggtgtgcgggcgagcacgagtgcgggaggaggcaccggcagcgacaacatgagctcggcggctccgcttctcccctctcccttccggccctcacgcgccaccgccgcctctcgtgtaacccaccacctccgttcctccctcacctgctctcctctcctctcctctctccacttggcaaggctgatggcgaggctaccgcgccgccgccgctgccgctgctctggcccacccgccgccgctccagctccagccgcccgtgctccctcgcggccagccaaaggggagaaaagagaaagagaaagaaagagagaagggaggaggaagaaagggagagagaggatgacatgtggggcccacatgtcagtgggccccacaattttttattgtgtgtgaatgactaatgggtcccacgcatatttttttttctaatgtcacctaagtgccatgtcaacgccacgtggaaagaagaccgagtcaatactgccacgtcagcgccacgtcagcgaagccgtcatccaaaaccaccaagggagtcaaattgcaccggtttcaatagtttggggggtgaagatatccggttttacggtttagggtcatgaattagattggtcacttttgagggtcctgaagtgaacttattcccactaaaaaatctcgagatatttccgcgatccggtagggcccagtcgcccagacgccaacgcttttgtcccttcctaccccacctcgccgtcgccgcgcgctccacccctcctctcctctcctctcctctcctctctacgcaagcgcagcaatacggataagctcaggcttcccgccgccgccactgccacgaacagttcgctcaccgcctcaccggatcgccgccgccgaccaacgcgcagcgcgggcgccgcgtccccgaacaatggcgctcatagcgccgagcccccgggtgctgagcgcgcgcgaggcgcccgccgcaggcgccctgcagccacccgcggctgcatgctcgaccgtcgctggcggtggcggggcggcggggaggccgctcgggatgtggaacggtggcgggggcgggggcggggggaaggggaggaggagggagagaggggatgggatgttgagggcggaggcctacttctgggacgtgtcgaagccggtggagatggaggagatcgactccatggagaagctcgacgacgcgctccggtggtccgtcgagaacaagcagcccatcatcatcgactggtatgatccgcttttgcctttccctgtttcatttttctgatttactacgtgagcatccctgattttgccagcccatgaattctctctgaattcagcaattagaactgcgcttgagtgttacagagttcttagattcgctaggaatcgacctgggattctgcgaccaatgtagcatcgtgttagtttctgaaagttatcattctcttcagaaagtttctgaagataccatgaagtgaaaaagttttgttggaataccccgtttgtcaggttcaaattgcaacgggagtgtcacaagtttaactaaaagacatgtgattcctttcgaattgaagctttttgttaaaaatttgtatcggtggaagttccatgatgaatgttgatttcgaaatgggtgactggctggaatggcccacttggcccacttagtcttaagaaatgtgctaaaataattcatttggacccacctgaacgacttgtgattgttccatggacttgtgaggagtgtgatcaataattgagatgttgttgagatgaatgtctattttctttatcagaatgctagtcttcaaccattccctaaagaaatgcttccgcagatgctgaggttctcttaaattgttcttgccaggatggctagttggtgtcggaaatgcatatatctgaagcccagactggagaagatagcaggagaatttccagggttggtttaaatttcatcaaatgtttgtatgtagggctgacacaattgacaatatgaattcaatcaagttatagaggacagccttgcggggtatggactgtgagtgtcccattgcttcactcgaattaaaatggtatttctcatttcttttgtagagtcaggttctactttgtcgatgtcaacaaagttccacagactgtggtgaaaagagggaatataactgtgagtcagcaaattttgagcttgtcttttttttttctgtattaactgttgattcagagtgactccaatacttatcttattcattctcaatttctgtctttccacgtgtttggatgcacttctatcttcagaaaatgcccactatccaggtaactccacacttccttcacagttcattgtccatataccaaaatttgtaaatatctctcattctgcttaatataacaccagcaattgctggctttggtttcaaaaaaaaaaaaaccaaaatttgatcttagagttctcgttcatgttcagttatggaaggatggagaatgggcagcggaagtgataggaggccataaagcatggcttgtgatggatgaggttagggaaatgatccagaagcacaagtgactaactacctaaatcaagcaattgatatatactgtaaatagagatttgagatgatctcttcagatattaagttgtaacgagatcaataattaaagcaatattctctaatatattgacgtgcaattcttttgtgcgttcgcgaaaaaaaaataaagcaatattccagctcctactagtgcaaactctcaatccaatacttcgtactgtatagtataatactcctgtattagcatgtacataagaacttcagatttacgccatctgaatagtatacttccaatttacagattgaggaaagcagacaaattgtaaagaatcaaataatccaccattcagtattaacttaattcaatccacatatctacaagatccactctaataatctgcctctttcagagcccagttcccaaattttccatttccattaatcacaaaccaaaccaacccatgataattcaggtttcttcagagtaaccaaactagcacctagctggccagagcccagaagctagcactaaccgcttcaattaatcctcgcggcggctagcccagcggcgcgacaaggtcggcgacggcgaggacgacggcgacggccagggctcgtcggtgccgacggggacgtcggagagcggcgcgaggaagcgcctgacgctcatggaccgcatcgaccggaagctcatggacgacctcagcttgccgtccttggagaagacgctcgacgagctgcggaggatgaggtagaccagcgcctgcaccagcacgaacacggcaaccttcgtcaccgcgtcgcggatctccggcgagatcatcaagctcgtcgcctcgccgtccatggcgaacagaaggatcaaagcttgtgtgtttacgtgtatgcgcgtttgagccgtgtgggagagatcgatcaaagcttgtgtgtttggtcatctcggtctccgctttgctcgctttatatagactcgagccggactgcatgttgtttcggattttcttggtcgtgtacgcaagcggtgaagtgtagtatttttgtttttgttttttggttttcttggtgggggatagcttcgttcatttgattggttggatttgctttgcaaggaaggaggtgccaacctgcctccaaccctgaacctgtgaaaaatttgggtcttccaattgggccattttttttattggccccgttaatttggcctaatccggctccgttaatcctttggggttgaatattgggcctgaataacttcggtggtgtctgaaaatccgcctcctaaaatgcctggattgcttggataaattggcctcttaaaaaaagggaaaccaaagggaccttcccccctacattgccttcctaatctaaattatgacctaatcgctctacttgttttaaagtaatcactttcttgggatcaaagcagtggtttactggtttataatatacagacgtaattaccaaattagatcgagcacgtttcgtttgctgcaagccttggtcgattaatcaacatttcttcgtaaacggaaattctttactgaatgtttatacagttatgtcacattaatccttgctagattttctttttccttaatgaaacagaaaagactgtaccaatattaatccagtggcatagagtaaattctcctattcccggttgcattctctcgttccactatcttccctcctcttttctgcaagggtttgagtgcgcttcttgccatcatctccattgacactctccttcccagcctcgatacctttctctcctaacctacggtttccgcgcctgaccctttttccgcgcttgcagttgcagctacatcctggaacacgtagataagatgaacacgtagtagcacttgtgtttgaccctgtcactgtacctaattttcgccgcggaagatcccacccagaatattttgaaacaaacatcaaccgctgaaattgacccaaatcatccagaaaacaacagttggaagagaaaagtgatgaacttttggtcgaggcgtttcatactttcatctaatcaaaatttatcttctcttctagatgcatacttggactgtccagaatgcaaccgaattccaagccagatgtcacaatcttctagccgttttaccttttttttttcgccagaaacttctttggactcggcattccatgtgccaattcgattgggttcgatttctcaggaggaaatagcaggaggaaccgaggaacgtgcatgcatgtaattcatttaatttcattcctgccgaattatcatcaccggcatgaagtccggcaccgactagtagccagttgacagcttaattagaatcagagacagctagctcaggagttccagctagctttgaaccttgactcggtttgcaatggcgaggttagccaggcaaatgtgcgatggccggagtgggtcaaggcctctctcaataatggtcagccagcctcggcacagcttgacttgtgggaagagatgcgctagatgctataaacgcttgaaccgtgcacacgtgcagaacgtttgtgttcggtgtttacatacacggtgccggtgcccatgttatcaatcagcaaggttctacacttctaccgtagaagaataactaaagaaatcagtattatgcattgcatgagataaagagagttcatgaaacagagcaaaataatatttactagtaggcgtgcaaaacggaaccgtgattacctaaaatgacttgttttagagtcgagatcctcgacttgtagtccaaaacagcaccaggctcagcacaagcaagcaagcggaagccagagaagcagcatcacttccatgcaggattcattgtactcatgagtgaacagggtgaaaaaaaatatcacaatatcacgtccagtttgcgcgatgtatcgcaagcaaaaggagccaatgcaaccaagtcatgcattacaacccaactagacaggcctacgagcttaggtgtgttttcgtatgacaaaacttattacaacgcgcaaggtcctagtatcccggtctcttccaaaaaactactagctgctatctctaaaagcagggcaactgttagcacatgcggtttcacttcttgacctcctcgtactcagcctctggagcctgctcgcctccgccctgagatcctcctgtctctgaaccgcctgcgccaccaccaccaccagacatatgctgcccaatctttgaaacagccttgttggccgcttcgatattggccttgatcttctcgatgtcatctgaggtcatcacagagcggagatcggcgattgctgtctcaatctcagtggcaacctctgcaggaatcttgtccctgtactctcccagacttttctcaacgctgtaaatggtagtgtcagcgttgtttctgatgtcaatgagggctttccgctcctgatccttctgagagtgaagctcagcctcctggaccatcttctgaatctcagcttctgagaggccaccggaggatcggatggtgatttgctgctccttcccggtagacttgtcttttgcagagaccgtcacaattccattggcatcgatgtcaaatgtgacctcgatctgtggcatacctcttggcgctggtggaatgccaacaagatcaaactcaccaagaagcttgttgtctgtcgccatctcacgctcaccttgcaagacacgaatgcccacttgtgtctggttgtcagcagcagtggagaacacctgcagaatgcatggagtaaattaaggaggtcaaacatatgaaatggaaaccccttgaaagaggtggcaagcaatctatcactacagatagaagaacaaggtcctggcagataaaatcaaacagcaaggtcaagaataagtacgtagctaaaaagcaggaagttagtatatcatgtaatgcatgatataagagtattcatggatcaatcacaaaataatccatgataaagaacagagcaacactatgtaatctactactataccacaatatgaaaatacaaacaaaatttaatcacgtgacaatgaactagatgctaggtcattaaccattgggatgcttgctaacctgacttttcttcgtggggattgtagtgttccggttaatcagtctggtgaagataccaccaagagtctcgataccaagtgaaaggggggtcacatcaaggagaagcagctcctttacatctccacggagaataccaccctgtatggctgcacccatggctacagcttcatctgggttgacccctttgcttggggacttgccaaaaatctctgaaacaatttcctgcacttttggaactcttgtcattccaccaacaagaaggacctcatcaacctccttggtagttataccagcatccttcaagcaattcttgcatggctctctggtcctctcgatgaggctattcaccaaagattcaaactttgatcttgtaagtgtaatgttcaaatgtttagctccagaagcatcagctgtgatgaatggaaggttaatctcggtctgggcagtcgatgagagttcaattttagccttctcagcagcttcacgtaacctctgcagagccagcctgtcctttgccagatcaatagcttcactcctcttgaattcactcaccaagaactccaaaagagtgttatcaaagtcttctcctcccagaaaagtgtcaccatttgttgctttgacctgacaagaagataatcagtgaatcagcaggaaaaaggaatattatgtaactacattttctttgtacataaagttactagttagcatcagtgtgtagttcataaatactgacctcgaacaccccattggagatttcaagaattgagacatcaaaggtacctcctcccaggtcaaacacagctatcaaaccctccttgttgtttgttccataagacaaa

SEQ ID NO: 28506 - DNA, 26592 bp, Oryza sativa
  unsure (1)..(26592): unsure at all n locations
ttagaccattacctgaaagctcttgcaaaactaccccattgtgaacaaatattcgcagaatatgccgattgagcattggcggtcaactgaaaggtgtacaagtttcataaatatcgagaaggtaaaatgtaaaatgctaaacatagcttaagattgaatctgcaatccttcgtatagtctatgtgtacagatctagagtaatcttgaaacaagaaggggaattattaatctaggtgacactgggagtgtaaaacaaaatagtactcttcaaacagcaagagaaaataaaactacttatatgcatgagcaagacaaaagaggcagacctatatgtttcagtttcagggttaacttaacccaggtcccagagtggttctggtttatcactgaaagatattacaggccatccttttttggggccatccctttttggggagaagacccaccaaacacaatgtgtaaacacaatatgttgacagagataagaaaccgcatgttgaacaaactaaattgacaggatagaagatgatatagaaatactaacacagagctccacgtaggttcggatagaagatgaaatagaaatactaacacagagctccacgtaggttcggttcaattcatactacggaaacaaacagaacgctatctggccaagtggccataagctttagacaaacaaagctccagttcttccattagtgtattggcatgattgcatgaagctccaactgaatcgtagtacttacaaaagtgtcttatgtaagtatgcaagaagtgcagcaatcacacccggacactcaggacgttacaatcttgtgcctcctagcttaaggaacatgaagagaggcgatccccttcttgacgaatgaccaagaaaatcaactaccttaccccaccctcccatcgtcctctactcaccatgctaaattatacacgatctaacatttcaaaaagagaatggcacacggatccaatccataccaccggcagtaaggaaaaaaaatcataatttgaatttgcacctagataacatatccctcatctaatctaaaacaacatagcgaaaaggtcnaaccagtatgacatatcagataggtagctgcaagccagcaagaagatagcaagacgtcaacagctagtagaggaatccaccgtgaaaaaaagtaaccacagccacatgagaacccaaccaaggacactaatcagccacccatggctcgatccggcagatccaagcaaaagaaaccgcaggcgaggaccaaatcgcgctatcacagatcgccgcatcaaatcaaacgcgcgagggaggcagattagggaacgggaggcggagagggggcgtaccgttccgaggggcgaggcgaggtctcgccggcgggcggctcggagaagcagcgacgccgccatggccggacggggaggggaggggaggggagggaggcgaggaggggtttagggttttggttttggcgtgtggaggcgtgaacttattggggattgggggaactttggggagaggcgtggcttgcggaggagggtggggattggttgttgggctgctgcctgctgggatggatgtatggctgggcggtggggcgccacgtcgtcgcggcttgcgggtggtgcggatgcgggtggccgtgtgtgtgtgtggaaccttctcgaatcgcatgggatagcgtggcctgcgcacgaatgggccggcctggtagggggtggatcggttgggataagtccatctattgttccttgtctgtacgtcgagtctttacttgtaatccttaaaccacaatatcgaaaatctttacccttcattttaacaaaacttttcaaatcatgttttatggcagtatatggatggtttggctgttgtgacatcctagtcaacaaagcagcagcacaagctcaacggttgagactaggaggaggcaaacgctgatgggggaatcggacaccagcctgccgatctagcgcggagagcacctctatctcctcggaggggggtgctactgcgcgcgttcgtgccagcaatttagctgccccccccccccccccgccgcccgccccgtttattttttcctgttcgcattttttttcccgattttgacgttctcttttttttcgccgtttctttccgatttttttttcaatcacctctttacaaatgtagaattgaaagtttttaattttaagttgaaagattttaaatcttgacctgaaagttttcaaatctgggttgaaagttttaattatcggttgaaaattttcaaatctaggttgaaagtttttcaaatttgagatgaaaagttaaaagttttcgaattaaagttgaaagtcttaatttagaatatagtcttaaattatatttggaaagtcaaataaaacaaccgaacgctaatacagaggggaaaaaatctaaactaatcacgatactaatcacgtttcctaatacaacctaattcctaaactagcgctaatcatgacgttaattattttttaattctgattttaaccctatgcgtaacgacgcgtggtctccccaggcgaaaaaaagcaaaaaaaaaaaaaaaggaaacgatggactgtcgtgtgagggtttgggccgcgtgcaagggatgggcaagaaacacgcgcaacataagcttacgcgtgtgtacgcgcgaattaggaaaaccgctcctcggatctcttctctaggcagggatcctatcgagctcgcaatggcggcggccagcctcgctagtctccatgtctgccttgtacctctgcgcccagagcatggctaacgatgagagcaacaaaacgaggcatacgatccaggagcgcagcacggatttttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccaccgcctccttagacatgaatgcggagaggaagaggacaaggggtgaaggcttggaaggccaagaaggtgcagtagagggacgcatctccttgcaagtgccatcgaggcaggcctcccacagcacaacgtggcaggcgagtaggtcctccttgagccacttcaagatatgctaagcggcgtcgaaaacgccaaggtacacggcgcccttggtcgcgcggtccctccctgcattgcccccccccccccctccattttcactgaacccaaacaccaggagcgttcctatggtggagttgttcaggccggagcgacaccgcttgcatgataataacgattgaaacttgaggtctagcccagagagggcctagagggcatgttctccccatcgttggcatgctctgttgacctcgcgtgcgtggttgaggaaaaagagcgtggttgaggaaaaagagtagagaaagaagtaggagctgatacgtgggctcaacatatttttttcttctcacttacatgtgagctccgtatgttatttcttaaaaaaattctttttatcaactagaatgccacatcagcggaatcagttgtctgtactgccctggacctgtcttggacggttctggcaatacaaggggtgaagatttataatatcgatttttgggatgccaattaaactcaacgtgaagatgagggacagctggacttattccgctttggttttttgctggccttatgctttggcccagctcagcccgagaaggcacctagaacgctagacgtctggttgttcccctataagccgctggatcaagatggacgatccagattgaggcttgaaagcaggcaattctcgatatgcacactaggctctctaatgtttcattactatacttgcacaatggactgctgattttgccttttctttttggccggacaatgtggcctactaaagcaaaagtcatgtacacaggtggatttgacttcatagttgcatctctatccgacactgccgtgtcgatgaaactaagagtttctgaacatcaaacatggcgcactataatgtggacaagcagcagctacccttcacctctagcaaaagacaaaaacatcaaacatccatttactttggtactaagctccagcctccaaggcctccagcagtccagcctccaagccctcaccttggtctgagagtgttcttgggggcactaatccatggcgtccctgcgacggcgaacctccatggtgcagcaacatgctccggcgatgcgtattcgatgcctacacgggggccaaccaaaatgttctccggttctggcccgtctagtacctccaacccacctaagacatgtaatgtcaggcgaaaacatgttgatacgatctggcagttttgaacgatgttggagatcactgaatcataccaggtgtgtacagaggatggttggaccagtcagtggaaagccccagagcttgaccaacctgaataacacattcagagacagttataattcagttgtgtgggaacagtgatgatgcagaatacaaaacttggtattgaaaggcataaacctttcctggtccagtgagtagaagtggcttatcagtctgctggcctcgacgctgctgaatagttgccagccctacagtattttgcaagacaatgagaaaagatgccatcaagctcaaactagatgttacacaatagaatttacaggaggaacagacatttggcagtaactagtaacctgactgggtttttcttacatgaccaaatgcagatgatttatataagctctatggtctaagcatatagttgcttttgtaaaattggaactccagtagtccaaacaaagaaacagattttactttctgaagttaggagggacagacggaagaaaaacaattgccgaaacatgtgaggaaagattatcgcatatcctcttcctcttgctcacacagcaacgtcctcgtaaacttcccttgtgttctttaagtaaaacatattctctaatgcatacttcatatcacattaagtctgaagtgaaacatacatttcagaagtgaaaattattgcgattacagtatatatcttccgatctaaactaaacaagcaccaaacgaaactgcagccgaggtttataaactgtaagtcacccaaataacttggtcatgttcacttgttgttacttcaggaaaaaagctgatcagatcatacatgatgctccataatgctcaaaatacttgagagaaatcagaaatgcatactgctcaaaatacttgagagaaatcggaaatgcataccactaacgggagcacatgaccgaatcagaacagcagctccaactccctccttgtcagcgacgacattgagcatcatgtgcagtccatagcacaggtaaacatacgcatgccctcctgatccaaactacaccggatgaaggaaaacttcagcccacattgaagttcaagagactccccccaaatttgctaagcttatcgaagaatttaaggcaagagaagcatcggccttaccacaggagcagtcctcgccgtgatgccgaaccggccgtggcacgcggagtcatttggcctgtaagcctccacctggaggaacacgcaggaacaaatccacagtaatcgcacttggccgcagtgattactgattagtaggagtggtaaggtgaaagaacaagcacctcggtgatgcggaggacgacttcgtcgcggcgcagcagcttgccgaggaggcgtggggcgaggtcaagcgcgtccacctcgaagaaatcgcgcggcaatgcgggcccaaacggcgactgcaacgacaccgccgtacacgccgggtgcggtggtttccccgcggcgatggtctctccggcggcgacgcggcgggtacggggctgccgcttcttcctgtggggggatcgcttgaagcgtgggggcgtgggcgccccggaggtggtggtggtggtcatcggagatggccggctccctccggcgaccggcggcggcggtggcgtgggggtgtgtgcgtggggatggacggtgcagatggaaggaagggatttcatcgatggattggcaatacactacgagtactactgaactcaccggcccacgcgattagtatttacaaaaaaaaaaaaaagtcaacgattagactatggctgtgttcggattcatattacgcacggaaaacggaacgattcattagcacgtgattaattaaatattatcaaaaatagattaatttgattttttaaacaactttcgtatagaaacttttttaaaaaaacgtattgtttagcagtttgaaaagcgtgcgcgcggaaaacgccgaacacacccatatgtgtttttttaaaaaaacaaatggttgacagtttggaaataaatattacacttcaccattttattgtactctatctgtcctaaaatataagaatctataattggataggatatttcctaatactaggaatttagacaggccttatctggtcctatgtttttatattttgggactgatcaggtattgtatttgagttcatatttattagaggcatccatatcggttgcatatgtaaggtttacatttttaaagggtacgtcaagagaaaagcattcgagattagtctctaacaaaagttagaatggtcacccttttttttccattgctgatctctaccgattaggcatgaataatgtatcacggtgacaagtgaccatggtaatctatgtgggagaatctacatcataaaatatggtgaaaccttggaatctcagagagatacgtagggatgtcactagggttattgcactgtcatgcacacctctataagcatctatctttcttcctcattcgtttaggttagaaaaaaaatatgttagtagaaaaacgtattgacttatgttagccatttatgtctgatacccatgagttgtcacgtgtgatgtggctatttcgcagttagcaagaaaaacattgaagaatatagatgttggataatgtttgactatcaaaggggataccattgcctttacaataaactagcaataccagtgctaaatgagacatctatatgttgttgacccaataaaatttctactagagttagattacttgatgaaatttgaaactactttaccactcgtaacaaataattaaatatttctttgaactttgatggtctaacaaataatcccttgctaatactacctccgtaaaaaaaaaagtgcagttatggtttcccgtgtccaacgtttggccgtccgtattacttgaaaaaaatatggtcaatatttttattgttattagatgttaaaacatgaataatattttatatgtgactattttttaaaaaaaaactaaataaaatagacggtcacaactgtaattatattgggtcggagttagtatttgccaccatcttcattggctccgagatcgccatccaataatttggtggagacaattgaacaactcgtacggatgctccatcgatttctgtgtaccctgtatagcgagtgatagtgcctccatccatccacaggtgaccgtccgttcctagcctcggcccgtagagtgtcgacttggtggacagcacaaactcggtgtcaataatggtcttgggtgatggcccttgacctccatctccatggcgagtggtcgtcgtcgtaggaggactcagcaggttcaggttctcgttggacacaatcacatgcctcggccgcatccacaacggcattgatattgtgcagagcccgatgtttagctccaccattgctcttgccgcgctagcttctgcgtcatatgttggccctatggttccttcgcttgatgggggtgatggatatagagcgacctaattgattcgagcgatagttagcatagttagtgtctgttcataagcaattcattatttagataaaaaatatcattctcataatttacttgtttaatgtggtaggtgttaacactcttctctacaaaacatagcgaaactaatcttttatattttagaacggagtttttcttcttaaaaatatatatgggagtttaattcttttttatttacagaacttttggagagattcatatatatatatatatatatatatatatatatatatatatatatatatatatatatatacacataaataaattaatacatacctcgataatttcgggtttgatgaaacatattggaagagcgaggtggagaggcggaaccgcaaagtagagcccgtgttttgcctcttcctgcctatggaccgcgatcgcgacgctgtcttcgtccctgaagacaatcaccgtgttgtctagtatcacgcacaaggtgatcgcctcgatggcgccgaacgccaccatgtccgcctgcaggtcatcgagtttctggaaaataaaatcgagaccttgggccagaacgcatcgacgatggaggctgtgcatatccccaccctcggagatcagctggctcgtgatgggtaccaagagatctcgcgccagtgttgccctctcgacgatgtcaccgtgcagatcgcgtaggtttcccaaagagaccatgattgttactatttggcttggaattttcgaggctggagctgaattatacgtatgaattttgggcgaatacgaatatctctcgctagcctagacgcaataatacggcggctgaagtacgattgagatttgagagaggctctgatgaatatataagattttgtggccgaatacgaatacctctcggcctgtcgctggcctagtcgatggtagcagtcgggctgggcccgctcaggaagaggaaaacgagtcagaatcagacacggggttgggggctccatttagcccacgtgaaattgtttggcccatgctggcgaacataattgggcctcgggctcgggctgctcgcacgtgcagcgcgcgtgcgctgcggagtgcttcgtcgtgccatctcgcatcgcaccccagaccagaccatggcggcggcggcgctctgctccgcctccccggccatctccacggcggcagctctcggcgacggcgtggccacgctccgcctcgcggtcctactgcgccttcgcctctccaccgcgggctgtgggctgtggctgcggtggggaccccatcctggcaggcgcgtcggcggcttccacgactacggaggaagagggatcaggtgttagagatgatgatcccgacggcttcctccgctccgagaaggtcaggcttaaaaatcggctttaggtgaaaggagcccgtgaatttgcacagtagagatgtttgtacactctcccacactgatgtatgtacattttttgctggactagtgctgtgtgtttgcctatttactctgatacggtgcataagtgcatccgtctacaataagataatactatccttttagatgattacgtgccctataagtgtccagttacccccctcgatggcaggaagggaagataaaaacacaacagagtttgaatgtgctgagcatttcaaatataatgaaatgacaggttgctagaagcttagaagtgaaaatatatatcactgtatgtctgtatcaggcatatggtttctgctagtaatcttctagcattgaaaaatcaaatctgtttagtgctcaatggtagctcttggacgagatgatcttagctgttcaagcacaatgaaatctacaatgttaattgctaaatgaactagtagtagacaccgtatattatgaatgacggcattgagagattaaaactatttactgctactgttgtccttagacaaaacactttatgaactgcaatataacctcaagtactatggttgaatatgataaagttggtcttaaattgtgctagtaataaattacacatacattcgagtctctattgtttttcaagtttagctctggttacctgtttcaggtaaacgttgagcataaaagattcgattttgtttctgttccaggatcgaaagtgcggtatctgaagagtcacatgatgaccgcacagagaatgaacatattatacatgaccatgaacaccgtcatcaccatcatcatcatgagttcatgaccatgaacacaaacatggtaagtataaatgttgagacatgatcataatcactgtcatgatcctcaccaattatcattttgagaactcctgctaaactgaaaagtagtcgacgacaactactgaagacaggctaaccttagtagcaatatatccatgcctgaactgtgtaggcattcttatctgtttatatgaatcattagttcattactgcttgaagcttgatgctacttttctattaccatgtgaatagtccaaaaataatgattgttcattttctgatacacatcatatggtaacacccttttccttatggtaatattatactaccttagtagcaatataactggctttctgttccacaatcacataatgtactacattaacacctaaaatctcacatcaaggagcatgatggcatgtacgaggtttgcgcacactgcacactcacacacaatcttagatccatatggtcccttcgtccagtacctattcttttaggagttagctcatggaaacatttcataattaccgggaggctgggagttgagccatctgcattgtattatttcactcaatttcagaaagcataatatgatgactatcttaagtcatggcaatgctttccatatcttaagtgaaaatatattaatatcattcggaagtttttgaactgtttataccattgtctgcttttgtaaaattttaaatatgctagccccccatgatatgaagaacaggtaaactcattgtttttcttttccttatagatcatcatgcacacgagcatacccatgatcctggtgtttcttctgtaagcattgtttgcaaaggggagatggatcttgaaaaggttgattctaaatttatctgtcatgctctatttagtcattattgctacatgaaattttacatctaaatactatcacccatttaattgccccacacatgatggggttgtggatattgaaataagtggataacaattttacatgctctcacataagctggcatgtggttgggaaacctactgctagaatgtctttcaggtttatgttaaacttagcctgtagttttacatagttcactattgattcttccatcgtagtctcttactgggacatttacacaatgaaccaattactctatatgtgttcttatgtaagaaatgtctgtgttccttgggcagggatactctatatgtgttcttatgtaagaaatgtctgtgttccttgggcagggagtgcacatcattttccggggaagaataatgtgggaaccaaatgagccatgcatcaacaagattgtattcatagtcaataatctcaaatggggaagaactggagaaacggcttcaaagattgcctactctactgaaggaataagcgagaaacgggactccaacaggtggtgtatacttcaatccaaccaatcaaccacatgaaagtgcagcagcctaaagcaactaatataaggaggaggtgatcagtctaatgttttcatgtacacagcctgaaagcaagaagaatgcatgaatgggctggctatccgctgaggtcaaggagatggtccgtagaggctccggagccgggccaacttatctacaatgacagctgcaatgaagtcatgagtgtaggcggcgtatggcacccgtctgcagtcggtgaaccccaagctgtaccagtcctcagccggcctccgtcccagccttgctgccccatgccaagacttgaacacggccactgcgaccccccttcagacgggcgtggactagatcatccatcgcaccaaaggtggtggacagccgagcctccagatctgcgcggtccgtgtacattgggatacctgagaggatcaaggacctgtccgggaagctgctgctccagacggtagcagggttcgcgagagcacacagcgcgatgagcttgtgcacgatccgtctggcctcgaccaccctgttcacatggtatcctggtcctggagacatcaactcgtcggatagccagttcttggcttggcagtaggccacgggacccgcccagtccctcgtgctgaagctgagctgctgcggcggctgctgcggcggcggcgtcaggaaccgggaaacgtgcagccatgtcatcatcagacagtgaggagaaagcccccatctcatctcatcatcatcatcatcatcaccccatctcatcccaggagcgtgcagccatgtctcgggaggctcctgcagcagaagctcgacatcctccggactcccgagcacgaccaccacgacacccatggccctgtggatcacgacggcctccacctggtgcctcagctccacccggtgctccagccagtcggcgatctgggccgcgtcacactgccaccgctctgtgcccagccctctcagcagaatcacccggctcctgtactcttcctgctgcgccgccgccgcctgcgtgatcacgtacggcggaagcaggagacggagcaaggacgacgtgccaccctcgtccgggagcagcagcgaggaggagtccagcatccggaggcccgtcctgacgagcaaccgcggcgccctcctggcaaccaactccgtggcgtccgcgtcgtcgtacacgagcacgccggcgtccccgcccctccacgccaccacggcgcacgcgtactcggccccggcgaggtggtctctcgccgcgcggcaaagaccgtaggctcctccaccaccaccatcggacgtgccagcgacgcggacgacgaagacgcacctcaggtggagatccgcgtcctcgtcgtccagcaggtaccgaggcggcacgagcgaccggaggagcccaggctcgggctcagcagtggtcctccgcctctccgcctcatcgtccagtgcgtccaagatgtatccgcgcgggtcgccgcgtccgctcgcctgaacaaatccacattcacattgtcacggagtactagctagtagtagtagtagtagtaattagttcacaaaatgtaactagcctggcaacatcatctcggctaattgagttgtttactgattcatttcttgtgtaataaaaagcgcagaatcatgccttgaatcctattaaaaagaaagattcaaacaacgcaaagcattgtcctatcgagttttggtgattttgctcttagcggacaggatgcattgggtaaccgatttcgtccaaaccttcaataaaaggctacaattctaggagagagctcatctgctcatgtatcattctccaaatacacgtgaaccagaagcactgagcagaaaacattatcgcacagacagcaggaaacaaactcgcatagacagagcgggatgcagagattcagagaaaacaaactcgcacagacacagcagaaaacaaacacaaactcaccgccggaatgcaggcgacgtagaagcccgggcgaggcgtcaggttcatcgcgctcgcgctgtctgcggcatccgcgaacaccaccagcccgacgcggtagcccgtcgagctgtctcgaactaagaccgcggcttccacagccaggacggagaagctctctcgcaggtcccgggggcttgtgctgggcgccacgccgtccacgagaaccgatctctccaggaagtctgggtcatcaagaaccccgggagcaacatagtaaagatcagagataaggcgattcatctgcctaaatgctgtgttgctcgcctgcaccaaacaagggacagcatccgatccatgtcaaatcaagcacaagactgaatggaagaagaagaagaacacgacaggtgtaggggggggggacgggaagccatgaattcggggcaaaatcaagaatccagcggcaagagaagcaaaatggcgccgaattcagagaagactcggcgttcacgcgaaagaaacgagaaaatgcgaatcatcaagaaatctgagaccatgaattcaagaaacgggaaaagaaaaatcaggaagcggaggcgagggacagaatcgaacagcaaaagaagcgacgaattcaagaaacgggaaaataaaaatcaagaagcggaggcgaggagaccgaatcgagcagcaacagaatggaccatgattcccttctagaaacgggaaatgaaaaatcaagaagtggaggcaaggaaacagaatcgagcagcaacagaagggaccatgattcccttcaagaaacgggtaaagaaaaaaaaatcaagaagcggaggcgaggcgacagaatcgagcagcaagatcaactacaagacaagtagcaaatggtggttgccgaattcagagaagacgccgccgaacacgcgaaacaagaaaggggaacgaacagaacaaatcagagaccacgaaatcgtcgaagaacacgagcaaacagcaaacaacccttccttacctctcttgccagccatagcctggcgaggctggggtggcgaaccgggatgataccagcgggaggaagaggagcggccatttccgccgatcggtgcgggtcagaggagaggatgaccgggggatggagggagctctgctctgctcgtttggtttcttggagggagaaaacgcaggcaggtgcagggagaagaccgcgctcaacgctggtttgggaggagacgtgattttgtttcagctcacctccgcgaaggcggtggatggaattggaattgggctttggaagatttggcccatttttgtgtggcccgttattctaaggggacgatcagttattaggccgaaagaacgaggaattttaagcagaataagttcaccagccgtctctcaactttacatcgaagttgtttcacatcccttagagcaagtataattgtgagttatcgtaggaccgagatatcgactagaggggagtgaatagacgatttaaaaactaaatgacacctaatcaaaactaacctaagttgctagactcggtgagggttaagtctaactaagcaactaagttatgtttgcaaacctagggtgatagtggctcaattaattctctaggaaagtaaatcacactcctatatcaatgttttgcaatcctagggtgatatgatatcaagaatgtctctaggaatgtaaattgcacaaatataaatgcgacaatcaaatgagacaaggagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccatggagaggactacccaagcctcgatcactcggggtagttcttccttcactctgaaggtggtgaactccaaaccactcacaaccggcgccgggcctcctccacaatcttctcggagaggtcaccgggcaacttctccacaagccgtctaggaggcggcaacctccaagagtaacaagcaatgacccggcatggaaatgatcaatcaagtgccgcactagctctacaaatggaagtaatgcacttgactcttggctagaacaatctcaatcactacaatggatgaacactaagctcaaaggtgtgtgagagaggtgcaatgggtgtatgcaattgaattgggtgccaagagagcccccttactgctggaggagagtatttatactcccaccaaccaaaactagccgttgggggcgaaatcccccaactctgtgtactgccgttctgaccggaggtatgtggccggtcagaccgtgctactctgcaacggctagaaaactagccgttgtagccctgtcagagggccccatcggcctggccggtcagagcgacatggggtggccggtcagaccggcctcggctcggtcagacagccctcagctcggtctgaccgaatacggctccgtcggctctgtatcggccaccccgagcaccaccataccggcctccagggggccggtctgaccgcacaagtgccgtcggttagaccgaccttgtgcgctggtcagaccgcccgcttggggccggtcagactgccacaaggtggccggtctgaccgcccctggtcaggacgaaaaccagtgaatgcaaggtgttgtgtgtgttgtgtgaaatgtgagcacaagtctaaatgcataatgacctaatgtggcaattaaaatcttctctttgctaggtcattactcctcttaatagtacgacgaaactaaaaataaactagcaaatttgatcgccctacacctcgatcaattcaaaactaaagcacttgttttaccgtcttctttccctttgctttgcgccctcaattttaatccatcgataatcatctatgcgcacatctgacgtggatctaacttaaaatatatagctcaaaaacaacggttagtccacaattagtgcttgttattaattaccaaaattaacaacgggggcctagatacttcagctataaaccttctataagcttatgtagaggagagatataacaaaaaattaagggtgttggctgtcatgcaagagctagcttaacataagctccaaggtaaatacaattaatgtataagtgagagatagagagaggagaagaaaattatagccaaccttatagctaatctattatatgtgttggctttaagattggctaatagtaagaagtgagctctattattatccttgctcttatctctaataaaaaatcttcacctctaaactataaaaaaccgtgcaatttgggtccgttagcagtatggatatccggtttcgctgaggtggcatcctagtcaggaaaaaaaaagacccacatgtaagtgagaaggaaaagaaaatgtgaggtttgcataagaaagttacttaaaaaaaatcacattactccatctattatattattaagacagctcgaaaagaagccaccacgttcgctgtggaagctagaaattcccacattaatcgaagaaaaagaaaataagagtccaagtagaaatacaaactaaaaaataactgaaattcggaattaaaaataagcaatactgaaataggagtccatataagaacccaatacgagattaattaaaacctttggcaattctagattttaactgtttatagtagaaaagataagtctatagatctgtactgtgtacgttacatactaggagtctttgtccttttctatttctttggcggtgtacacagtacacgtataatctaattcaattacaaacctatacggagaagagttgtgctgccaaataaacaaagcttgcactgctgcacctatatattctgtagatttcaagcagcaacgattgggctagagcggcagaacccaatgatagcgggagccgaccatagtaaaaagacatgatatttacatagacattacaacaaacagatcaatacttgcaaccggcaatgcatcaaacaccaaaagtttctttgatgtttatgaaagtacaaatgatatcgacatattgtaattagtgtatatttttcacaggagatgagttagtgcaagccgctataaactgacagtcagattaaacgtttagattatagtggattcacaatttaacgttcataatttaacggttgagatataacacctatatataaatataggaattagagttgtagtgctaatacaggagtacaaagcgcgctgctcgatggaataatcgagatccaattccaaaactgttatctaaacctatttgattcctgtggaaaaaaaaagcaaaacaggaactaggtaggcagaaagccgtgtatatacgtgtgcacatgtaagtattattttttcagtataatcacttcaaaactatttagaacatactttgatatatttgttgccagtaaaaatgaagcgactgcctctttatctattcgatcctttttaatcaccaaatatacaaccagcaattcagatgatttataagtaactaaatttgaaataataataataataataataaagactatgaaaagaaaaaaaccatctacaacacaacatgtgattaattaaaattttaaaaaaaattatgaaattagaaaaataaaaacaaaagtttaagaaagaatacgatttatgaataacaaaagttcaaaataaaaaaaagaaatattaaaagaacaacccgtaacacaacaatggtaaataacaataaagagggagggataacgggtgagccgtaaataaataaatagggtgtagcggttgatgggacattttaaaacaataaaaatataaatgacgattagattcaattttaaaaatctcaatgacgattaagagaaacaacagcgggcaagccgtcaaggagcacagtcgtgacgtttgactggacttctaaaaagaaaaaaaaacaacgataatcataatatcatatttgactttttaaattccaatgacaattaagaggagacatcgggtggattgtagaacagtacaatgacgacatttgatgtaacttctaaaaatataaatatgtcaatcgacaagacaatgaactaaaaaactataagatctaaatatgaaagtttcaaagaggatgaataaaagttgtgacaggtcgggcgatcaaataaatgagtggtaaaaaagtaaggggtgacgacttattgacttttaaaaactaacccgatgataataagattcaatcttttaagatcggctagatggctatttaacaaatttaaataaaaccatgcttaaaaatatataattctggatgggtgctagccgtgcaacaaataaaggggtgacaaaggagtaagggtagcaacatgtgtgacttttaaaaattataaaattataaacccggggatgataatgttcgatctttgaaagtcctaaaacaacgagatagatatttaataaattttaagtagaatcatgtgaaaaattagataattttgttggtgctagccacgcaattgcgcggaccacccagctagtttgttttaaaaaagctaatttttaattaatcatacgctaatgagttgctccgttttttatgcgcgaggatgagttcccaacaccaaacaactcgaactctacgttagtgaccatcatattgatttgtggaagtgctagaagaacaggggtcatgactaaatacactgctcaaaatactacacaggcacaatagtttgagaatcaaccatcctaaccaggaaaattggagtatttaacaacaagaagtttcagaaaagattagcaaactgttagcagaatataactgatgacctgtcaagggcgttgatccctagggtagctggcccctggctacggagttcgtagccacggtccgtcttctccggcgaggtttgcccctccgccgcaggcttgagagttacgagagaagggaagaattgggacaataaccaaattgcttaatttctggaatgtgccgattacagagatatatggcctaaggcccaactaaccaaagagctaattgctcctaaatgcaagggctaataacaggaaactaattatcctttccatcctagccactgaccgtggcctgatctgccgcagccgcgcgttctgcctctgcgcgcgccgcgcgttccgcagctcggcgaacgtctcgcgctctgcggcgtcgcacatacgtgcgcccccacatgacatctccccctccgtcgagaggcagctcgtcctcgagctgtagagcagggtagcgggcgaagaatggctccctgtcctcccaggtagcagacgccgctgaagtgcccttccactggaccagaacttggcgcaccccacgggccaagcgggctttgatgactcgctcgggctcacaggccaccgcgccgtggtgcacgttcggcagcggcgggggagcgtctggaggcgcgccgtgccacttcttgagcagcccgatgtggaacacgtcgtgaaggcgggcgccggccggcaatgccaagcgagcagccacctcgttgatcatctccgcgatgcggtagggcccgaaataccgcagcttcagcttgccggagactgccagcgacagggacgctggggcgcgctggcggagacgcagaaggacccagtccccaacctgaaacgacactgcacgatgggacttgtcgtagtacttcttctggatggcctgagcttgttccaggcggtagcgaatgtcctccaggaactctgagcgctcctccatgcttttggccacagctgccacgcgggtgtcccccggttcatacgaccggatggagggagggtcgcggccatagaccacccggaacggggtatgccgcagcgaggtctggtaggcggtgttgaagacaaattccgcccacgggagccagcgcagccactgccgggggcgatcaccagtaaggcaccgcaggtacatgatgatgacacggttggatgcctccgactggccgtcggactgagggtggaaggccgtcgtcatgtggagcttcgtacccaccagacgcatcagctcgctccagaacgcggacgtgaagaccgggtcgcgatccgacaccatggattgtggaacgccatggagacggacgatctcggcgaagaagacttgagcgacggattccgccgagtatgggtgcgccaaagggatgaagtggcagtacttgctgaatctgtccaccacagtcagtatgacggacttgccgcgaacacggggcagcgcttcgacaaagtccagtgcgacgtcagtccacactccttgtggcaccggcagtggaaggagaagaccggcaggctggaggtgctcggccttgtagcgctgacagacctcgcaggtccgcacaaaatcctgcacaacgctcttcatgttaggaaagtggaaatcccggcggagtcggtggagagtgcgctggacgccttcatgtccctcctcatggacagcgcgcaggacctcctggagcaggggcgacgctgggggcaggtacaggcggccagcgaacaggaccatgccgtcggccatggaccacggccctgcgcgtgtgccggagcggatctccgcctgtagcgccaccagcgccgggtcgacgtcctgtgcttggcgaagccgctcgatgaagtcgaaccgtggcgcagacagcaccaagacagaagcgtcctcggtggtgtcgcgacgagacagcgcgtccgccacagtatttgctgcgcccggcttgtactccaccgtgaagtcgaagcccagcagtttgcccacccaatggtgctggggaatggtggacagccgctgatccagaagatatttcaggctgtagtggtcggtcttgacggtgaagtgccggccccaaagatacggcctccaatgccggacggccagcaccaagccgatgagctcgcgctcgtacgcagcgagggcgcggtgacgtggcgccacaggacggctgaagaaggcgagcggatggccgtcttgaatgaggaccgcgccaaagccgtgggaggaggcgtcgcactccacggtgaaggccttggtgaagtccggcatggcgaggatcggcgccgaggagaccgcggctttgagggcgtcgaacgccgccgtggctgcctcggtccaggcgaatccttccttcttgagcagggcggtgaggggcgcagcgatggtgccgtagttgtggacgaatttgcggtagtaccccgccaagccgaggaagccgcgcaccgcacgcgccgagcgtggctgaggccactcccgaatggcctggaccttcgccgggtccatggcaacaccagcagccgagataacgtggccaaggtatgccacggagtcgacgccaaaggcacacttgctgcgcttgatgaagagtttgtgctccctgagcaccgtcagcacagcccggaggtgacggagatgatcagcccatgtgtcactgtagatcaaaatatcatcaaaaaacacaaggacaaagcggcgcaagaaggagcggagcacatcgttcatgagggcttggaatgtcgccggggcgttgcaaagcccgaacggcatgaccaagaactcatacagcccgtcgtgggtgcggaacgccgtcttgtggatatcttcgggccgcatgcgcacttggtgatagccggaccgcaggtcgagcttggagaagaagcgcgcgccatggagctcgtccagaagctcgtcgacgacggggatcggaaaagcgtccttgacggtaagcgcatttagcgctctgtagtcgacgcagaagcgccacgaaccgtccgccttcttgacgaggaggaccggcgacgagaacgccgagtcgctgcggcggacgatgccttgggagatcatggcggcgcattgccgctcgagctcatctttatgagccgccgggtaacggtagggccggacagccaccggcgacgtgccctgcttgaggacgatggcgtggtcacggccgcgctgtggaggcaggcctgtgggctcggtgaagacgtcggcgaaggagtcgaggagcccccccaatagggagtcgtctgcgctggccgcgcggactgccggcccgtcctggtttggcgcgccctgccagcagatggtacggccctccaggtcgaacgtcagggcgcgtgtggtgacatcccaggacatccggcccagcttggccatccactgggtgccgaggacgatgtcatatccggcgagaggcatgacgtacaagtcgacgtggaacggcatgccctcgatggtgatgggcgcgtggcggaggacgcctgggcaggccaccttttcgccgttggcgaccgtggccgtcatccgtggccgcggctggacggacagcccggtgcgagcggccgccgactcgccgatgaagttgtgggtcgaccctgtatcaaccaaggcgacagcgtggtcgcgcccacttgaacccgaaccaggatcgggtgtcccacggcgacgccggccacggcatggagagaaaacaccggtgcctccgcgtcgacctcgtcctccggcgcttcctcgtcctcgtcctccacgctgtccacaaagaacagacgtttgcaaaccttgttgtggccgcgactgtacttttcgtcgcagttgaagcacaagccgaggcggcgacgttcctcctgttcggcctggttcaggcgcctgaccggccggttatcagcagcggtggcggcgggcggcgcgggcttggcagccccagctggagccggcaaggcgagttgcggccgaggcgcaggtgccggcaggacaccccgaccaggagctttggcgggaacggcggtgtactgctcgatcagctcgaactggcgggcgaggctcatggcagccgccagcgactggggattctgcatctggacttggaggctgagcggaggaagaaggcctccggtgaacagctgcactcgctgttcttcgtcgaggcgaccggcgcgggggagcagggcctggaaccggtcctggtagtcctccactgtgcccgtgcggcgacaggaggacagctcgaacaggggagcggaccgcagaggtggcccgtagcggagattgaggagctccttgaagcgagtccacgtcggcgtgccgcgctcgtcttcttggacctgcatgtaccaaagttgggcgccctcgaggaggttgtgggaggccatccaaaccttctcctcttgcatgattcgctgttgcaggaagaaggattcgcagcggttgatgaagattagcgggtcgctcttgccgtcgtagtgcgggaagtcgggtcgccagtgcttgggcggccggtctggcggctgatcgccaaagccggggcgggcgccggacgtagatgaactggtggtggtggcgagcgcagcgatcgccttggcgttggccgcgatggaggcggcgttggccttgatcgactcgtgcatcagcgccatgtccttggagagggcctcgatggaggccttgaggtcgtcacccatgtggtgggccgagcaggacgcgactgagggtgaggacgcaggggaggcggcggcagcaggtgggaaattgggcggagcgacagcaggggcggcggctggagtggtggtggagtcgtagatgggatcggtggtggctggggcagaggtggagtcggcaacggaagacgaagatcgacgtgaccgcgataccaggttgtcaagggcgttgatccctagggtagctggcccctggctacggagttcgtagccacggtccgtcttctccggcgaggtttgcccctccgccgcaggcttgagagttacgagagaagggaagaattgggacaataaccaaattgcttaatttctggaatgtgccgattacagagatatatggcctaaggcccaactaaccaaagagctaattgctcctaaatgcaagggctaataacaggaaactaattatcctttccatcctagccactgaccgtggcctgatctgccgcagccgcgcgttccgcagctcggcgaacgtctcgcgctctgcggcgtcgcacatacgtgcgcccccacatgacatgaccaccagcataacattactgctaatatattatgcacatatgcttccttcaaaaatattatgcacaacacaaaagtagttgcagacttgcagtaaatgcaaagttcactagctcaattgaagcatatttctccccgggaaaacaaccaaactgcaagggccatctaacaaacacagggaggatacaccatcatcgaattcaaatgtacatatctcgtggcagaataagcccacttaagagcctcattggtcagcctaataagccaaagcaaaagctaaaatttaaaatttcgaacttaattttagagttaattttaagatatttttaatgtaactttgattttaagttgctacgaacaaatacataaaaactttacctataaattaatttgtattccctagtaaactgttttggtttattagaaaatatgggtaaccgatgaggctctaagtttcgaaatttcacccgaaatttccgttgacccttaacaattacaagaagacagacatgtaatactgccacacagatcttcgtaagatcgtaagagacataactttgcagcggaaataatacggggggatttgaatccttgcggcggatcagcacatggattccgccccaaacttcatcgtgtccgcccagaacttggcctcctgcgcgcgggtaaaaccccactaatcacctggatccagcgtgttagggtttcgagggcacggaacaaatcgcgccaagagagagaagaagaacaagcggcgggtagatctccttcttcacgacgctgccgctcgccattgtcacctgctgctgcgaagctctctttctctctctcctctcttcagcctcacttcctctttcttctttcttttgggcttgactcgttttcctcttcctgggccggctcggcccggtctgactgctaccatgggcttggccagcgagtggccaagacatattcgtattcggtcacaaaatcttatatactcagcaccctctctcaaatcaatcacagccgagccgccggattattgcggccaaaaatcatacgtgcaattcagctccagtctcaagaattccaaagatatatcatcaagtcgatcaccagccatggtccctctagaaaacctacgcgacatgtgcggcgacatcatcgagaaggcgaccctggcgcgagatctcatggtacccatcgcaagccaactgatctccgaggacagggacaggtacaacgacctccatcgacattgtgtcctagcccaggatttcacgaacttcctccagaagctcaacaaggtgagcgcgctcgaccaggtgtgcacggacatggtgacgttcggtgccattgaagctatagccttgtgcgagaggccgagcaacgccttgattgtctttagggatgaagacagtgtagctatcacggtccataggcaggaagaggtcgaaaatgggctctatttcgcggtcccgcctctccaccttgccctcccatcctgtttcatcgaatccaaaattatcaaggtacgtattagtttgatcgatgtatgtatgcatgtatgtatgtttcaatctaatctctccaaaagttttaaaaaataaactagtaaagaattcagactctaataacttttaaaaatatatgttctaaaatataagagattatctgttgtcctatgtcaaactatcctaagtttagtttaattaagttttgtaaagtagagtaataacatcaaacaaataaattataagaaatatatttcataatgatgcttatttggtatcataacacgtaaacattcttatttcttcttttttttctataacgaggtaagaaaatctaaggacgcatggcactaatggcactgtgcaattttatctctattttatgtatagaaaaagaagttagctagcagggacaagtaattcgatctctagtactaacaatgattttttatctaaaccatgcataaattgttgatgaacaaaaaattgttatgctaactatcactagaatcaattaggtcgctcttatccatcagatccgtcaagtgaaggaaccacgaggccagcatatgatgcagaagctagcgcagcaagggcaatggtggagctaacattggaatctggagaatatcaatacc

SEQ ID NO: 28507 - DNA, 28713 bp, Oryza sativa
  unsure (1)..(28713): unsure at all n locations
gtgtgagatccacctccattaggagactgatattagtcaactgcaatttgcacgctagaagtttagagttatgaatatctttgcattctttttaggttccaagtcttgatccaagctattgaacaactggtggagaacaaggcgggagagaagatgacaccggagcagttgatatggttgtactcgatcatgctttcagcaactgtggtgaaacttgccctctacatatactgcagaagctcagggaatagcattgtccaggcatatgcaaaggtatacctgccttgactatataataatcaattttgaagcaattgcagaagagcgtcacttgatttattcgaacgcaagagtgaaactatgaattgccttattgaaccggtgaaaactttgctgctctaaaattcagttgcctttgtgccgctcaggaccattacttcgatgtcgtaaccaatgttgttggtttagtggctgctgtgcttggagataagttcttctggtggattgacccagtaggggctgtgctacttgctgtgtataccattgtgaattggtctggaactgtatacgaaaatgcaggtttgccctctagatttcttaatacttcgctcccctttttttaaaccagctcttttcgtttttttttaaccaagtgagattttttcattagcaaaagagtgaaactgaaacgactcataaaagaatgtgaaccacttaacaaggaaaatgatgtttagagtttaatggcagattgctcggcctcaattgcaccagttgtcaatagttttggcaccacaaatcttgacagtttgtggttgtaaatctttatgcagttacactggtgggtcagtgtgccccttcagatatgctgcagaaactgacatacctcgccatgaagcacgatccacgtgtgaggcgggttgacacggttcgagcttacagctttggagctctctactttgtcgaggtcagccattgcagctattcagaattacagattctgcaccaataagtttgttttttttttaatttttcgtgccactccatatcttcctcatgctagccaatacaacttaggatatttctgataatctgaatacacaggttgacatcgagctatctgaggatatgcgcttgggtgaggcgcactccattggtgaatcgctgcaggacaagatcgagaagcttccagaagttgagcgtgcttttgttcatgtggattttgagagcactcataagccggagcacagggttcggagcagattgccctctactgagccttgagcccttgacagctccagttttactcttgtgcagtgtactgaaattctggtactgtagtacagtcttccactggtttggtttgtcgctgaggcagcagaaggcttatggttacacgtacacggtgacggtaggtcggtagctggcttttgggtagaggaatctgtatgtctgagtgaaataatactggattcgccatttggtgcgtttccttttttgtttccttttggctggcctgctttcttgcttcgtaacttgaccaaaaagttctggccgtcgcaaagagctggaactgtgaatacattttctactgcataaaacgttacacgcatcatgcatcacctacacggttacacccgatagaattcggttacagttcaattacaaggcactcccgagtcccagaagctagcacgtcgagcagacaaaccctacagataaaatttctcctcgccatgcttttaagctttacgctaaccacatgcttataataataacgagcattgccgcgtcatttccagattgaagtggcagtgaagggcaacaaaatgatcatcaccttgctgaaattagtgggcagcagcaaccatagccgtgcgagcacccgtgaaagttgatatcagcgcccccagctgtaacttgtcattgcaagcaaagcttagccggtacctgcacacagacgccatgaacaacgtgccatcttaagggaaaaggccataaatggttatactacctacctttccaagaagactaaaggctaaaaatatttggaatatttcataatattaatcagttattatacttccataagtattccagatagccaaaggtcaactttaggtaattgcatcatgaaagcaacccaaagactcattttccccccaaatgcaaacattccacaaggcacaaataagcaattccaacatgtgaggtttgcttaacaactattgctttgcagtatgcaaccatttaactgtaatggctaaattgtgaaacacatacaataaagtatgttagctggtttaaattatttattattatttttcttacgtaagatactccatactagttatttgatgtgatgacataaatgactatcttgaagcatataatatgaataaatcagcaaaatgttccgtcaaagttttgaaaaaaaagggtactgagtagaaaatcagccaaaaatcacaaatgatttatgatcaaataaaatattatatgcaagttctaggtgaactaagcaaggcacactaaatttgacaagtaatcaactttacagctgaaaacaggacgtactcgatatcagccagatcattaatcagctttatgcgtacatcagatggcatctgtattttgaacacaaacctgcaagaaatttcttttgcgtattaggagaaggttttagaggatttgaggaataagaaggtttagagaaatatagggcatgaaagagggcatacatagtgacctcccgtatgatatcaaccaaggccagtccttttctcatcttcatatcagatatacctgaagcagataggacagtgttttcacaagactgacagcaaagaacaaattgcacaattcatgtttaaaccatgaattgtaattgttaggagtatgactttgataattaagaatacatttgaagctggttgaaaatgattcattcagcaaccagtatgctatctgttcaatgtctttcggcatggggtttcctgtgcaaaggtacacagcttcctctgttatttgcttagatgccatgtgtgttgactgcacataaaaggtaaagcaaatcagtgtaaaacatatatatatatatatatatatatcagttcattgtacaaaaacaattagtataacaaaacaggttttaatggtttggttgaataatttacaggcatctcacaagtaaatgatgtgatatcattgccaatatggcatggattagctaaatctagcatcacatgttcttgttatgaagtgagggataagtatggttcatccagatctatcttaacaggcaaaattttcttgtctattccaacacaacccccatgcacatgggcctttatgtttttcataaactaaatataatgattaatggttaaaaaaaagtaggtaaagaatgctcagcaaacgcttattcacacataacctgcaatatgttcaaagccttcctcatatcaccattacttaaccgcacaagggctgtcaaaccaccgtcatctacatcaagcctgcaagaacacaaagatgtggcaacaaaaatttagactaccacatgaagatagtgacacaatgatattatttcaaaacaaaaccaactgaattctcaagtctcaacagtcaacatgagcaagaaactttacaagagaaacatatcgaaggttctagtataatctgcaaaggagcattaagtgcttacccctcggattgtattatatgtttaagacgttccctaacatgagtgccatcaaggggtgcaaatctaaacctggtgcaccttgattgcagtgctggaatgattttgttcacatggttgcatatcagcgcaaaccttgtgctccttgtatgcttctcaatgactgtaagatgggggagattagaagatgtagctgaaagaaaaacacagcaatattgtggtgacacaatgagaaactttgaacaacagaccaacctcttcgcaatgcaaactgtgcatccttggtcatggcatctgcttcatccaatagaaccatcttaacagatgctttgctctacgcaagataaatatcagatatatgacaaaattgaattaaattgtataccagatctttagtaatgcaaattatgcaataccagtagctccaataaagcataagaaaacaagcataaaaaagatccatgagacaatatgcaacctccatgggattattggctcacaagatgactgcataatgcatgctaattacaacaaagtatgaccactcatacacaaacaacaggaatactctctcaacatgcatttccaaacccacgatagatcgtgtataggtaggtctaggaccaacaaagatcaaatctggtatatgctaaaacacgttcccccttattagaaagaaaatactactcaaatatcttcccaaaataataacatcaaaaaatgtaaagcatacccgaaagagagactgcgggcacttgcgaagtcttggatttgctgccttacaacatcaataccacgctcatctgatgcattgagttcaagaatcatgttgccatactgtgacccatacaacttccttgcaacggccagtattgtcgatgttttcccagtgcccggaggcccataaagcaacaaatgtggaagcctgttctcatttgtaagcctatcaactacaatataatgaaatgacacaaaatcatcagattagcttaatggtctaaatcagaaattaataaataggttgaaacagaaaaaaaaatcgctatttacttctaataatgtgtcaaaactcaacaacccaaaatatgtgacagcttacaataagctaaatttgggagagagagagagagagagagagagaaatatcagcaggtcattatatcacatactaaaacagttcctcactacctaaatggctaaatataatacagtcacacaaaacaagcagaaaacccaattgcatgactcaaatgaccccaggctcctaacaggatgcaacatagaggaacaactaagacaaatatggtgaaaactaaccatcacaattcatggcaccaagttaacaacagatcacaagctggagctcactagcacgaattgccaaatcccctgaaagaccaaatcaaccgccaaatcctaaatgtggagctggaggggagacatgagtgtagaaccacaaaatccccatcatgacactagcaaatagatagtgattattcacaaaaacaaaatagcgatactacctacagaaatcccgtgggctcgcaccacctcgccaataaaggcaaaacaacccccaaatcagtaacccaatcgagtcgctccgctcctaaaaccctaaaacgccgagcggcagccaccgactacgcagtagctcaatcatcggcgcaggcgaaaccaaaggggggagcggcggaagcttactggtgtcgacgatgtcgcggtgggcggcgacatcgccgagggattgggggcggtacttctcgacccagggcgcggccctaccgccgggagtggaggagagaggcgccttgcccttggcggccgcccccggcggcggcgcggcggcgtcgatgtccatcggagtggcggcggtggctcccgccatggcgtagcgcagagagaggcggaaaccctagagctggaggagggaatcggggggaatggttggcgccaattcgaaacccctctcgcggcctcgccttggcgaggggaagaaatggaagatggtcaacgtggtcagcgatgcggaggagggttgttatctgggccgattatgggcccagcccatttagccgctgcaactgggccttcgagagtagaattaggggaagaggttaattaaatttccaatcaccatatgtgaattcgaattgtcttattcaaaaacatgtgagttcaaatttgaagtgagtatagtcagtttagttcaaccgtttttaaattagcgaaaattggctattataactcatgattagtgcagtgcacaagctgaacagccacgctagaagccttatctgaacccatggtaaaagacgtgaacagccacgataggggaagctgaaagtgcagatgtgtgaagaataatctgtattcttttttatcttttctgcttttcggcaacatgtatatatacgggagtagacggccgctgccccgcaccgtcattagcgcagaaagcagctttagccgtccatcaacagccgaaagaagagagagacggtgccaggttctgaacggaaagtcaagaacgagattccatcttttctgtcctttattaatcttttccatgctatttcccatgtttgattaattaacatactgataacaaacggcacatttctgtcggtattgaggtgtttgtttatcaaatattctggtttggtatcggatcttcagtccttttctaaagaagtgtaccgcactacttggccactgttgccaacatgatttacatgccaggcttgtgctcactgataattaattaaggagaaaatgctctaaaaacgtttagcaaactgatctgggtacagtcaacgcagttagttaccaaactggtcgaaagttgcgatttgttcgtctgagaaaaaaataatatcgacttgattttgaactgttctttatttatagcacacaatagtgtgtcagtgtcacagtatgctgctgccattacatttacatccaagattaattgatactgtagttattaatgcctaatagctcaagacaccagagtccagacagtccgggctccaatgatcatgcagcaaaaatatcccctacctatcattttccatttttcctcttctccagcggtgaagccagtgatgagtagaagtaacagagtaactatactaaaatggagcatacatggctcggctaggtttcatccgtggaatgaaccgattcaaagttttgaacctgcacctgctaatcgatcgatcgattgatgatctttgcaaatttcattgctctcgtcggtgatctcggctcaccggcggcggttgacgagcgggaaccaccaatcttggaagcaagactggtaggagatgagcagcagcacgagcgccagcgccagcgcgacgccccacggcgaggagccgtcgcggcgctggtcgtaccagccgccgccgccgccgctgtgctcccctaccagcggcgccatgagcagcgacgagagccccgaccgccgcccgccgccgcccgcggccgccgcccagtactgcatcgcgagcaggagcagcagcggggacaggacgacgacgacccggacctggtcgaacaggctctccaccgcggactcgcaccgcgagtagagcgaggcggcgccgagcagcgacgcggtggcgaggaagatgaagaggtggaacgacgtccccgccccgtccgccgcctgccgcgcgtcgtagcggtaggacgacggcgcgccacggtcgtcgtagtagccaaggctcgccatgtctacaaggctacacctcctgctgcgctgctgttcttgccggcgatggacgaaagtccgaagctgcaagggagaagacgagatggctgctggtttatattggcgggagagaaaggaataccaacccttgcgagagagagagagagttgagctgcgctttacttggcgggagggggattccgcgattccttcacgagggaggtgaggtgaaacgcgagagcggacgaaccgcgcggcgacgcgtgtgccgccgccgaggcgtcgaccagtcagcttgggcttggaaagcgtcgcgcctctattgtcctactactacgagagcaggtacaatatcagcttataagcaagctccaaacatattttaaaaagataaaaaaaaagcaaagtagcgaactatagatctgtagctagctgcgcatgaactctaagatgtaatgtgtgtatggcaggtgggaccagattctaattttatagtaagcgactattatatgaattcaatattttattggttataaataatttggagctagtagtggactatagtcactatactattaaacttactctgaaaggatgtgcctttttgttttggaggcacttggcgagttggcgaaaaggatcttttgcgatgaggcgatgaccatgccacaatggcatagacggtgagggcaatggctggcaagttggaaagcttttggagaacggtgcgggtgactgggttgagtatggtgatgaggcctttgttgcctacgggttacactgtcacttgcacacttaactgtgaaaaagaacccaatggtccagtcatataatcaacgttaaagtacacaataacacatatataaaagttttacctaaaaatttatttttatttttggtttattagggaaaaagccaacgatgagagcctgaaagagaagtagtctcctatctacacccaagcaacaaagtgaagctttgctcaaggattagtacagcgctgcctatgaactacagtacataggacaacaccaggtgggcctttttttgttgaaaggccatcaggcagcagtttggttcctgcatggctgcaccggttgatttacgctggctttgtcagtggtcacccgagcgaggtaactgtgttggatgcgtagtactatggcctgtatggttcatgggcccggtattgtcggtgttactgcgtcccacccgactatcattttgctttcccagtatcaccatcactgttcttttttatatgatgttggttagtccatatatttaggatggagttagtaacatgccagaagaggtgcgcacttcaaggcaagaaaagggtatgcatgaaggtatcaccacatgccagcaataaaagatcatcatcctcatgttgcatcgcgaattctgtttattgaaccaaatgaaggcagggctggtatcaagtatgagcattgtatggaagtaaatggagcaggtatgatatgacaaagcaaacgtttgcatttccaaaaccaacgccggaccacaagaggcctgactattacattattactgaagcaagcatcccacaggaaaaacttacaaaaggttaactgatgatacaatcaatgtgattcactcacgcggaatatattcacaaaccgatgttctccccaagtgcaggatgggcagagccaatacatgttagtagatatatttggtaggggcaccagtgacaggagaatccaaaaacccattgcagcaattatggaagctctcagcacatcagcccaacaaggcctcacaactttgatcaaccggcgaatatacaagatgggaactaattcacactgcaacaggaaacctggtataaatctcttatcttacatacagacgtacccaagccagtcgcactactaataattaattagcctagagttatgatgttacgagccaatatatttggtgtcaaaatcctcaagatcatggccttgagactttttcagttttgccactagaacccacatgtttgcaagttcactttccaagaaggcttccttttgcttcgactcctcaattctcctttggagttctgcttccttttgttccttctccataagcacagcttctaatgccttttctctctcgtagcctgcgttgttgtctcttcttggagctggctcatgtcgtctactgatgctatccctccgagtacctctcagtccactgttggctctacgcggggttggacttctcaccgatgccaactcagaagcaagcttctcgttttggttcatgagcttggtgacttcttccgacaacgctttcaattcaactcccgcagccgaagccaagcctttcgcgtacgtgctttcctctagtagcttctggttgcgagtctctagttgagcttttacttcaatcagctcacacaccttctgcttcagctcatcaatctcaactgactgaaggacaccccccaaaagaagtaagttaaatgtgcaaaccaaccaagtcatagagaggcagcaccataatgaagagcaagattgcttagaacctcaaatggtacaagcagagatcattttgagtcatatggtgtaaaaataagaagctgcaataaatgtttttgaaatctacagtatgcaaagattatgagatagtgcttgcgtggaagtgcatgatcaatgatttgggataactgcctattggaacagatcagtttaaactgaaaatctgatcctcgctccataacacagggtcaactggccaagataaactttttgatcatactaaaacaatgttttcttcgatgtctgtgttgctgtggggaaatagaagtgtgcatagttgtgagggatacagtgacaatttggtgttaataagctattatatggcaagcagacatagattaactgaggaacttaaattttgaaggaggttctaagtggtctaggttctgatctgttggcccagttatgaaatgaaaggaaggcaaaagaaagaagatagaattaaacctgtggttcttttggcgacgtttcaccagggacctctctaggaactgatagttcttgatcagcatgattatcagtttcatggttaattcctgcattcttctgcatcataatgctatttgacagtgaatccttagcttgaagagtttggtaaagttgctctttcaggtgagcaacctcctcttgtaattccatgcattcagttgtctggcaacaaaagaaattcagagaagcaatacgaactgatttcagttatccaccattcaactttcagcaaaaaaaacaaattgattttctagcacatctaaccttttcattaagttggtcttgtattactctgttatctgctgccttcacctgcaataaaaaaaggggaaaatgaagcttcacagactaaacttgttgtgcgcattcacatgatagaaacaaatgcgctgttctgttcataacaaaccacacaaagctgtatctaattatgcacatgtatagcgaagggacaagaccaatcctgatctgaatttaaaccatcctaagtttgtgaggggagtaacaatttgtttgttcaccatatgttccatgacaatagagtaatattgcacaacaaagggaatactatggatgaaaaaactattacatacaattcgaatattatacagtcaataaaactaattgaaagttgtatattatctagcatagcacaataatctgctaccaaaaattggtgtgctagattcagttgcaataactttggaaggaatcaaggaactagttttaaaaattgggtattggctgataaaaggtttgcggcgatgactcctgttgcatgcaacgtagtggtgataattgagcttgaaacttgataatactggctgtgcatcataaatacctcataggaagtttacagttgataaaattcatatatataagtttctcttctctttttggttcatgactttttaataaacccttgtacaatacacatgaaagactgcaaagtgcacaaactttttcagtacctcgagatcaaaggatttctcgttgagttgctcaagcagttcagcataagactgaaaaaccaataataaaaccatcaaattgtttaatagaatacttggaacaaaacaacatgaactgaagcgaatgcaggatgttaccggagtaagttctaacttgtcagccatcccttgattatttgagatggaatgaggtatctgcctttctaaagacgctatctgatgcttctttcccttaatttcatcattaaccttcttcatttccatcttcatatgtaaagaagatagagtttcaaggtgaaaagcttttagcaacatacgaaactgaatatcaggtaaggtatagagtacctgaatcttctcattatttgggctccttccagcttcctcggtaaggcgctttaggacacttgtatgaagtgcaacctcccctgacaaaatcttcaattgctctctcagtaagtcaacgtgatctattgtttttctgctggcctgtcaacatatcacgtatcaaaatatgccaaaaagaagtccatagtaagacatcatgctgtttatattacatcactaggatttgcaactatattaatcttctacctgtgtctataaagaagtccacactagtaaatatttgagcggtttagttgtcttggtaatgctaaaaatgtatcatgtaccccacaccatgtgccatccatgtatagcacttcaaaatttaaattatgctcttagttaatacacgttagccaacaaaatatactacaacaaacaaacttcagctgttggctatgagttcaaaaataacacattataaaccagtaagccaatcatgactcattagtcgatcaaagattgtttaaaagtggattgctggtttaaaactttaactaagtcatccttttctgctttagatgtatttgtttagctgatatttcacatccgacaaatttcggcctttaattaccaacaatgcatgttacctaccagaggtgtttcttctccatgaaggctgtcagtagcgaactccccatggccaatgctaaagagatcaaccgatgcactctcaccaaccaaagaatttgatattcttggttcggaaggaaaattaacactctccccaataggtgttgaaggagcagttgatttagtcaaactggacttgtcaccttctgaacttgtcagaatagaagctccaccttcacgtttctggacaatagaaccatgggaaaatgttcgtgtgaatcaattattatttcaattttaaaatcaggattggtgcacatgagttcatctatattgtaacaattcatgacgattgcacttgcatctatgtaaaagataaatcaaaagaattgaataaatggactattaagaattgcccaatttaactatacccgaagtttaaaccaattaagaattcctttccgattctttttctcctccttcgaatcttcaagtgtcatgccaagtccttcaacaggagaaagtaattcattgctttcattatccaacacgatatcacgtcttttgtaaggtaggtacgcaagctgcaatttgaacaagcaaactttatcatacaggaagttacccatactaactataatgaggaaaaaaataaagtagtaactcaaattttctgcaaacacactaaaacagagtctgccgatttattgccaaaagtatctcagtaacaaaagcaaactacattatcgaaaaaacaaaagcaaactaaggtcaaagtgtaacatgtgtttgacatcataaccatacctcctcttccccaaaagaatgtcttcttcttggtccaggatgtggagaaaatctagaagtttgtgtcgccttagtggagaccaagataagctttgtgagacgctgtatccttgcaagcaaagcagctttagcttcctcctcttgttcgagcctagactgcagcttgacgttaccatcttctagcttttcatatgataaacaaactccagttaggatgatacattcatacaccggcaaagtgaacatgcaacattatataacttgtaagtataatattattaatctacagcacagttcaagcagacaggagtagctgaagacaaatctgtaaacaactcagttaatagcatagcagatctcgcatacatacagttaagcataatgtgagcagcaaaggggcaattgctataagacaataaatattccaccttttgtttccaaaggatgatattatcttctccggcatccttcactggagtgccagtaataatacccattttcagctgttctagttcttcctttaatctgcgaatctcattctggtatttctttattaaagatttttcatctataatctgcccaacataaagaaagattcaggagaatatgtcagaaatacttcatatgatatttggcacaaaaataatggttaagaattcctgctaacataacctactttgttttgtgatgcttggacctcaatgcgttttgcacggtgggcaaatttcagtgtattatgagtctcttctgagttgctcgatgctggagtcactgtacagatcagctgcaaagtataatagaatgaagttgtcagacatccaaatcacattgaatattaaaagaaatacattagctttaaccaccatcccaactgataatgaacaacttactgaaacacgtccttgaccactcaaggatgactgaagtagacgtgttagttttgaatcacgaaatggaatatgtgtagcttttccgtcagtaagtttcgatatcacctggaatacaaaagggaaaaaagcttcttaacttccaacctatgatgataacctctataacagatttcatggatcatgacttgcggcattattttatatgtaaattgaattcatttaactggataataaatgcaaacatatcaacagaaagtcaagcagtgcaacagaacacattggaacttggaacatattatgtcgaatgaatagcaaaacagatacaaccacccattatgccaggatgcaaagatcttctgatgtacagccaatgactggacagtaatcatgagacttacagttccaagtgttagcaagcttttattgatataagatccttctttccggcgtactccagtagtttctgcccttgagctctcggaacctgccagatcgatgaggttctgcaaatgagtgagacaactaaataatcaatacatgattttggcagtatggtcaagagataactgaaaacctaaaacccaccagttgtgagaaggtaactgcctcgccttcattagactcaccacaagggctgctctctacagtctgtcagataacaaaacgaaatgaaaagggagaaggaccatatcctgatatctaatgttcttccactagtgagaagtatattttgcatgcaatttataatcttgcaatacagcagtgcaaaggaaatatcaatgtttcgaagttatataaagatatctaaaaggattaccagtgtgaaaattgtatgacttctgctactaagtagattgaagttagtggatccaacatgtctatgctctgcaaaggaaatatgaaggatctccattagtgaaagaaaactttaaaccatgatcatttttattactcacgatcctgataggttgcttctgcaaataactaaatgttaatcatgctaaaaatgaatggcacagctggaatagtgaacaagttgaaagattctaaaagatggtaatcacaagaagaccttctccagcagcaatgagggatagggcatgtgcaggagataatactacttcttctttgataccctcaacaaatgttccctgaaaaagtaaatgtagatgaaggaactatcagtcaactgtataaaaatgatgctttaaattcattcaaaattctataaagtttaagaatgaacttcaaagcatgctactatatggggtatgaagtatcaaaagatacatttcccacacaggggaacaaatgaacaatgcatggcaccattgtctctaatgactaagcacatgcatgacaatgtttacacttaactttacactgtttttttactctacacatttgaagaacaagacatagccatattaagtgaaaatgcacatgttacctgaggatcctctctaattcgtaagttctgtccagctggattgagcagatcattgacaacctagattcaacgaacccttaattagagcagcacaaaacatgaatatgtgaacgatgcaatgatacaaatatgattgcaatgacaaacctcattgtaaatttccaagtatgatacacggagaagaaactcgcgatttggtgtctacaatggtcagacagtgacataagtgtacagtgcataattgcatgttagtttatttgtatatacatgatgggtccatgtttaaaattacctcttgtataatgctaaatgcgtctttgacagccaaaggtatgatccctggggatctttgatctccctggcccaaaagaacatgtgcatcaagatatagatgaacatttgaaatataaaggaaccaacctatattgcacaatataagcctagccacatataaaaacgaaaagtaaacttcaacatgagtaaattgcaaataatatgctgcagatgggaaatggaagctgcctatctctgtgaatggtaaccacaatacatttaaaaaattacatggtgataatatcatattatcagtagcatttaacatgtgacactttgattccctgtcttatttgctggacttgggacttagagagggtcagataaggctgagtttttattagaaaagaggaacacataaccaacaagcagttataataacttgactgcttcgttttttttttcctggatgcacaatatggttatactctgaagccagtaaaatctatgattaaaagattaatagaaacatgaagctgtaagtgttctcacatgcattgtgtgggtcttcccgctgcttgtaacaccatatgcaaatattgtacctgtggcaataaaaaacagaaacatttatacatcaatctttgcttgaaaccaaaaaaaaaaaagaatccaccaccacattctatcaatgaatggtgtgcaacaataaatagcttatgaaccaaaccgcatatatctgtatcgctataatgtttagaagatatctcatagccatagtatcatggcattctgtaaatacaacccaagcctttcttttcttgaaaagttagcttgaaacagtaaacaagctgttatcatggccctatataaggatagtaaagatcaattaccatttactccctccatggcaccgctgacaacatgttgagcagcaacatcatatacctgacgggttgtagtagttggtgcaaaaacccgatctgaacagcatactatattagtctctgatcaagtaaatttgaagggggataaaacaatatactgatagccttagaatagccccttaaataatattctctcttttcatgagatggcatacatactcgcttgactagctcattttatagaagaatatattgtttttcattcataggctagtatatggaaacaaggtatgcagaaactcttttattccaaacaacaattttggtgccttaaccagaaaatgtcaacaactgattcccaaaaatggagagtattgtgcaaagttatatatgttaaagtaaactattgaagtccttcacgcatctgtacatgtgtcgattcacatttttataagaaaaattatgaataagactccgttccattaacatgacatactgccagtgcaaaacctcttataattagcacaactctagcaagtccaacagtgatgagccattgaagtacaaactcaatattcgtttgtacatgaatagaacaagttatattaccatgttaacacttgtttttacaaatagcctgtatggagccacagaatacaaatcagcgtacagattatgtgttagtacaggaacagcaggtctgcaaacataatttactcccaagtgtcccagtacaccagttggcaaaactactatattgaaatgagaaataaatataattgatgaagtgatattgagaatcccaacaagtaaaccgaacacttagcagaattgagcataatcttttaggcctttctttctattgcactgctaagaacagctgtaggtccaagtcgcaatacagatttgagaagcatttccgggacactaatttgagtgatacaatcaaactggcacgagataatttcaggcatccaaggtacccacaaaaaaacaaggaagtatcacgttcacagaactccttctagaatctagatataggctagaggactcacaccaatctcacctaatactccagccttatgagaacagcgatcgtttggacagaactcaactaaattcgcatatgccaaacgaggtgatgatcagaattcagccagcagagcgccaatgtcaatgccaccaaaagcaggcacgtaccgtaagcataagcaacgctgggattctgctcgctcctcacgaccgtgtcgccgtccgcataccatgccacctcctccccttgccgaatctcgcgggggcttcacaagcgaaaaccaaaacccaaatcaaactgcattcccccaaaatccaagcgcgaccaaacgaaacaccaccaccaccataagcaaagcgagacgaacctcagcggccggaaacggacggtgacggtgacattctccttgggcgccgggtcctcgtcaagcccggcgaacagcggcgacgcgggcccgtcgagcgagagctccggcgtgagccgcgacgaggacgtggtggtggtcgtcgtcgacgtcggcgaccccgactgcggtatcggcagttgctgctgctgctgctgctgcggctgcggcgaactcctcaccaccgccaccgccgccgccgccgaagacgccctccgctgccgcgaagccggccgcgtcgccattgcctccacagcccgagatctagcagcacgcgggggcaccaccaccaccacccgccattggatccaatccaagtatccaccaagctaatcgcccccccccccccccccgccgctttatgcgggatttttcctagggctccccttttccctttccgtctggctcactcccccccttcactcgtgggtggcggctttcggatggctttcgcactcacgcctttttgcttccgtcggaagcgatgcgggaggaagaggaggaggaggaggacgcggacgccgctgcaaaatgtagaagaaaagaaatcctccctctctccccctctctctctctctctctcttctctccaactggctcttttggtgggtttattacgccacgggagggagcaggacggggtgggtgggtggggaagaggaggctgacaggtggggagggcgctgatgggtccacatgtaggtgagtggatgttgactcgtcggagtcactggggtaggggtttccgtggattttgattggttgtgggcgttggggtggtacggaacggaaggagaggcctctctcttctcttccaactgttgcgtagggggaggcgacggtttactccggtttgatgatgatcatctagcgagattgctgtttttcgagtcagtggtctcattaagaaaacgtactagcaagtttatcatggtagagtagtagtagactagtagtttgatgaatcaaataatgtagtactaccaaaaatatggtagtactatcataagccttgttttgcaaaatttcataggaatttaatctggccctgctcggctgtcatgttggcagctgtgacaggcccattacctgtttcaccccaaaattaagacgtgtgatgcgaacgttaattcttcactttaaatgcacaatggcgatggttgtttctgtaagtcgctgttagtagatcgcactgttatggtggtggttgcggttgtgctggacgagtggactcctggaccagtaacatcattctccctcacagccaatcgatactccttttgcgcccatttctagttggtgcaataatctccatatatgggaacctaatacatatgctcctctcttaatgcgtcacttacactgtggcacaccgaaaataacacctcttgtcccgtatccaggcaccacgcgccgatcccatctcctgtacccatcagcgttgtctttgtcgcgcgcgtacgtagctagagtagtagctacggcctacggcctgggcgcgtcgcgcaccagcgcgagcgggcgcgggcagacaggacgaacgtatcacggcgcgcggtcccggttggatggatcccgccgatcgagcgacaacagtgccaggcgcgccgcgcgcccgcgcgtcccgtccccccatcatccgtgtgcccgcgcggccggtcgttttccaacagcgcggcgctagctcggccgcatcccccggcgcccggtcctcgccatcacacgcccgcgtcggggcacgggaccgcgcgccaagcgccaaacgcgcgtgctccgagggcgtttgcaaatgcaaatatgcaacaacgcccgtgagccgccgtgtggccggcgagtgctcggcgctcgccaccaccatggcaccataggcggacgaccttcccgggcgtcacagacggagcacgggcaagagacaaacccgaccttcccaggtggctcgatcgtctcacagacggaacacgggaagcgacaagtcgacaacccggggcgccactgtttgggatacaaattatatgatgctgcagctcgcagctctctgcaggtgcgtgctgctactgtgctcggtcctctggtgccggatttctttcgagagaaaatgccgtggaaatggaatagtttccgtcacttcggtcagctgagttgcacactcgcaccacatgcgttcgcccagtttgttttgactactggacaatggacatggcgatttggcgagaccgtcagtagtggccgacgtatagtagtactagtagacgagacgcacatggctcaacgtgacaaaggcaacgagtgctagctgcttgttgcactggttcagtaagaaaaacgaagtcaaatatgatttgaagtgtattaaactcctccgtgtaagctcgtagtctaatggactatcccatcatggaaatgagtggacatggtgcccttggacgtacgcagtagcttggatggtatagagtactacggtatgattatgtcctgcacttagcatagattcgattcgcaggtggagcaattagggcacccacaatggttatctataagctatctacaagagatccatgtcagcatattttcctacttgaaagatattaaatgaagagagagagcaaagctatctactagcttagagatagtctatagagaaaaacgagacagtgcatgagagagctatagatacctatgtagacatactattgaggtggtttactattaatctagtctattgctgagatgtacatgttttatagagagcaccatactttaccattgcgggtgctcttagcatgctactataagatgattgtcaggattctattgtcatcattagggctcatgctctgctccatttcttttacagctaggagatgctctgcaaccttggactgactagtgttttttcctgaatgtcctaaattgcaggcaattgaaaaagaaatttcttgtcagggatcagaattcagaagtactccatccgattatctgaacttgtttcagggaaaaacaaacttagaagcatgaactagcagaacctgccatcgtcacactatctgtattttagtaggaggaccgctcaggctactcctacttcacaagtcctttgcagcacatctccagaagatgcagtcatccaatgagacatacgcctgaaatagtagcccatgcaccaaacaaaaatctgcgtgattgagacacttaatcgcgtgcaacgacgagaaagaaaccgattaaaaatactgagtagctgggctggtgattcatctgcctttgtttactggcataatgccattccgctccaaggcaggcagggtcctaccagactatcaaccatcgagattaagataatcgattccttgcaccttacagaataataattgtccggtcgcatgcctgctctcccagaataatacaccactaacattacgaatcattagccatggaaaagctctcagacaagacaaaaagacccaatccataccgtataaattataatcatattccagtgatcaattcatccactgcaagcactattcagtcttcacacaaacaaaaggaaacgaaaacgataactccggagacgtcgaagcgaggggtgaattgactgttgttgccttatcaggtgtgtgtatagtgtatactcctgtgagaggaagcgtgacttgtgcgtgccgccgacaggagcccagtgccctccctcgtttgcttgcaaccacggcgggtctgacgagctgatgggcacgcgagacccatcgagaacgtgacggcaacaacaacagcaacaaccaactatttaagccaggctgttgctgtcgagcgcgacttgcgttgcatcgcgggcagcatccatgctctctgtgccacgacaacgcgacggcgaaagctgcactggatctctctctccaacatgcgacagatcgccgcaacggcgtacaacgtgcgaaggcacggcagcgaacggaagtgcgacgaaagcgaaaaggggcctcacgggccaaggggccgaaacgcgcgacaccggtgtggatttggagcaatggcccagtatgcgttggcgactccggagctccaaacttgggccgagttgctaggcctggagagcccaagacgaactggaggaggaggaatgcaacgttgtgggcttggtaggccatgaagtggataccgttctttctgaccgggcaatcaatctataacgtgggcttgttgcgtctaaaaattgtgaaagtctggtgtgtcgatagtagatcgatggttacctctcgataattccctatgatggaacatttatatttctatttataaattcagtctataactgcgaatgcgaattcgtagacttatcttggaaaaatactatcctgacattgcaagtctgttggactttgcaaatatatccatcacaagggagaaagaagagactggtttctctgggcataattagcgagatgaccaaggtggcggtgaaaagggcaacaggcaagcctagtaggaaaaaaaaacggacagacggttaaaaccaaaaaaccagaatcagcatccttgacggttttgttcgctcacaagaccgtccctgtaattgatccagagtgaaatggttgaatggtctagcttttcatactatgatggcaaggtagtggtggtgctaccgtggccatcaacggatccagaaatttgatacatcggtattataatatgttgattgtgcttaaaccgtggtgttatcttctacaaaataagtattttagtagtaggtttgccaaaaatcgtgggcgtcacttgaccataactattacactgcagatccacccctggcattgggggtcaaaggaggtagtgggtaaggttgaagatggaggcttaaaatctgaagtgatantcagtggagctgttgaaaacaaggaagagngtnangcgggggcatgccgttgccgctcggaggagaggcggttgggttagggggaggggagtagggcactagggcaggtcccaccaatggtgacggttgaatagaactatagaggaggatggtatgagtgttgcaatctaggataaggagtggctgacatacctcaaagggaaggagaggagatcgagaataagttttcatattaatgtagcaacacgaatcttttgatgcgatgaaccgtccaaaataattaaatgacaaaaaattatgggtattttcatgtgacaaaagctaaacacccaagtagaataacatataggactacatatttgggatttactttggaacacgttttgtgtacacggcatgtgtttttttgggtgggggtgttatatttttgtcgttaggtagaagtacttgtgagtgggaagctgatgatgctatatgcagtgtccctgtgtcagcacgagtggaccacgcagctgtcacgaacataggagtatgagactgagatgcagcaaaaccttttctagcattacatggtgagcaaccagtaaacccagcttttctttctactagtggagatgttaccacgcagcgatgcaccccgaaggagcaatgttgaagctataggttcgttgtttgcccctgcgccgctctgagcactgtgtatggcgcagtgaatcatcaccgctctgccctagctcagaattgtttctcgtgtcagattgattgtacttgtacagttataatctcgtccctttcctggcaacaccaagtacagccaacactgctggtcaatagattctcctattgtcgtcgttcattcataaaaacaacgaagtcctaagacctagctaggctacaacctctgattatatatggctctatcatatgacatgcgtatccaaatgcacctaacttcaataatgatgatcaggcctttatatagtatatttatgcggctaaattcgtctgtcgcttttcgcatcagcaagtaattaacagttcacagagatatatcgatcgcgttgaaacactggtactctctccgtcccaaaaaaaagacaaaccctgggttccgtgtccaacgtttgaccgtccgtcttatttgaaaaaaattattaaaaaaaatttaaaacggccaggttccaaattaaaatattattatggtttattattttacaacaataaaaatccaattattaaaaaattttaaattaaaccggccattaaaatttgaaccggaaaacccagggtttgccttttttttttgggacggagggagtatcttgctagaaaaagttcatgcatgttgacgtcgaaagattgagagatcagcgggtagaatctttcagtcaccgtactgtgacagattcatgatctaaaatgatgcatgcacgatgcatgatgcaggtctggggataatattacgaccatatactacttcatactgttagtatatatgagtagtgcatttcaattaacagtatgaagttaaaattccccggagaagccaatcatttctgcttaacgacgtcccaccctatgcaaacatacaattcatatcttgatgggcagtactgcagtgggtacccatgattttcaccttaaaaaccgtgccaatcacagcatgcatgcaaatggagaccagatcattcattagggcggatgcatatgcatgcatctcgtgtcagatcggtaggtcgatcgatccatatgcatcgatcgatctgctgcagccagtaagtatatatagcctgcccccaccgcattgcatcatccagtcggagtacgtaggcagcagcagccgatctgtctccgattggcgccggccggccgcctgcccgcctcggcccggcccatgtctgctgccttggtgtcggaagcagagcttcgctcgcgtcgtcgtcgtcgtcagctagcaactgatcaacagttgcgctagctgcaacgtacgacgagcgcgatgagatgagcaaactcgccgtacgttacagctagcgtctcgtactgctccggccagcgcgcggccggccggctgcccggatcggagtaccaccaactctcgcccactcgcattccgatgcggttaaggctgcacatgctagcgcgcgcgcccggtacgtatagtagtacagtacatgcttacaaacagcggcaagaacgaagagcaaagaaatctgagaaagatcaatgcgtcgtcgtcgtggtggtgcaggggaagcacatggattgaatcagtatatagccttagctgctgaggcgaagacgcgaggtgagatcgtgatcagatcggtgatgagtgggcggcagtagctgaactactggccgatctgtgcatctacatggcttcgctctgctgggcacaagtacagctgcatgctgcatgcgcgcgtcttctctgggcgctggtcctgcattcatgcatgcccggcaaccactgcatgcgacgcggtggtggtggtggtggtggtggtactgactactggctgctgctgttgccttctgctggagctggacgcatatgtcatatgtgcatgcagtactaccaccgctgcagagcaaaccaattggcatgattcagtgccccctatttagatctgtggagagtctcttgatgctgtgtgtagtagtactgatcatcgctgcatgcaccttgctggccagcagtgacctgtagctttctatagcttcggtgtgtgtatgatcctatatatcgtgcgtcatgacatagcagtatatagaaatagttagctgcatctggcagcagcatcagcttgatagctagtatgcggtgcgcgcaggcctatcgccgatctcattgtttgtctctgtccttggcctgctttcttgcttgcctctcctctcccctcaaaattgcatattgtgcttttctgtacatgggacatccatgcatagagcgcagatcagttctctctgctcttctttatttgtaatggaatgataattgaggtgtttttcgccggagaaattaatcatcaattccgcatgcatgttccagtttctgtccctaagaccaaactttattgccaaaccagtgactttgtatctgaatgttgtctgtcctgatgcgttttaattatctatggctatagtatacacatctgaaagaacaaaatggttgcataataagtagttgagagcatgcatgaattgacggagatgatcgacttcggctttttttgcagcatctctttgagctttgctggctagctcagtaccggcttccggcacagcatgcatgcagccgtgcatattggagtaaaagcatactataggagtaaaattaataacgatcgaagcactgcagactatgtcaggctgctgtgccaccaaatgacgacaagaacgtcgaccgaaattgaatttcgtaaagtacgggggccgtacgatgatcgatgtgcaatgcaatgcaatgatctattagctgttctgaaaattcatgacgtgtggccggtggttacatatgtacttgatgagattaattcaggctatttaatcaaactatgtacacgtacaccacgaggaaatccgtggttttgtgatctcaattacgtacgcgtatagatggtcagtagatccagtaaatgtttgtactgtactgtgtgttcctaggctattagcccagaatgtttatgtatgacaggctgcattttctcccgatgtattgattagacttagaagtagtactagctaatggaattagcagctggtcgtacgtacatgtgtaagtacatctcatgtctcgatttatatggcgctgaatgattatcatctatagtagttcatatttcttcatgacatttgagacccagaacttttttttatactagaaaaatgatgagctaatcacacagtagcgcattccattttttattttacgggtccaattttctgtctcggaccctgtgaatactctttattgattctttttcctcctctatcaatataaagtggtaaagcttttgcttttccttaaaaaaattattgttcactaatatgatgctagctactatacttttgtcccattaattcgatcatcgcgcaggggtataaacaaacggaaagttatcctccgggattgtctattagggtttagctaggtagaaaaatcagactgactaaaattctatggagaggtgggtcaataccgtaacgtaactagtcgccaatctatatattgcacagactattatatatactgatactacaaataataaaattctaaagttatgctaaacatgttgattacctttttgaattattgtagctacttatattaaaagaacaagtcacatatcagtttcaacttactaattaatttaattttgaactttagttagaatatattaacttaataaaataataaaatagagattgcaatctaggtaccatatcacatatattaattacaaatttttagattattaaattagagccatgctattttcaattgcacaatttattaaacatgtactatgcatggtcacgataattaatacgatgcatcaaatcaatggccagagtttatggttaatatgagagctttcttgaattatccagttagtccatgagaccatagggaaatcattactagctagttaaaacaaatcatatgtgtgctatgaaattcttttctatgtgcgcttttaatttatgaaaatcaattaatacaccctcatgtccgtacaatattaattgcacgaggaacaattgtattttgcattttaatttcttgttatatatcagcagccttttccttcacgtgccaatctgccatcagtaaattattatattactgatcatctataagaggaaggccagaaagtacatgaaatacacctggctttggcagatggagcacatgctcaaaagagccatctctgaacaaagcaattcagatggacgtataattgggccatggggtggaggaaaagaaaggtcatgtacactatatacatacgggcccatgtacgacagtgttggatccacacattttcaatctactgctgcgtgctggaaccgttcttccacacacatgcatacatttctgtgggtaaattaattattcctgtttattcaagcaaattaattaatttaatttcctgtttattcaagcaaattaattaatggactagttttttcttctgtgttttctttgacttttcaagccaatattgatatccataacaagtgcatcttttgccgttttggaattgattttttttaactgatctttgcaattcgaaggattttctttttctttgcctggtaaaaataaagtggcaacacaagctaggtagctagctaaacttggatccggacaaggcaaaaagagtagattatttaagctatgagaattaacataccctttcttgcgactgctaatccacaagaagaaaacctaattagacatggattacaaatggaggtccaagctgacaccctccttctgccccaattcacacctacctagcatctccggcgacgtcgacgagcacgacgacaacgaaggcgacgaggacagcaagctcatcggcaccatctcgtccttgcatgccacctcccccgccgccggcgtgcccgccaccgtagtagccagcttgtcagcgccctgcctgccggccgtgctgccgaaattctccgtcgg

SEQ ID NO: 28508 - DNA, 7056 bp, Oryza sativa
  unsure (1)..(7056): unsure at all n locations
tgcaggtcgttggagaattcgcagccgaacagccggattgtgtcccgcgcctgctgctgcggcggcggcgccggccggatgaacggcagctgcgagaacgagtcgacgctgcgcatgtcctgcggcttcgccatggccgtctaaccaaccaaccaagctatctgcttctacgtgaaccaaaaccaagaattaaccacccaactcggggcaattcttgctagctgctgctatatcttgcgtctccgcgctgaagaaattggctacgagttggtgtggttttaaggggatatgggagttgtaagctggggcggaggagagggggacgaagagggggaccatgcaagaagtaagagcagagggggactaccaagcttaaagctcccccctctctcatcaccaagtacaaatgcagctgcagtggcagttgctgttgctgcttgtgccctccctgcctagctaagctactgctagtgcaagctatcgcctcatcagtctcacacacaatgacacaaaacattaaccccggcccatttctttcttggcaaatatgggactagtacatatacgtactcacacaagtgcagctatagctagactggttaggtatagctagctacagagagaaattaaaatctggtagtgtttattttctttcaaacttctaaaaattctaacacatcagatgcttaacacatgtatggagcattaatgtggacgaaaaaaaccaattgcatactttacatgtaaattgcgagacgaatcttttaagcctaattacgcgatgatttgacaatgtgatgctacagtaaaatttgctaatgatggattaattaggcttaataaatttatctcgcagtttacatacggaatttgtaatttattttattattagtctacgtttaatacttcaaatatatgtccgtatactttaaaaaagtttagcacacgaactaaacacggtctctctgatgatttttttttttgccctgtccagctttcatgcatctgtagctatcagtgggcatcaagtggggggagatgggtagtgtgactccgtctatccgtcgctctctccctcccctctgctgcctctgggattggctgtagccgggggttctttatgggaggttggcttctttacaacatgagagaccgcaggtggtcctcctggggacggcgacgtgctcgatcgcattctgcttgcttgcttgcttgcttgcaatattgctctctccctccctgttcatgctgctgctcnnnnnnnnnnnnnnnnnnnnttactgcatgccggccggccggtagtgcagcagtcatgcatgcatcgtttgcatgcgagtttttatctctttatagctttgcgcggtggtactgctgctaccatcgtttgtagatcgatcgatcgatgttctatggatggcatggcatggcagcaagctgcttcaattcgttcgtttctctccgtttctccgcctgtcgatcgatatggtggtatctttttgacagcgcggttataataatcgtgggcgcgcgtacgtacgtgttcgatcgatggcgcgcgctgcgtcgatagctgggatccacatgcatgcttgattgctggatcgaaagctagctaattgagatagccagctgagtgctgcagttttgagatcatgtcgatctctacatacactccatggctgctacagtagcttttttttcccctcctctctttttctgcaggcttttgtagaccttttctttttacggaattccatgcatgcattcagcgatttttcgcctgcttgttgtagtagtgatatggaaaaagggtaatttcattggagttgtttcagagagatactacgtgaaaagttgtcaatgtcagtaactcactctcctccaggacgtctggtttcatatggcttctgaattaatgacccctatctaccacaaatggaattggccgtagttgagacttgagagatatactactgtcggtgttgtccatctagctagctagctgttcgagtagaaaaccaaacatctcctacacaggtagtatagatcagtcgatccagtctctccaacttgtgatgaacattaatgctcgataggacaagaaaacattttcaagcctcatgggcgcgtaaggccgtagagtgaccgtgtgccaaccgcgatgctatttgaacttgtgttatctctttaagaggtactcgtctggataagtacatcgccaacatcgaaacagtgcacgcatgtgtctctcgacaagtacataatgatgacaccaatgaaatctccatcttaatttcatctgtggtacagacatcgcatatgcatgtcttttttttctttttttaatttcttcatgtccatgaattaagattgtttgtgttacaatatttctactgcctaaattaacggcggctcccaggatagagggacacatggaaaagctgagtgaaaacgcaagctcgactgggactcatgatctcagtaacattttctgacacttacgtgtatgacagatatcaatatcgaccagaacgagctcatctaatcataatgaccactcagagatccacgtttatttcaagttgaagaaatcgttccaaatgatcaaaattccttactacgatttggacagtttttcactggtttaattaacctggcgcaaaaacgaagaataatcaaggaaggaccaccgtgtagctgtcagtagtatgagagccatctatctgaaaacacgaaaatgggaacgctcagagaaaataggagtagaaacaaagcgttgatgcgacacgcaaaagtagcaacatttatgtacatcgacgtgcatctggtcatcagtactcatatgccctgcttgttgctgccttgcttttcttttttttcttctctgcccctgtactggtacatgtcgtcgtacgagttagctagcgggcaacagttgtagccacagcttcgccgacggcgactccgaacccctgcaggtgcaggtgggtgcacgccgctttcacggcgacgtcgcggccgcgcgctcgccactcgacctgccggtcgcgccagatctcgcaggcgtcgccaaatattctcgacatggacttccatttgtgtgttgtagtagtatcatcgatccatcgatcgattgtctcacgcgtttttcaccttttgccccctctccttgtccaaattgacaccgtgttcagttccaaatattttcttcaaactttcaacttttttatcgcatcaaaattttcctacgcacacaaactttcaatttttccatcatatcgttccaatttcaacaaaaacttttaattttaacgtgaactaaacacaccgtgaataagcttcttcttctccttctcatcaggttgcagtaatttattggcagatccaactcccccgatccatccaccacacagttttcctcgtaaatgccgtggccgtacgatagatatattgatggtaggctcgagctagccgtcgataagacacaaacgcttgtcaggctggaaaggatttgacagggaaaaggtacgggtacttggtgcaaataattccgtgccggttaggctgctgttattaccgtgggcaagtttctcacccacgcacacaccgatcgaccgatggatccgtacacttttgcacgcgtgagccgtgtggaaaagtcgactcgcagcgggcagagacgacggtgcggccgcggcggcggtagcatcagcaacgtgatggtcgtcgtaactgccggaaaaggacgccgcttgcatgttattttcggtaggaagcgatcgagatcagcgcgagacgagagctagctagctgcaattctgcggctctgcccaacccaaccatgcgaattgcagtgcatcatcaccgatcgctcgctcgctgtctctctcgctctccttttcgctttcgctgcttccaacgaggggcaaagcacgcatatggatgtgcaggtacggagacgactagtatgcatgctggtatacgtgcttttcaccgcgctagctagctaactctagttgcaggacatgacagccttaccactgctcgaccagagtactacctcccctctctcccacaatagttgtcactttgacttttttttaatatttaatcattcgttttatttgtaaaattagtgcaaatataaaaaaaaataagtcacttaaagtacttttgataataaaacaagtcataaataaaataaataataatttcaaatttttttaataagacgaatgatcaaattttacaaacaaaaactaaaagcgacaagtaatatgggacggaggtagtactctcttcacattttgttttggatttttggtgggaggctagttggttggagaactacctcatatcaggtactacataccaaggatatggatattcatctcttgagatgatatccctcgttacttacatgtcacctaaatagttataaagaatacgaaaacacgataacatagtgacggagcgtggggctcctcaccgggagaccgcgcaggcccccctttgccggttcggccgggggccctgggtgagattctaagctcctagtctgtgtgtggagggttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctctttttttctaagtgggcaaggtcctccttttatatctcaaggggataccacatgcaccatctctccctctctttcttttgtgtggggactcatcctctcttccctccaacttgactcctcttcattaatggacggagatttgtatggctgccgtccgaatgaccttctgatgggacggcccatacctacctccacttccgtcggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccgggaccaacgtgccatctccaggagctaacacgccggctccggctagggatgagtgcttggaggctctcatcctgacgggatagggcgaggcgtgcgtcagaccgcctgtcgccatctaacccacgatctgatcggtctgtgactggtcactgaccggataaacaagcgcgctgcactgcgttacatgcggcgtgacgcgctcgtccaaaccgcaataaatgtggttaggtgagccccgctatgctcacctacccaatatacgcggcgcaaaacccacaaggggtcggtgcgcctcggccctcggggccgagacgggagcggtccgacccctcggggagacaaagagaagggcggccgtatcacccttgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgtgagaaacgaggagccgggcacaacgttggcaagggtataaagtcgccgaggaagagatttgcttccttcctctcgccattattccccttgtcttcgccgcttgcgccctaactccttatttcctgtgccctaccttcgccacacgcgctcgctctcaaacatctcttcttccggcgtcatggcacggggctccgctccgcttgacggtagcgtgctgccgccttcccgcatcgtgagcgagagacaggccggtctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatctcttcggctgttccggtggttcttcaccgtacagccggtgtcgccgccgtcagtgattggtggttgctacttccagccgcgggggccggtgctgaaccgctacattccctgcgtcttccgcaagaagtgggatgactggaagagcgactggttctacacccccctcgccgacgaagcgcgcctccgacttccgagccagcctccagcgcaggcctccaactggcgggcgccgatagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccggggggtcaaatgggactgggctcctgaggacttcaagatagtggtccaacgggtgctgaatctcagctccgtggaggcatccctcattcctcaaggagtcctccccctctgcagcgatccagatcgcgccaacatcctgaccatcatgcaggcggtaggggtgtcggaggagcgggctcctcgaggccacgatggcacgggcgggagccgcaggggggaacaatctaccccgggagggggtcgtgcttctgggccccgcg

SEQ ID NO: 28509 - DNA, 9551 bp, Oryza sativa
gggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacagaggctcggaggcgggaatctgaccggcgagaagccgtggatcgcctacgggaagccgaggaggccgcccaggtggccgtccgagctcgccaagctgaagaagccgctcgggaggaggccagacttcgccaggccgaggcgacgacatcctccgaggcgacctgtgaaactgaccggcaagaggccgcggatcgccttcgagaagccgaggaagctgctcaggtggccgtccgagctcgccaagctgaagaagccgctcgggaggaggccagacttcgccaggccgaggcgacgacgacttccgaagcagctcgcgacgaggccgcgggcgcatcgcttgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcaggccttggccgtcgcaaacaccacggtgttggacgggttaagtgcccagatggaggccttgcaagcagagcgggtggagctcgacgccgcatgggcatgtgtcgaagaggggtgtcgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacttggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgtggccgcggcgcaacggctggcggacagcctgtccctccgcgaggcagtgcgggaggagcaggcgcgccgtaatctggaagatgcccgcgccgagagggccgcgctgaaccagcgggccgctgagctcgaggcgcgggagaaggagctggacgcgagggcgcgcagtggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgtgccggccggcaggcgggcctctggggcgggcggactgcgaagtacgccgccaaccaggggggcctcgcccagcgcctctcggagatagccgggactctccaacagctccccgaggagctcgagaggacgattaagtcatcctcgagggacctcgcccgaggagcggtggagctcgtactggcgagttaccaagccagggatcccgatttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcgacccgggcgcatcggagtgagcccccaggcccccgccaatctttaaatagtttcttcttttcttcttccgaggccttcgggcccccttcttgtatagactaatttaatatgcaatcaaataaagaggaaatttttttgtgtcaattctatttgttgtgtgtatgagacgaggatgcctgtgccgcggttcttttgtgtcttggcttgagcaagggctcgtgcccaggtcctagtcctcaaatggctcgggtcggggctagtgcctggggagatccacatgtcgagactggctaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaatacgagtgacctatttcaagtcaagatccttcaaaaggaaacaacagcacatatacagcctttaggaaatcgaaaatgcttttattgaaatacagatataagagaaataagaatctgcatatgtggtagcccccggccagccctgcacgcccgaggggggtgcggggttggccagagcccgaaacctgacacccgatccccctttaggggtagaagcgacgaaggtgttcgatgttccacgggttaggcaactctgtgccgtcgcccgtggccagccgaacggagcccggccgggggacgccgatcactcgatacagaccctcccacattggtgagagcttgctcaatccagcacgcgtttggacgcggcgcaggacgaggtcgtcgacgcagagtgctcgggcccggacgtggcgctgatggtagcgccgcaggctctgctggtagcgcgcggctcggagggccgcgcgccgccttcgctcttccaagtagtcgaggtcatctctgcgaagctgatcttcatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttctcgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttattgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctaggccggctgatggatttgcttggcgtggaattgacacgctctgcatcgccggaccaggtcgactgcatcattgagagctgttggccaatagaaaccttgacgagaggctttgccaaccaaggtgcgcaaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtttgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaagcgaaccaaatatctgaggacctctccgctcggcgaggtcaacgtgacccccgcaccggcgccctgaagagacagggagccgttgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagttccctctcgattatgcaagatttggccgagggggtaagacgtaaccaccgtgacccgatgtgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggtgctctttgtccaagcggcctcacggggtgcactcgtcctctgtgccgacgacctcggggtcggaggacgacaggggcggccttcccacagtggcctcggggccgtcctgggggtcgggggctcctggcgtcgtcggacaagcgggcaaagggccaactccggtggtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctcccggctctctcccgggccaagccagcacagggtgggggtgcgcggaatgaggattgtcctcatcgcgctccacaaccaacgccacactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagagccttctctcccagcctcgatatgaaccgacttagggcggccatgcaaccggtgacgcattgcacatccctaagtttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttctgctagatccgagagtaaggtctcttggttgcgcgtctttacaaccaagtcatcgacataagcctcaacattacgtcctatttggctacctaaagaaattcgagtagtacgttgaaaagtaggacctgcattctttaactcgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcactgcgagacggtgctcaatcacctccctggggaccccgggcatatccgccggtctccatgcgaagacgtcagcgtttgcccacaggaaagagacgagcgcgtcttcctatttgccgtccagaagaccaccgatccgtgtggtcttggacgggccgtcgcccagggcaacctccttgaccgggacctcgtcgcatgtgactatccgctgcctcgggacggcgggggcggaggtgccaagcctctcgtcgcctcccttgggcttggacgcggcggcgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtaaccgggaggtcgatatgacctagcggccaagtgtgacccggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcccccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctctctcctcctcccacttcctcgtccgctcagccaaacttttgactgcgcggcagtccgcgaggtcatgaagggaggtgttgtggacgatgcaccacatgccggttgggcgctccctactgagagcgccggcctccttcttttggtcgctcgcaggcctcccctttcgggtggcccacggagcgccctcgacggcgaggacatgaccctcgtcgtcagaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacacccccctgaacgcgtagatcaccgcgtgtgcagggatgcatggtatggtgttgcggacttgacagaaccgctgaatgtaggagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccctggcggcctcgatcccggtcgtgtagacctggagaaactcggcggggttgacgctcccgtcatatttttcggcgatgtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccaaccaacgttgggctggagactccgggtcagggacaatgggcgggtgacgtaggagcgcgccctggggcgtgctgccgtcgccgtagacaaggaggcgacgctccccatctcgccgcccttccccatcacccgtggatgtcgaagtcgcggatccttcgaccctctcgagcgcctcctcctgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagaatgacggagcgtggggctcctcaccgggagaccgggcaggcccccctttgccggttcggccgggggccctgggtgagattctaagctcctagtctgtgtgtggagggttcgcgggagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctttttttttctaagtgggcaaggtcctccttttatatctcaaggggataccacatgcaccatctctccctctctttcttttgtgtggggactcatcctctcttccctccaacttgactcctcttcattaatggacggagatttgtatggctgccgtccgaatgaccttctgatgggacggcccatacctacctccacttccgtcggaagcaggcgcgacgtgggaacatggctgtctgctgacgacatgaccattgtcagaccggtcacaaatcggtcattcttgtccaccacgtgtcagtttaacaatctgcatgttcgcccttcttcata

SEQ ID NO: 28510 - DNA, 6789 bp, Oryza sativa
ttggatagagtgatgaggtgaaggacagaagtgaggagagagattatgagctacttctaaattaagaggtaacctccacacaaacttaaaaaaagatgtgtgagtattagatgattgacatttgtgtgttggaagtgacatattgtatatgttgccttttagtttattaatgaataatatggataaaattaaaggtggcatttacgtctatcatagtatttgctcttgtagtcgccgcggagtccggcaaataactgtcataactttttcttttcttttcatcttctttatatatggctgggtgcttaattgtacatagttactaagtatatatagttagcttaattatcatgcctggtttatgtatcggtatgtctctgaattggtctcgtgtaaaagatttgccgtttgatggaatttcagaagttgccgtacaagaccggtactactagtgttggacatgtcaactgaaagtcgtttggcccaactgagaaagtcgaaactggctcttaacagactagataccttaagaaagcaaaagaaggaacagcatactgacctaattaaaagctttctgtgtcactctatggttcaattcccgcgttttgggttacttgtgcacaacaaaagtactagatcctggagcacaaaaatccaagctgcaaccgagggaggctcaatctacagagtatatattcctgattatctaaccggcctgtcataggtggtgtttggttggagggactaaagtggagctaaactttagtccctctcacaaaaatataagtccctatggtagggacttatgtttttgtaagagggactaaatttagtccctagttcccaaacacccccatagtattttcaggctgaactcttgttgcttgggtcatgtgttgcttgctgttgattaatgagggtgctctgcttttttgagcacttgtctgcatcacatcatatgccaaagtctctccacttaaagtaagctagagacggtactccaaaacaatcatcaaattccagctctattgatggagctccctgtcccctttagcttttggatgagactttggatgctgccgcttgggaccaaacatgcagctagccacagcccaattaaaccttgaacgcagtaatcaggatgtgtccttttccttcttttcgtgtgccatcaatcccattgcctcatagatctatgcatcaacaagcatcagaaatataatacattttcttagtgaaaaggcaaaccgaaagaagatcagaatccctgaagaaaccgacatgcacaccatgcagatagtactaaactggagcacgatttaacacgttgccactacaagataatcgttgtggatccaccagtttattccagataaattaacactgttactctgatagatactcctcctatctctcacctgtctctaccatatatatatacgtggtcatgaggtgatcactaatagtactactatatatagttgacggcaaatttttttggcacagaagatctgaagatgcacacatatgctgacaactgcaggggcagtgtcaagctgttaatgcagatagggaaggaggtaggctttgccaaaggctttttggtggtgttcttctcaaagcataaatatgggtctgatcttgctgtcgggaaggagatctccaatcctccaaacctaggaccacacctactatatggcgcagctagtcatcggctcacctcctctcatcacccttcaggctcagatcaatctgcatgcacaaacaagcaagattcaactagaaagagcaatagtagctggtgggtgtggagtggactcgtaccgctcacatgacccatgggtgtgagcaagagctggagatatttaattagtctgctttgattggttgggaagagccatagaagccacaacggtgggggtagaaagttgctttcaataactgtccacaactggttggagtacccttgtcgttgttgaaattgcacccctaaggctaggattagttcctaactttttcttcaaacttctaactttttcatcacatcaaaaaacttttctatatacataaactttcaattttagcgtagaactaaacacaccctaattatgtctaaggggaggcaggaatgtccaaataacaagatgaaacactctgtgattttacgctgtttggtcacttaaacatcgatctgatctcttttttttccaacaggccgctagaaattgaattaattggatgatctgaaagctctgtttatctgaaaattactgtatcagagcatgcagaatatatatatatatatatatacaacgaagaactagtataattaattaagttgttttcgggggagcatatatgtttctgttcccgagaagactcgatcaggttgtcatcgccgtaaccaatcacgtcttatcccttaatgccagcatgtacgtacggaaaacatagtaggatcagagtagttgctactccagctagctcatgtaaattctctcccggccgggcacgttcgagacaagatagtacacccaccccacagttcatacccaattcaaactcgcatctgtcgagctatagcttagctagctacctgcttcacaactcaggagttcaacatcatcatcgttagctcccttgaatgaatccccgtgacccggagaacgtgtcgtcgtccgaccgtttcagcgtcgatcgatccaacgacaaaagacgctgcggccggcggtggagccagcgcgctagctagctgcacgtactggagttacgtacgtacgcgcgcggcactgcaccgcggtcgacgacgtcgtacccgctccatccgtgcatgcacgagttgcgccccctccccccctactacccctgctccggctggtaggggacacccctcacatcaacccgcgcgccgcagcaaatccatccatccatccatgcaaatgttaggttcaccggccggctcgtttcgctacagatgcgcggattgcgccaccaccgcgagcgcctgatcgctctcgcgtgtcccgcgagatgttgggcttgtggctctcgcgtgagatgccggtgcgagccgtggagtacgtgggatttgcgtgtgagacgccgtaaattcacccgacccaccagcagtccaggcgtccagcacgttggatagggtgggggatgctttgcttattaagggaagaacatatgagcagtagtactgggcgggcgcgcttgctaattaattggtttttgcgcttgctcgtgctcgcatgtggccgcgaactaccgtgaattaatgtgtttggaatttcgacgtgatcgtcgcgagtcgttattcaaaatggagtactgcgtactagtaccagtgtgtaactgtagtgtgttcggttaggttcctgtacgtggaaccagctccagcaactggtgacctaagcttttctctagtttctttgtacttgttgctatttgcacggctgcctgcagttatactaccaagcactttaggtacggtacgtgcattgtagatgtcacttgtttgttactgcttcgtggagaagtgataccgatttcccaggagttaaaacttagcaaatcttgtacaaaaaagtgctctcgtttgaaaagaaaaaggtccatcaaaatagcatatactagatgccatatatacgattttctatcaatcagaaagatattagaaaaacgtaaaactatgtacagttacaggctacaacaatctgaatgtctatgtaaaaaaaggtgaaacaacctttctaatctactttcacaggtcacaacgaatacgaaataaccattgctcggacagggagtacagtacatcagcatccccattcaccggtctcgaaagctatctctacgcaatttatgagaacgacagcgcgcacagatcaaagtttgtacaccccgtccttgatttcagtacacaaaggcccggaattcaattcctttgccggaatccgtaggtggtaggaaaagccgtgcatggccgggaccccggcttgtagtactcgtacacagtagtcgtactctacatcagtagtagatcaggccgtttgctgaacatgcccatgacgcccattcaatgatacactggctgtagaggagtagctttttttttttctatctcaaacgacatgcacagcactctgagcatcatttaaacgtggtcccaaatgtaagcgctaccctctgcatgcatgcccgattcattcgtcacttgcttcatctgtttcattgcatcatgcatggcacacaaaaggcaacgacacatgcataacaagcacaaaaagacgcaaacgaagagaggatagggtccaagtgctttgcactagggtcttctatataattttagaaccgaatgtaggagaaagattttcatcatctaactatctaagggatatctcctcatttttttcatattatttatatagttaaaaaaataaaacaagatatatcaatatgagatatatcactctacatgtcaaactcaaattttacaagttgtaaaaaaacttatattaaagtttgaggcgcattttattattaaagttttattttggatcaatcttaaaccaatctctttttactttggactgaataattttgtcctttttttttgattcaccaactcttcaatataaaaacaaagcctatcaaagatatgaccagtgtatagatggggaagtttattggtgtgctagagccgatttacttgaggtttgtgtgtatggaacaagttgtttgtggtggtccaaactgtgataaaattatttggtttaaagtgaaactttagtagtaaaataatctcagttcagttttaagtttttgaattaaaactaaagacatgtccattgtactgcggataacacatgaaaaaatagttcataatttccaatgacaggttttatataataagagttttgaatatatactatctatgaccattataaggcaacccacctaatcagtggatatgtcccacgaaaaaatagttcacagtttccaacccacgatcgagtgagcaatggattttttttttgcgggagagagtgggaagtggatttggttgaataggtggggctagaagagtatttttcatattttgttagtcaattatctgttttctttacctcacttaatttgggaccaccgaacggacatccaatctaggggtaaatggattattcagttcagaaaagtgagggcaaatcgcaaagtctgaaaagtaagggtaaaatcacaattgcactaaaaaaacatgagtaagaacacaattgtctcttccttaattagaggagatataatagcatactacaagtcagctataaacacatatccagaagaaaaaaaatagagagatatgactagcgggctacagatttgtagtcacctgcagcacagactctatgacgcaatgtgtgtatgacaggtggtaccaactattaatagcgtagttatttatatgtaactattgtatgaattggctattaaattgattatagatgatttgaaactggtagttggctatactattaaactttaaaattgctcttaatctcaaatgaaatttatgacgcgcgaagttgcactccgttctttattcagtgtctgccttgtacatgttcctgctccatgtttgtaggatctgaaaatcaaactgcctgattaaattctgcatctgacgttgtaagatgggaaatgtttacacacagttaaaatacagacaacgtacatggatgctatatatgctacgacacaccaattcaccactatgcatgcaagcaacagcatcgtcccttgtccctagcttatctggaaaaattaattcaataagaacttcgtagcccgagtcccgatcgatcgactactatcgcacagcgcacaatatttgccagtgccggcatgagagcgacaccttagctaatgcatatgcaagcttcctcttccgagaacatggccctggtccaacaataatgtgaaagtactgcatctgttgatgcatggttaggtgcttgatgtggcttgtgtcttggcgtaatcctgagtttagttgccttcattaacgccaaaaaatctactcgatcgatctcactgattggataccatccccctgcatgatgcacggacagtcggcggaggtcactgctgttgagatggttctagcccaaccacaccacccatggggacaacatctcatatcgatctaatcagatcattaccacttcgtcattggtcacacccacacacatatattcccctgtagccgacgttgatatgacagtctaggaacatacaaaccctgatcctttcatcaccagtactaaccagctggtgtaccctctctcgtcacgttcccacttttcccaaagatgggagagaattgagaaaagagagaaaagaaaggaaaagaacaactagcttgatctgtcaatcagatggatctatcaaaccttttttcttaaagagagcacgaatttaggacgcaaaccatgtatatttcagtcttgtctttcttggatctgcagctcgcagccgtcgccgtcgtcgcgtttgcatgatcgagccgtggtacgcggtgccgcgcatgtgtggcgcttcgcgggcctctcggactacaccgcgcgcgccgccgggggcgtacgtcgtcgtcgtcgatggcgagtaaacgtcagagagagatacggaaaacgaacgcacgctgctctcgtcggtttcaccgtctcgttggctcgtcgtgaggcatacgttgcgttgttgttttttattttccccggcttgaaaagcaca

SEQ ID NO: 28511 - DNA, 5306 bp, Oryza sativa
ggggggggggggaggcaaaaggtgaggaataatgagagatcgctgtcccgggaaggcaaatcacatcaggattgcagcagctgagggcaaccagaatggagcctttcagggcttaagctcaaagtttttttccttctttctcagatatatgcatgcatgtgtgcctgtttgtggcaaagcctgtgtcgggtctgtgctgttcacaccactggctggctgaatcttcaggagaaaaaaaaataaaaaaggtgcacatcttgtgttacttttatctcgcaacaacttgatgataattctgctctgatttgattcgggcctaactcgccagacacgctggcccacctgtcagtgatctagcacgtggtttgcagctgcaacgcgtaggacacaataacacaaatccctctctctgactgcccccaaacatgccattagagcacctcgctggaattcagagctagtaggatatggttgttggtgatgcctgtcagcgatcgagcttaattagtccaacgctggcacaccactgcttcctgaatggagcagcgaagtactccaagaagcatcacgagggagtagggacggccggggttttggcaactgggcatgcaccccagtttcccgggcgcgacaggcaacggctgtacgcacagcgaagcctgctgctgcaaggccgatctagctactcactacacaactgaccgtggccaatggatccatcgttaatgccgaattagatgtcggttctttgtcctgccgtggacgattgcaccgtacgttccctgtgcttctgctgtttttaacctttgccgagttgtaaaaaaaatccgtggtttgtacacgtgtcgtgaactgcaactgagaaagaacacaaacaaaggcccaagccaatgaagcaaggcccacttgatgcaagcccagattagcccacatcctgaagcccaatcataaccactgcctaaaaaaagctcaaacctatccgtatcagtatcatgattcatgagtacttctctaagaaaaatcagtatcatgagtatggtattgattgtcaatatttttggggccataactcaagaaacataactgaacttttgcaccatcattatatcatgctaagaaaagaatttgctgatacaccatcatcgtcacatcgatcgctgccatgtccatggaagcaaatgagtacacatatcatttctacatcacaaatatagcccagctagttctttgatccagtcgcggttggtgccgaggcagacggacagtactcgcagtcacaaccaactggaccgaagcaggtgccggtgcccttgtacatcctggagcagtccgcgttgcatttggcggcgctgcatgccttgcccggattcaggataactgaactacagttcggggttaaggcagatatgtctgcagatctcgccaccatcactgcagatacaagcgatagatttcttgcttaggagttgcgtgatctatgtttgcgaaatcaacggcgagagaaggtgcttaattacctgatgatagagacatgagggcaatggcgaccagcagcaactgaacagtcctcatcctttgtttggtgttggtgtcgaaagctagaattggaagactgatgagtgattttttcgcgaacgcactgatgagtgatgagatgagatgcgttgttgatctatatggcaaatgccatgattttatagtggatccatggggatgctctatttttagaatcacttccaagaaagacaacagattaatatggattacattacaatcaataggcttatatatgaattataatgcttctaaatacaaatcatctatttttggtagctttgatggctgtgattatatactactaattcccaacaatggatagggttatccggttcatatatgtgtcttgcattaatttttgcccatacctaaacgaggctagtaccggagagactacatgcaagaaccttcaaaaggcctaacttgtcataggcataggatggcagaatacaattcagaccatgccttgtccagagtcgggccaagctggttaactcatgctggagtcgtccggctttggaatcttgagaaagatgtcggtcctgtttggactttggagctggttaactatggataatcgtgggagctataattttagaagaaactgtagctgttaaaagctacagggaatgccactgcttctgctgaaagaaagtggcaagagtgaagtatcctaatttcccaccggttgcttgagcattcgtcactggaaaatgccatgcgccaattcactattcccttcattccaaaatataagttataaccacccttaatccaaagaccaagaaataattattatcatcttgtagtttggaacattctaataaatataatgcatgcatctaatagaattatataaggatttaaaatagtaataatttaatagagaaaatgtcataattaattgcatgcttgcatgcatgacttatattatagaacatctaagaaaagtggttgtgccttatattatggaatggagggagtatagtttctaatgtgctaaaaagacaactcaaaccattatttttatataaccttgagccaccttagcaggatttaaggttaaacaaatttttttgcttaatcaaaagtgtgcaccttcacaaaatatattttgcaatatatactgcagagcaagataccgcaatacgaggatcacaaatggattaattccatgctactgcttgatctctgctttgccacctacgatctcaaatctcaaattacgtttttgtacatctccatgcgcctgagctcagattcaacccaactcttcttgaagcccccctcaattctcaccaaagttgcgtggaggctctcgggcatggtggcgagctgctcatcggtgaagcgatcgaggaaccggtatcggtccggcatctcggtaatctgcctgactcgcaaaaagggctgcggcacgaggggcatcctgtcgccatagcccctcgccgccacagcggcctcatggcgctggcgcaccacggcgccgtcgctcgtcactgtggcctccaccttgagtcgcttgttcgcgcacgccgcctcgccctcgccgtcgctcgtcactgtatcctcccccttggggcgcttgttcacgctcacgcacgcctcctcctcctcctcgaggaggcttatccacggatctggggtcatccacgccatcgctctctattggaacttggaaggcgaaacctattagtaccagatttaattgcgaaagcaatctgtagatttgggtgaaaggggaacggaggacacggacatataaagtccggcccaacccaacctctatcgggtcggattctgtctcgcaggctgagctcggaacagcggccatcaatgattaggccggccgcaggccgatgataattttgacagccctaacctaatatcctttatgcacggccatgctgactgttcatgtgcttgactaattttgacagccttcctcgggagaattaattctgcttcactctacgtaattttaatttgagcaaaggtagcatgatgtaccaaattttacactagatttttagtacctcgtggtatctcctcaaaaaccatagaattgctcttttaatttaggttacatagttacatcattgataaaataggaattaagattgcaacgaagatgcggcataccgatgtggcattttcattggttttttttattaaaaaacacagtacaaacataaggctggattggatcggtatatctaaggttgacaaagtcaccatgaatgcatcgtctaccactgaaaaataattagatataaatgcgagcattgaattggatcggtatattttgagattgacgaagtctacataaacgtctcgtctaccactgataaaataattagccataaatgcaagggtaaattgattctatcacaagcaacctaatcagttgaactaagttcacttcgcacattttcgttgaatctagagactaatattgagctatatgataaattttgaagatttttttataatataaaatgttaggaactaaattgaggaccatattaactaaattcactctaaaagaaaatctgcaaaaacaaagcaactgaactctctcgtggccaacgctgtaatgaagcacatgagaccccccccccccccacacaccaaaaaaaaaacagagagaggttcacacagcgttctatttagcgctgctgaaaataggacaatcccatataaatagtctctttatttaatcatcaacatctctccaggcatcacaaaatttaacaatcgcacgcgtcacactgtatgtaaaatttaagcctgatcgacgcgtgagtgatgatcggcccctgtgcacacagtactgcacatcgtcgtcgatcgaccaccgatcgatcggccggccggccgggttattagttgctcgccggcgccggggaagcgcaggtgtagacgcacttgcactgcgtgccgatgcactggcccacgccgcctttgtactgccgcgggcaattggtcgcgcactcgccgctgtcgcacgacggggcgcccgggttcaacaccgccgagcaggtgtcctggaagtacttgggccccgctatcttggccgccatcacgcctgccatttcgttcaatttttttgaattttgaagcgatttcgttcaaggttcaaaccaagctgatcacaagccagagagagagagagagagagagagagagagagagagagagagagagagagagagtagtagctccgagtgttgtgtactacctgatgaagatgatgcgacgaggaccatggccaggaggaggagcagtgctgcgtggaaggccttcatctctgactctgacgccattggcttttttttttccttgtgacttctgctactgctaccggtgcttagctgcagctttgtttcttttaggtgtaccgaatgggagtgtggcgtttatagtgttgttgttcgtattatttttggaatcacttactacagtaagttgtatggatatggataacgggaacgggtttaatttcaggagtaattggcattgatactgctatattcgtttgtgctgatctttaggattatatagtggccttgtattaagggttgtaccaaattggtacctaatcaatagtaccaattaaaggtgatatttcggtgcattttaatttgtcaattttcacgagaaaaaaaaagcgcatatgctccgtatggcatggaaaatgtttagatgggtcatagtcaatccaaagcatatgttaaagatgttatagc

SEQ ID NO: 28512 - DNA, 9292 bp, Oryza sativa
  unsure (1)..(9292): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttggtatagtggtttagcccgagaggctatttggcgccgaaagtgttttttttgtctttgttgtgttcagggtgaaggattgattcatgctacaagaaggaatttgtctcaaggtggagtttgttgagtaccctcaatctccatctgcnccatgctacgggagtgtgcgtcctttcttgtagaaaaatcattgtcttcttgcataaggacacaagagcgttgcttgtttggcctgattcctaccaagagtgcccgggtacatgacacgaaggaacattggccatggactatttccccaatggataataataaaggaattgctaccttcagtcaacaaaaaacctacctttaatacttgcaaattttagttcactggatgtgtttcgcaattcgtgctccagctgcttcttttccaactccgacaaactccttttcttttccggtgccggcgacaacccaaactccggcgaaaaattagggtcctggggtggggtggggtggaaagggtgggagggggagggggaanaaggaagatttcgccgggcttaaagggatggccgggggaggcggcagcccggcggtgggcggcgaggcaccggcggcggcaccggattcgcggggctggaggacggcggtgggccggcgttggtggcgggggcatcttgccgccgacggctcgaggaggatggaggggggaggaggaggggaaggacgagggggaggaggctggccgaggggcctcgccggcgccgttgacgccctctggccagccggcgaggcgggcagcggcgcggtagggcggtggcggctgggaatcgcgtgcgagagacaggagtagcggtggcggcgcgatctggatgggggaggaggagaggagttagggttaaggggtctgcacgaatcttgaagcatatccaatgatctaaaatttgaaagataggaggtgggattttctgtcaacatatgtgtagatgcactcttataaaagacaataaacatcacctgatctatgattccttcaaaaaaaaaacttacttgaatgtaacagtcgacacttgacaccactctcataaacttgcttcattgagcagttggctcaaatgacgttctgacgttgataggcatgtgattgtttcattctcaattaagttgaatcaaataggccctttttccctttttgagtcaaacattcttagaaaaaccttccgcatgctttaatatcttgttggctaagtcgagcttctaatgagacatgcatacaattgtattactttgtttttttaatataagacatagttgtcattcacatgctccatggctcttggattgtcacggagtcgtcctagagctcgggtgagaaggagtgggtaactcacccaccacggtggcgacgagtttcccctgacagcggtggaggtgacctcggacgataaaactccagcagaggacctaggttttatagttttagggttagaagttggtgccatggtggagcagggtaggggttttggagggtggctttagagggatggatggggtggtggaaacatcttagtgggtgcagagacaggtaggtgacttgggtgctgcttgagccgtgaggatggaaggtgacggttggcggaggggatggatttagtggcgctagccgtcggagatgagaaaggaccgggacattgctggaatgggagaaaaaaaatcaaacaagagaggggtagaagggaggagttgaattgcatgcttggaaggggcatgccagagccattggcggcttccggtgccgacaaggctgagcggtggcgcactgggatgggtagtcagcagcgcagggtggggatgtagtgaaatcgtattgtgaaatcccttctttttcgtgcacgagaaattccgaatcattgaataagttgttatttttcttggttggtgtgattgtgtcatcttttcatgtacctttgtttatttctgtcgtgtttgagtttcaagccaaaaactttgtaataagtggatttagctttagttgaagcaaaggtcaagtttaatattaattattaaaaaaaggtatgttactatgaaaatataattattgtagccaatacttaggaggtcaaatggccttccacttgaggggtgaaacgactagctttcccatgcaaaccgatgtataccatgagaacgggaaccctttctttcatttatttgttcatcaaacgcctctccgagcataacaatactgacaacgcgcgggtcaccctgtactaaaacacaggagtaaatatattaatcctgattcaacctctgtaagctaagtacgtgacacgcgccgccgtgctttcccatcgtcgaccaaccggttagtttctcgccgtcgccggtggcggcggcggcggcaggaaggcgcaggagtagtcgcacttgcacttgttgccgacgcactggccaatgccgcccctgtactgccgctggcagttcgccacgcacaagccgctgtcgcacgtcgggtattcccggttgatcacctccgtgcaggtttccagctgcgccgtcacgccacctgccatttcgttcaacccaaccatgcagctgatcacaagctagcctcgatcaccaaaaaaaaccagagatggatacaagctagcgccaagtattgcgtacctggtggtgatgatgatgaagcgacgaggacgatggccaggatgagcagtgctgcgtggatggccttcatctctgacgctgttgatttttttttttcacttgtgctgatcgatgctactgctaacggtgctagctttgtttggtggttatagtgttgtttgcagttttatttttggaatcacttactcaaataggatatggatagcaggaattaatcgcggtgtaatcccaggagtaattagcattgatatggtatattcgtttgcgctgatctttttaaagggttgtatagtagtatcaactaatggtgatgtatcggtgcttatcgtcaattttcacaaggaatggaaagcgcatgtaccgcgtgacatggagaacgtttggaatataaatcatcgaagagataagtagtaggagtaaaggctgcgctcgttctgcctgtcaaccgaaatttgcggtggcagtcaaaaacaagataagtcactcatgtatgattaatccgatattaattgttataaactttaaaaataaatttgttttttataaaaacttttatataaagacttttgcacgaaatacactatttcgtggttgttaacgaccaaatttggtaatatcaacatcggaggtgaagatgggatcgagatcggctacgactagaatcggctaaatctgaatcagactgggttaggtgatatagccgattccagcaatatgactcgtatccaacattgggtttgagttgatatgcttcaagatgattgctgcacgtgcatagagtcctgaaaaggcaattgtatctattaattaggatgttttatgtaatttccttagagatatgcttagggcaaaagtctgccgcaaagacttatggtatcttagagtttgttagagataatagtcgtgtccgatatggacatatgtggtaattctcgggtataaatagaccctgagccctatgtaaaaaagacacacacgttcaatacaatttcggcgcatcgccatctttttgctttagttttatttcgacgagttcttgctttcgggttgagctgcatcggtttcgatcttcaacaagaggtaaaacttgttatgacggcttgtgttctcgggattagtgcttcctttcttatgataatctaatcttgtttacgtgattcgcggagttatcatatatcatacataatctctggccatatcgctatctaacctataatcggctaacatctgttagtatagggcatccgattaggttagattttgatgttgatttagattatataactcatctcccactctatgaaacttccagcggcttgattgtctagatattgttcttcttttcatacttaatgctgcatcagttgagtttgatctattaagtcgtgcgtagaatatcaatctttagcctgccttttggttgccgattagggtagtatcggagtttcagcctatcctatttgaattaactagattcgctttatatgcttcaatgacatgttaaatccgccctttatgtcaaagatcttattatatttcagtatattaagcttttatttgatatattatacttgttttaatatcctatatagagtagtatcggagtattagccgatacatgctagatctatatgatcggctatgctataaacatatatagtcctgttattaatatatatttcgatccaggtgatttatactgtctcggcatggcgaccgatctatcccaatcacttgatttaaatatatatcgatataagaactatatattggtaatatctacagccaatcgagtaggtttagttctttattatctattatagtcgccgaacgattcacatatgacatcggctcaaagataaatgatatgtcatcggcacttagccgatcggctattatttatagaattaaccgcgatttctttatttctatttcttgttgattgcaggatcaaatcaactggcacgctaacacacccaaaggcaagctttggacctgcactggagttaagcaaatctcccaggcctcgtgttttacgtcaacagtggtttgggaaatgtgtttacgaagaacaagtaagctaccgtatctaagggtgtgttcggtagtatgggatgtgaagtaatccctcccgcacgaaaaacggagtggcccattaacacgtgattaattaagtattagctaatttattttttaaaaatggatcagtatgaatttttttaaacagctttcatatagattttttttaaaaaaatacaccgtttaacagtttgaaaaacgtgcgcgtgaaaaaagtggtgagtgggttcccaactcgttttggctaacacagcctaattaagtaccgtttagaatacaacttaagtaagtgacacgcgtacattttagtagcttccattttttatatagagtaaagtccatcaccggtccctaaacttgtaccgatgtgtcatcccggtccctaaactcgcaaatcaaccgttcaggtccttaaacttgttcgactgtgtcatcccggtccctaaactcgcagatcactcgtttaggtcctccaagttgttcagttgtgtcaccccggtccctaaacaggacagtctaaaaactttatatcaaaaaataattcataactttttcatgtgaactctaatgaagacaaactttatatcaaaattgtagccctcgacgcgacctacaactttgtagttgaaaagtttttgaattaaaactgtttagggtcccaaaatattgttgcatgtttatagattttgcaattttgattttaaaattacattttgggacaaaaaatgacttaagataaaaaaaattcaactacaaagttgtagatcgtgttgagggctacaagtttgatataaagtttatcttcattagagttcacatgaaaaagttatgaattatttttaaatataaagtctttagaccgtcctatttgacccagatgatattcaaatccaaatttagggaccgaggtggcacaactgaacaagttggaggacctaaacgagtgatctataagtttagggatcgggatgacatagtcgaataagtttgaggacatgaacggtcgatttacgagtttagggaccaggatgacacagcggtacaagtttagggaccggtgatggactttactcttttatatatattgccccccaacactactgcacgcacagaccggagtcctaagggaatgacagtccaaccgaaaaccaccttatcccattggacggctcaggccaaaccgccatagcatatggatccggatcgtttacagtctgttcgtgtgaagggcagtgaattaatgccatgaacagtgatgctttactataactatagggtcgaaaatactgtagcgcatgacttgatccttccgttctcgatcggacggtttacagtatccctaatacgcagtactactcatcctctgcgttagtacccctctaatgcagaagatatatgaattccatagcatggcccaggtgcctgtgcaggttcattgctgcgtggaaagattggtaagattaaacacgaacaacttaaattaaaaacagtccatctgaatggagcggtaactctttgaaagaaagaaatgattcttattcatcaatcattatatatatatacaggcaaaacaaagcaaccagtagcatcatatagttcttcaaaacctgatcacatcacatgtctatgtgagacgatcagaagaagaagaagacacgaagttctaacaagcaaagcttgatgtgcagtagcacatggacatgtataaacgtcatttccatatcatatcagttcgctgggaggcgggggcgacgccttgggcggattaaagccgcagccaaaggcgcaactgcatgtgttctcgtcgaggcaggtgcctatcccgtccgagtacgagcgaatgcattccgagaagcaccgttggcacggcactttcagtatcttccgcccaatgcactcgtccgtattcacgccacctgcacaaatggaggatcaagcggctctcgctcagggctctgcccaacaatttccaataacttttttttttgcgatgaacaattctgagaaaaaaaaactatatacagagaaaaacatacacacgtgtgtgtatacttggtgtagagatgatcaaattaaagcgtcttaaaaaatagtactacctccgtttttaaaagggactttactttgttagatgaatatggataaatattcggggaataaattcttttttagacgcaggtaacatatatgtacgagactacctgaatctgaaggtgttgcttccgccgcaagaacgacagcaagagcaaagagcagtgctagtagttggctagtcttcatctccagcaaacgttggccgagcgttggatcagtagttgctatcctgaattttgcttgtgtctgatggtgctctacctccggtagtactatatacagtgtgtgtaatggaggtgttttatactgatgttgtgtttaccatatcggaatgttattatttttcatgggataagatataccatcaatactttgattctaataaagatctaaaacatatgtttatgccaaaataaggcatgctattttacaccttatttatttttggacataaggcgtgtgctacctcttaatttatgattaggatatcactttgtgatacttcacggaaatcttacctcgtcatatttccacttcatctaaccttacatcgaaattcatattgagttaacggatatcgtcaaaacaagacaatggtactgctgaaaccgaactttaacttgagtcttggaccttgtaatagttaagcctcatctcaagtgtgaacctttctccacccccacgaccagagctcgtccctagctctattttcctctaaaattattgggctttatttaccaagtgtcatttatcttgtctcagatactcaatcatttagtccgcgattataaatttagaggctccaataattggtgtgttgatttgcagggtcaattaagtctatcacttcgatcacaactattttaagaagcatgtggtgattagttagctggtgataatacaaaaagatgagcttcccaacttttaccttctagtttattttctgaattttataatacatactctcataatctgaataaaatcttggactgttgagagaattagagattctgaaagaagccacacctattataagacaaccccaaatagggcccatatactagtatatctgccatcaagatcaaggatattccaatggaggaagaatggtgatgtggtatgcatctttaaatccatagaagatggtcaattgttatatatgtttcttacactcaataacttatcatgctcaaggattttataaagagaaattttatggttcttgaaaaagtacttcgaggcatctaaattttacactaaattttatgtgcctcgaggtatcaaattttatactagaaaatatggcaactccggtacttttttaaggataaaaaaattacccttttataaaactaaggtccgcacatcaagtatgttccttaggttacttttgaatttacataccgtcatttttactttttctgtaatatcttagaagtttacgaattttaaaattttaataagtttttttttgtttctcaagtattgcctgtgtaacatcatttaatttgatgaatttaaggtaatctagttaatcttttttttttcgcgtcaatcgcttttcatggtctgtctgatcctttttctttttctttgaaaactcagtccgatccattcatcttcggtgttagtgctgaagaaaatgacaatcctaccactaccaagtttaattgcaggacatggtggtttgtccacgaaaccacacgatcgattgtttctttcatgtgcgagtccagatcataactttaaacctttcatgctacttcagagttcaaaaccctctttcaaataaacttcagagttcatcagaatcctctctcagtgacaaaaaaaaatcagagttcagaagcagtaagaacagaaaatgaaaacttcagcgttcgatctcccattcctggctggattcatgcggctacggcttgcagcagtaggagcacttgcacccttgctgagggaagcactggccttcgcctacgcccttgtacgccgcggcgcagtccgcgtatcacttggacggctcgcacgcgcccctgtagatgaacgcggtgcaggtgtactccggcgtgcacttggccagctggccgcgaatcctacacaaacattgcagatcacaaggtcattgcgcagaagaaattactactactacacttcattgttgagttg

SEQ ID NO: 28513 - DNA, 906 bp, Oryza sativa
ccccccccccccaatttttttatttttcttttatttttttgatatttttttttcacgcttagggacacataagaacccaccatagaaaaaatgaactcaaatggacgtaatatgtgacctgtagaatttttcctctcctctcctctctctccgaactagtgcagaggagagagatgtgcaacttttttatttttattttatttttctgatatttttttcacacttaggaactcacaagaaccaaccatataaaaaatgaactcaaatggacaaaatatgtggcctatggaattttccaaagctctaccgagaaacttctctcctcgaaaacacaatcttgcaagcggaatttggaggttttaatatcgccgaacccggcgaagctggggagaatcggatgtaacattttctgtagatgtccatggatatattatttgcctgattccgagtccgtatgagaaaattacgcctattttaataaatgacattttgtccgtttcggtagagttttggaaaattctacaagtcacattttgtccgtttgagtttattttttatatggttggttcctatgttctcctaagtgtgaaaaaaatatcaaaaaaatgaaataaaaattaaaaaattgcatctctctgtactgtttaacttatggctatcatttcatgtggttatattttgaattagattaagtaatttcatatagtgatagagtgcattatgtataacatgctgatcaaagggttttactaaatgagctatggtctaattttagtgaaggtgcaaagtagactaagtggtatgctagctattttcagacttagctaagtggtagttcgagtttaaatttggttgtatcgtgatcctaagtgtgaaaaaacatccgaaaaaataaaacaaaattga

SEQ ID NO: 28514 - DNA, 5222 bp, Oryza sativa
  unsure (1)..(5222): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatagcctagcaggaacacgattggatgatcaaatataactatgaaagcatcaatttttttggaatatgatttttgatgattgtttccatgatttaattaatattacgaattatgtactcgaagccaacctctctacaaataatttgtttagctagactacactgggcaataattaagtacaatgagattatataatcatacatataatgcttataatgcctatccacttgccataattatcattgttttcatgctatattagttagaaaccatagtttatgataatcttttaaaataaatggctaattttatcaggttatgtcattcgattatttataactaatttgcagttaaagaaccatattaacacaactaaattaaattgtttgtatttttacatatgtagattcaaattagtgttgtatatttgctaagtaatatttgaaactataaaatatgatttgaatttttaaatgttgttatggaatttataattacatgtcaaatgtcatctgccacattgtagcttgcactaaaatatagccaacataattcatcaaagtaaaatcacaccaaaataagtgataattacataatttgttttagtcaaacgaatgatgaaaacatagatcaaaagtcaatagtgtaaaaactggaggtaatataaatattttgtggcaaaaagagcagggccggctctacatattttagggccctaggccaactccatgacatgggcccttaggcatacactctctctatatatacacatatgcactttgaatttttaaagtatacttttaaagcattcatccgctaatcacgctgaaaataaatattgataatatcctctatatatgttgctaaaaataccaaaagagcattaaaatggaattactacggttaccttgaaatcttgactaaggatcaagctccagggacttcattaataatacttgacaaaagataagatgacagacatccatttgcttctcataaaaaaatactccttcggacatttcttgatgcaaaatcattaatgatggtatcaagatcaatattgtccaagacatttttctcaatgcaacacatagccaagccatttaatctttcttgtaacatggttgatctcaaatagtttttcaataactttaattttgagaagcttctttcagctgaggctactatcacaggcacagttaaaaggataaatgctttttaggtaacattgcaaacctaaacgtatagatgaaactgatctttaattagtatttactagttactactgactgattaatactttgctagttcaattcaatggagtatggacaatatggttgcagcacagcagtacgcaagtacctgtaaattgaaacctgcagacactctggaagtaggcagattcacattgtgtcagcggtcgccggtcggacgatgtccagggcaaacagtcgacagacaaaggcacaaagctgtgaagggctgaatgctgaagggatcgccggcggcccagcgtggggtgaacttgcagaggcgccgtggagggcgcagggcgatggaggcggattggcggagactgccgccggtagaggagaggagacgagaagactggaactcggacggtcgcgtatgcccgacgattcgatcagaaacttgtatacatgtatatggtatacctaatacatacctaggtcttctgggcccctacttttcctgggccctaggccatcgcacttcttgccgtagcccagagccggccctgaaaaagaggagatacaagtgcacgtgagggagagaggagagggagggattacattctgtttataatctaatctaatctaatggtctaaaacaatgagcccaccaatttaaatgaaaaaaattgagggctagatgtttctaatctattagaatgccacttggtggtttagaagcgtttacagaaatgccacattggcatgagaacgcttgtagtatgtttaatggacttgttcaagataaagtggtataattcaaatatcataaaatttggtgttatatatgaaaaatgtcatgtttaagagtgccatatgttaattttggcagtgcagttggatgctgaaagccgacagagagaaaattaaatcaaagatgaccttttgttagggatcgatgtggaagaacatgactgtattactgtaatagaagtttattaaataatcttaacatcttagagatatttcattctagagatcttatgtctccagttggttgtaggtagattggacgtccagtatttctatgctaacatggccctccgctattgcaaggaaccctaggaagattgattaatttagttttctaaatttgattttggttccatttgccctttgggcttgcttaactgatggtatcacctgctgcagcactgtctgtactgttagagaagtgcaagaatgtcgaggtcaatgtacagcaagaagaccaacaaaggagtattcctcttctcttgtacctcactagtcaaagtgacaaaaatgggagcactcctcttcactttgctgcatcgttgaaaactagtattgaaggtttcacatcgagattatgtgaacattttcgcccgaaacaaagcccaacaacattgcttcttggactcaatgaatctgctatatatcagccagacaacagaggatcatatcctatacttgttgctgcctccaatgggatactcaaggttgtcataaccttgctcaaaaggtatccagattgtgccactttgcgtgacatccaaggaagaactttcttccatgttgccgtggagaagaagcggcgtaatatcgttgcatatgtgtgtgaaaggccaggattttctcctatcttgaatatgcaggacagccatggggatactgctctacaccttgctgtcaaagccggtgttttttcaattttcagctcgttgttccggaataggtaggtttgcctgaatttatcaaatgaggatggtttgacacctcgtgatctttcgtggattatgatacctgcgaggttgtactctaaaaaggtaatcgttctctgccttttctgaccataattatcccatataatacactacagaggccgagtttagttccaaacttattctttaaacttccagcttttccatcacatcgaaactttcctacatacacaaactttcaacttttccgtcacatcgttccaatttcaatcaaacttccaattttagcgtgaactaaacacacctagagttgatgatactatacctatttaactaggctaccacatgttaatctttcagaacccacgatatatgataagtcaactattagcactttctggaggtactgttggttacagtcgccaggaccacttcttcgaaaaatacagcaagaaaagagacgaagtaatcgattcaaacgatatgacaagtgcggcacaggttctcggcatttcttcagcgcttatagcaaccgtgacatttgcagctgcattcacgttgcctggaggttacagagcagatgaccacactgatggtggtacaccaacacttgctgggagctacccttttgacgcgttcattatctcgaacagcctagcattcatttgctctttgctagctaccgtgagtctgctctactctgggatacaatcgagggacatctccatccggcgcaggtactacgcgttctctatgctcttgatgcagagttcaactacgagcttcactgttgccttcgccatgggaatgtacctggtgctagctcctgttactcttaatgcagcagtgtctgtctgcatcatagcatttgtttctctgctacctggaaatatggaaatcggggtatccctagctatcgcaaacacattgaggattagattgggaatttgggcagcgatgtcccaagcaaggccagttctcctgttcacgtggaaaagagtttggtcctgcataattatctttggattgcctggattgatgaagattcatagaaccaaaatggcttgattggcgtgtcacctttttttctgcattgatgtactttcttaatatatcctttattcggagtgttagaagtacatttacacaacatcgtgtatgacagctttgctgttacccctctgcattttaacgtagaatatacctacgatcttaggcagaagatgaaagaggggaattcagagtgtggcaaataagttacagtgtatttactactccatatatactgtaagttttcataaatgtgtgactgaaacttttttatgttccactgttttgaatgaaaaacaaatgtttataatattatctaatcaagatttttttttcattttattggccagccagctaattattatttatgtgcttgatatcacgttcctccaatcgtttgatgatagaaatttgctccaatttaacaaaaagtaccaaatcattttcgatcgttggatctaacaatgcccatcctgcccagctaaatccaacgatccagtatcgtgaggtactagtacctcgaggtactttttgcaagaccagagcaaatctcttattgctaatcatgagacctgtatgtccggactaatataattaagggttaattggatacatgccattataatttttgcgatatgcatgacaacacaatatatgatagttaagggcatgtacaacaataactataatgaattaatgatatgcatgacaatacaatatttattattactagcttggatgagagagggggaatagagaaggatggcttagtcacaacacatatatgagaaagta

SEQ ID NO: 28515 - DNA, 9692 bp, Oryza sativa
gagattattgattttgatattgggagattattggcaaagtggttttggagatgattgaatttttaggtgatgaacaggagattgctgacagtgtggactggtcagaccgggcagtggttgccggtcacatcggctgtacgtgtgcagtcagaccagccagcccgcggtctgaccaggccacattgtgttaatttcggttttaggttgtttctttggatatctagtggataaatcatgtttatgacttctagatggatactttgcgtatgtaatactgttgtgtgctaacaatgagttaagttggagagagcttgtgcttggatatggtttctttgttgatgcatgtgtaggtgagtcttgatgccttgggagagcgttgccggtgatggatgatgagtcaacttgggagaagatgacatccgaatgatcaggatatcatgcgggatgctaggctaaaaatcaataaatgtgcgtatgggatgcagagttgaatttggagggagaccgaattcggtacaattacagtttgtaagtttgtttcttgtacgggaaggtttccttcgggattaggagttattgtataaggttggttaattcgatgctttaggctacctacctagggtatgaatagtgagggaggcctcccggtatcgtttttgagagagttgagtttagagaaaagttagggtttagagtttcattgagatttttgtgaggagtgttgttgttgcattttgaaaacacagagagaagtaataaattttcaatctatttcgagagatcttcgatttgtatttgctcgggttctgcggtccaaccggcgggacacatgccatcagactggcaggaatacgatggtcagaccggtggcaacgacaggtgacagcggtgtgttaggcggtcagaccgaagctactacactgctcagaccgaaggtcatcgagcggtcggttcggcgcatctactctagtcgaaccgatcgccatcgaattgatacaacttttaattccgccaaaagttttgctttttagtactacaaccattcacctcctttggttggcttggtatttactgttcaatcctacaagtggtatcggaaccttgttttttccattagatttttatcgatctagagttttagccatggctaacatgcttacaactaagccacatgttttcgatggattggattttccttattggtgtgaaaagacgatggaatcttacattatggctcaagattacgatatttggaaaaatcttgctaatgctgatgagattcctgatcaaattaatattgttgctttaaagattgagtttgaatataattgtaaagcatgtaatatttttctcagtggaatttctcgttttgactttggttgtgtttctcatcctcaaactactcgtgagatttggattgttttacctaactttcatcaaggtacttcaaatatcaaggaacttcataaagatcttttcaaaaatgattacataaaatttgcgatgaaacctggtgagactttggatgattatcttgctagatttaacaaagttttgagtaatcttaaatctattgatacatcttatgatactaattactcacaatatgaggtttctcgttactttttaaatggccttgatatttctatttggtagatgaaagttatatctattcaggagtctattgatatgtctactttgattttagattcactttacactaaacttaaaacccatgagaggaatattcttttttgtaaagttgactttaaatctagtgttttggtttctccttcgacttccttggatattggtgcttcttcgtcaaattctaccgctcttgcttctataaatgtcatatccgatgatcaacacgagcaactcgaggaggacttggctttggctattgttggtatttattacgagcacaaaataatctacaggcgcacatataccgttgtagctttcacccaacagtattccagggtattgtatccacaggaaacgtgtgtgaacaatctaataacagaattcatccaatgacaacaattaaatagtaggccaaagatagagatgattcctatgggttaattatctaaattaagtttaggtaaaactctatcaatcgctttcggcacaggtttacccctagtctaccaaggagactctggcctacaactctatgttgtacttgaacatggaggattacaaaggatggacagggttatcaccacctgctgtctacctctacaacccgtgtagcacacagcaaataaaggtaacctctagcttagacatcatgtccacgctattaattactaccctaatctcggatccacatagaagattaaggtactctacctaagagtgatgaacccgtaatgatgagaatatatcttgcataaataataaaagtaaataccaaggagatcacaaatacttatcatctccagccctcctccggaacacccctggatgaatgtcgacatctccggtgctcctccgaaccaccccctcccccgagagaacttcgacatttgacacactcctttcagagcttccccacactcccttccaatattctaattctactagagagtagcctaaatgtataagtgagttgtactccacttgttgtgttgtgccttgagagtaaatggagaactcattttataagacaactatgacggttactagggcgataaccatccacaaccatcattgggagagcatcgtagtcccccacgtggcagcagatggcgaggggagccgatgtcagttcagctgaactaggagttcgatcgacccttggatctaacatcttcagtcgcgtagacctgaatgcactcctagggtcggtgggaacctccctaccaaagttgggcctaagaggccacaatggtggttcgatcgaactcctagataggttgttttcagccgcactggtctaaatggcctcctggggtcggtgggaacctccctgccaaggttgagcccgaaaggccacaacagtggtttggctgaaccatttttggcccttctcggccaccccttttgtcaggtcactgtccagtgggcccccatgacagtgcacgagggttttgctacggtttgtgggccctccaaatccatgtactcgcgtctgattagccggaggtttgttttattgcatggcggatggttttcgtccataattcacctacatacaaatattcagcaagacttgtgaaaatggtcagtaataaccactatctctaagtttgatattccattttatattctttcatttgtttttatgcgtgcattgattattggatttgctacttaaggaccgtcaacaacacctcacacttatcctttactcatctttgagtaaagctcatggatataaaaaatagagcaaggacttcctgatctcctatttcctgtactctctcctctttttctacagtttgtatgtttgctgctgtgggagggagattcacttcacacgcagtaggatggatgcgtgcgtgcatgtgcaatgcatgtgaaagagcatgtagcctagtgattgcagtgacctgagtagcggtcgtgagttcaaatcttcataggctaagtttctaatttaaaaatgttgtatatatcggtcgtatttgaacataaagaccgataaaaaaaattactcttctctaaaaaaataaaaaaagtaatgcttaggcaagcggggtggggggtgagtgcctgtttggttgatgccctcgttagcatgccggagaaatttgcatgcgtgataggcatataagatgcggataaattgcctggccaggcagcctgacaccttgcttgtttggttgtgcacctctgcctgggaggaaaaaaaacatgattaggatctagattggatctgctaactcacatactagttgaatgacaaatcttggctttttaccgcccctccaaagaattcaacgtaatacccagttttttttaacaacttgcatacatcaataagaaaaaaagaacagaaaaacacatgaaaaaattaatccccaaatccacgcatctatcataaccttcaacgattcctcccagctagttgccaattgattcaatgaaacaaaccgttgaagccttcagtgtcttgcatccggcgtgggcgtgtggctttagcgcatgcttctgtgaaatcattgtcatgattaatatttgtgatgaacaattggctattcaaatgatttaatcaaagaattggtttgagagtttgtgtgaatgttggtatgagtgcgtgtgactaatgtgggtcaggttgtgatatctgtgtccagaaacggttgttttgtctgattgtgtgcaggtgacttgaggtcagccctagtcaatggtgaggaccgggactatgctcagggaggagcagaggtctattgcggtcgggataccatgtgagaaggtgactagagtctggactcttggaggtcaactttggtcaacggtggggatcgggactagactcaaggaggagttgaggtccagacagtcaaggataccgggtgacgaagttggatacaagatggcatacggtggatagacatcgtgtgggagagatcttcgcaatgggcttcatgaggtatgcgtgcaagtgccggtattcgcgaagggaattgtaaagttggagtagtatatggtgctacagtacacgaggtactgtagcatgcaggtatgcatgcatgtacggtgctgtgcatgtatgtgtgatcgatacatgcatggtgaagcatgtatgtgtgcatgaatggttggccgagcagcaggagagcggctcggtgggcctcggtggctgttggcggcatgccaagtcggcccaggagaagcaagggcccagctggcagcgagtcggagacggtcacgcgtggacgtcagcttgggagcgaatccgttttagatttctggtgcggccggttgtttgctgcacgtttggaaattgtaaaacgtatggaaactgaaggatggagtcctattgtgtataggagttctacacctactttgagtaggggatttttgtggtataaatagagagggagcgtgaggtttcctgtatcgctttagagagcaatagagttgagttttggttttgggtttcgagtttagtcgaaatttttgtaaggagtgctgttgttgcagtttgtaaacacagagagaagtaataaagtcgtcatccactttaagagttcttagatttgtgtttcaccgggtttcggcggtctaaccggcaactcaccggtggtcagaccggcggcattgcggcggtcagaccggcgggagcgaggcggtcagaccggcggcggcgacaggtgcggcaagcgacttcggcggtcagaccggagattcaacaccggtcagaccggcggcatccacttggtcagaccggcagatcaatctcggtcagaccgacttccgtcaatttcgagggtaacttttatttccgctaaaagttttcgatttttgggtataccatccattcaccccccccccctctggttggcttagttcttgtggttcgatcctacaagtggtatcagagccttgttttcttctttggatttttattgatctagagtttttgccatggctagtccctctaggttttcaactaagcctcatgttttcgatggaacggatttttctcattggtgtagtaggatgcaatcttacattatggctgaagattatgatatttggagaaaagtttctcatgcttatgtgattcctgaagctattaatactgctgctgaaaaaactgcttttgaacaaaattgcaaagctcgcaacattcttttgagcggtatttctcgttcggattatgatcgtgttgctcatcttcaaactgctcatgagatttgggttgctttgagtaattttcatcaaggaacaaataacattaaagagcttcgtcgagatctttttaaaaaggagtacattaaatttgagatgaaacctggagaagcttttgatgactatctttataggtttaataaaattttgagtgatcttagatctgttgattcttcttatgatgctaattatccacaatctgagatttctcgtcactttttgaatggtctcgacatatctatttgggagatgaaagttacatctattcaggagtctgttaacatgtctactttaactttggattcactttatacaaaattgaaaacacatgagatgaatgttctttctcgaaaagttgattctaagtcgaatgctttgatttcttcttcttcctctttggatgttgatgcttcttcatctaagtcgtcttttcttgctgtttttaatgccacatccgatgatcaactcgaacaaatcgaggaggaggatttggctttagttgctaacagaattgctcgagctatgaataatgccaggaacaggaaaagaggtggtccaaatcgttgctttgagtgtggttcaattgatcatcttcgttcgcattgtcctaagcttgggagaggcaaaagagaagacaaagatggtgagaagaccaacaacaataagtccaacaacaacaagtcaaagggttcataccaagggaggaagatggagaatcttaggaaggcttttcaacaagtttgcgccgccttcgagccactaagtgatgtagatggtgaaagtggagatgatgataagggaaataacgtctccgatgtttgcttcatggcgcgtggtgaatctgacatagagtatgaagataatgaggtgaatgcttttgaggaagctattaatattttgagtgcaaaaaataaaaagtgtgagaagatgtataaaaaacaggaatttatcattgaatctcttaaatctgaaattgataggttaaaatctcttattcctaatgatgatgattgcgaaaattgtgagattttaatgaatgagatttcaaaaattagagatgttaatgctgcacatgatttgaaaaatagatcttctcttgcttgtagttttgctttgcacacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagttgaaattgaaagatgctttaggtcgtgttgagtacatggaagatgttgtgaaaaacaatgaagtgctttcttgccctaaatgtcgtaaaaacaaaggtgtcatgatagattgtgaaaattgtgctaatttggaaaaagtggtttcttatttgaaaaatttttgctaaggttttctgattgtaaaaagaacctcaacatgattttggatcaatcaaaggttagtacacataaccatggtttaggttttaatccttatgctcataattctagacatcctcctgttgtgttaggtgctgatgctacaagtggtgagattttggttaaacctgatactaacaaaactgtgtttaaatctgctggtatcatgtctactatgagtgcatcttcttcaaaatccaatgttgtgcatgtaaaatctcctgttgttgctcatgttgctaaatctactagtgctaccaatgtgtctaatcatcgtgaaaattatacttgttctttttgtggcaaagatggagatattgttggtttttgtttcagattagctcataaacagaaaaaggagagagagattgcttttgcaaaatcaaagtggcaaaaatctggttttccctcgaggaaaccgatcagaccgcagtgggtcccgcggtcagaccggctgaacagcctcggtcagaccgaccaccggtcagaccggtggtgaagcctcggttagaccggcccccagtcagaccggccactgtacctcggtcagaccggcctcggaggaatttttctgaaaattctaaaattgattttgcacatggatatatgcctattgaatcttctggtcgtgtgtctcagtactggattcctaaatttttattatcatctaaccccagtactgaggcttcgacttctgcttgtgtgtaggctttggtggcaaggagaacgtgtagatcatggattccggttgttcgcggcacatgaccggtgataaaaattggctctcctccctaaagaaggcatctaagactgaatcgattatctttggcgatgctgctacaagtgccgttctcgctacaggtatggttaaggtaaatgaaaaatttgaattgaagaatgtagctttggttgaggacttaaagtacaatttactttcagtttcacaaattgttgatgaaaattttgaagttcactttaagaaaactggaagtaaagtttttgattcttgtggtgattctgtgttgaatatttctcgctatggaagagtgtttaaagctgattttgaaaatcctgtttcacctgtgataacatgtttggttgttaagtttgataaagatgtgatgttttggcatcgtagacttggacatgttggttttgatcatctcactaggttaagtggtttggatcttgttcgtggtttgcctaaacttaagaaagatcttgatttggtttgtacaccgtgtcgtcatgctaagatggtttctacttcacatgctcctattgtttctgtgatgacggatgcaccgggacaactattacatatggacactattggtccggatagagtgcaatctgttggaggaaagtggtatgtgttggttatagttgatgatttttctcgatattcttgggttttctttatagcaactaaggatgaagcttttcaacacttttgtggtttgtttcttcgattggatcttgaatttcctggttcttgaaaagaattcgaaatgataatggtggagagtttaaaaatgcttcttttgaacaattttgcaacgaaagaggccttgaacatgaattttcttctcctcgtgttcctcaacaaaacggtgttgttgaaagaaaaaattgtgttttggttgagatggctagaacgatgttggatgaatataaaactcctagaaaattttaggctgaggcaattaacactgcttgttatatttcaaatcgggttttcctgagatctaaacttggaaaaacttcttatgaacttcaatttggacatcaacccaaagtttcacatttgcgtgtttttggttacaagtgctttgtcttgaaatctggaaatttggattattttgaggcacgttctactgatggattgtttcttggttaccccgcacacactcgtggctatcgtgtacttattttggggactaacaaaattgttgagacttgcgaagtttcttttgatgaggctagtccaggtactagactcgatattgcaggtacactgtcacaggttcagggggaggatggtcgtatttttgaagatgagagcgacgacgactacgacgacgaggttggctcggccggtcagaccgggcgccaggccggtcagaccgccggcacacctccggtcagaccggctcatgaggagcggttagaccggccagggtcgtcgggttccggtactgttgatgctgatcgagatagacctccagagattactacttcgactagtactgatacagaacgtggatcaacttcagaagtggctactcctttgcacatttaacgacgacatccaccggaacaaattattggtaatattggtgagcgg

SEQ ID NO: 28516 - DNA, 12155 bp, Oryza sativa
tgcttcttttgaacccaaagatgtgtcacatgcattaactgatgaatcgtggattaacgccatgcatgaagaacttgaaaattttgagagaaacaaagtttggactttagttgaaccaccttctggacataatattattggaaccaagtaggttttcaaaaataaacaaaatgaggatggtttgattgtgagaaataaagctagacttgttgctcaaggttttactctagttgagggtttggattttgatgaaatttttgctcctgttgctagaattgaggcaattagacttttgttggcttttactgcttcaaaaggttttaaattgtatcaaatggatgtgaaaagtgcttttctaaatggttttatacaggaggaagtttatgtcaaataaccaccaggttttgaaaatcctgattttcccaatcatgtttttaaattgtctaaagctttgtatggtttgaaacaaggtcataggacatggtatgataggcttaagaactttttgcttgcgaaaggttttacaatgggaaaagttgacaaaacgctttttgttcttaagcatggtgataatcaacttttcgttcagatttatgtggatgatatcatctttggttgtttgactcatgctttggttgtagattttgctgagactatgcgcagggaattagagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaagctattgatcaaaaggagtatagaagtatgattggttctttgttgtatctaactgcttctaggccagacatacaatttgctgtgtgcttgtgtgcgcgctttcaagcttctcctcgtgcttcacatcgtcaagcgatcaagcgaataatgaggtatttgaatcatacacttgagtttggaatttggtattctacttcatcttctatatgcttaagtggatattccgatgctaattttggaggttgtagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatctactttgaaagattatggtcttacttttgagaaaatacctctcttttgtgataatactagtgctatcaatattgctaagaatcctgttcaacactcacgcacaaagcacattaatattcgttttcactttttgagggatcatgttgagaagggagatgttgaattgcagtttttggacagaaagttgcaaattgctgatattttcactaaacctttggattctaatcgctttgcttttcttcgtggtgaattggaaataattcatccttttggcatggtttgacagggagtttgtacctcatggttttatcaagcaacaatatgacaatgagaaaaattaagaaaagagagctttatttatgcatatggtattttcttgtgcatgctaccaatactttgaaggtttatttatctctagcatagcttgtatgtattctagtcttttcatgagatttagattttgcttttaagggatgatgcatgacatctaaattctacttgaattaagaaaatatgcaatgttgatgctagcatatggtttgttttataaatgctctatatatatgctttattgacttgttattcctcaaatagctttaattgctcattgtgaaatagagaataaaaatatgaaaaaaatgaataccgaatccttggaaacagtcttgacgacgaggacgtattcgatgtgagcaaaataatgggtgccgaatccctggaaacagtcttgacgacaggcacgtacccggaataaaaagagaaaaaatatgagcaaaaaggctcaagataagaaaagttcaaaaattctcttggttattttgtgctcaaggttatttgagaaagagtgataaatgcaataggtatatgtgtttagtgtttattcttcaacctatgtgcttgttaagatgttgcattataaatcgtctgaaatcatgaatttttgattgttgattcaagcttaattgtaaaatgtttggttcatggttatactttaatgcaatgcatgcttgttatattatatatgggtttatcttctttttattgcaacacatgacttgatatgctatatgtatgctaatctcttgaatattaatgaacataattcctatgcttgatgaaatcattgtcaaaagggggagaagtaattgtgaaaatttttgtgcaaatttttggagaagcaaggtgaaattttggagaagttgttgagaagagcatgtttttagttcaattgggaatttctttcttttaaaaagggggagaagttttcttttggatttttgagcacgatgtgtacatttgtacgaagtgtgcttttaccactttcgtttttatttttccaaacaccaaaacattttttataagtttgccaatgtgttcatcaagggggagattgtgaaatcattgtcatgattaatatctgtgatgaacaattggctatgcaaatgatttaatcaaagaattggtttgagagtttgtgtgaatattggtgtgagtgcatgtgactaatgtgggtcaggttgtgatatctgtgcccagaaacagttgttttgtctgattgtgtgcaggtgacttgaggtcagccttggtcaatggtaaggaccgagactatgctcacggaggagcagaggtctattgcggtcgggataccatgtgagaaggtgactagagtctggattcttggaggtcaactttggtcaacggtggggattgggactagactcagggaggagttgaggtccagacggtcaaggataccgggtgacgaagttggatacaagatggcatacggtggatggatatcgtgtgggagagatcttcgcaacgggcttcatgaggtgtgtgtgcaagtaccggtattcgcgaagggaattgtaaagttggggtagtatatggtgctacagtacacgaggtactgtagcctgcaggtatgcatgcatgtacggtgctgtacaggtatgtgtgatcgatacatgcatggtgaagcatgtatgtgtgcatgactggttggccgagcagcacgagagcggctcggtgggcttcggtggctgttggcggcatgccaagtcggcctaggagaagcaagggtccagctggcagcgagtcggagatggtcacgcgtggacgtcagcttgggagcgaatccgttttggatttctggtgcggccagttgtttgctgcacgtttggaaattgtaaaacgtatggaaactgaaggatggagtcctattgtgtattattgtgtataggagttttacacctactttgagtaggggatttttgtggtataaatagagagggagcgtgatgcttcctgtatcgctttagagagcaatagagttgagttttggtttagggtttcaagttttgtcaaaatttttgtaaggagtgctgttgttgcactttgtaaacacagagagaagtaataaagtcgtcatccactttaagagttcttcgatttgtgtttcaccgggtttcggccgtctaaccggcaactcaccggtggtcagaccggcggcattgcggcggtcagaccggcgggagcgaggcggtcagactggcggcggcgacaggtgtggaaagcgactttggcagtcagaccggagattcaacaccggtcagaccggcggcatccactcggtcagaccggtagatcaatctcggtcagaccgacttccgtcgatttcgagggtaacttttatttccgctaaaaattttcggtttttgggtataacaactattcacccttctctggttggcttagtttttgtgattcgatcctacagcttccttcacatgcttcattccgacgactacagcaaggaagcaaagcagcaggatgaagggatctggcgaaggcagatgattcacatacaaaaatgatggtggcgagatggcggcggcttcgacttctcgggatagctacagcgagaacaacggcagtagcttctcgagacagctgcggcggctgcccgcacggcaacaacgcggcggcggctgctcgcgacggctgcggcgacaacgcctgcagcagctttgtctggcgacggcttcgtgcacgcgtgcagtcgaatggaatcccctcgttcttcctgcgtggaagacggattacagtagcaaactgaaatcgtggatgcgcccggaccttagccgaccaattatctatctatctatcgatctatacttatacttatactaattggacactttctacgagctctcacgttatagaaaaaactatccgtctattaaaggaatcatgtaatcatagccgtacatcttatatccaatctggtttaacactgtgggccaccttttaatggccatctaatgtacgtaacgtcgtcgccgatcgtatctctaacgaaagaagagacggggattctatcgcgatcacacctgcgaccatctgggaaaacttttatcagcgatggtacgtagatcgatgctccagtcgtccttcatggcttcatcgttattgctgtaatggatttagagatcactgcaacgttgtgaattgttggtagatcaattaggttcgcaccctttttttctttcgtagtaattttcttcaactcaatctatctggtaaatcgatctccgtcacatgtgcaaacgaaagcaaaatgatcagaatctaaagaggtggcctgatagcaggtttgcaggccgcggcaggcagtaatgaccccaacgatgaggcaggcatgtaccttccgttttcttattctgatactaattcgctctccttccgtcagcatcattatttcatttgaaattttttggtaagcattatttcattttattttattatatctagaaaaatcaattaattggtgaatggttattgcacaagtatgttcatgatctttatttttttatgattttttttatcaatttgccacattaaattctttcactattatcgatcgtaatatactatactagattagctatatgtatatgcgcacattctttttcctggaacaaccttgcaccatagccattgtcagttgtgttgtgagataatttttttgaatactacggattaggtgtttaaattattaattattcgagtaaacacatgcaattttttctggtgtctctttggctaaactatctatttgtacatttaactaggctccctgaaagttagcaaatattgttatagccttccggtgactatggagttcaattataaagatttacatccataaaaaagttgatgccatgtacaattaaaaaaaattcaaatcgataaaaaataattaaatgcaattgaatacattaaaacaaaattacatattaggtacaacttatctattacaatttctagactcataatttaataattatataaaacacaaataatgaaattagaaaaaggactcagttgggtgtgtttgccatagcttcggcttcagctccatctctcctgaagttagagtccaatcaagcttcactaaaaatgggattggagctggttgaagtagtctaacaaaatgaactagcgacataaagctgggttttcgcaactccactcctgacttaactcctgaagataaatttaggaattgaagccctaccaatagacccttatcaattctaaatctaaataattcttaaaacatgggaatgccataatttagactacacattttacaattattaatttttaatttggagctgttaatcgaaccaacagttttgttcttaaatacttacaaagtaggttccatacatttactaccgactctttagttcctttccaaaatttaatagtttctaatttcataattaagaaatatggttctatttcatactttcaactaagtaatttcatcgtaaattaatatcagcatgtagccatcaatgcaaagcaacttttttaccaagtctttacaatttataagatattttatatatatggttaaaatttaatatttatgtcatgtcaaccatagcccgtgtaacaaacgggttagcgactagtccaggctaatgacacgcgggaggacatctggccaggcattggagtacatctggccaggcatgggagcaagagctccaggaaggtgtgacatcccggctcagggcttaataaaattattagaatactcatattaacaagtaccaaccaaacagaccctaatagcacgatattattttctcccaccggccgatccgcagagagtattctccatgttacgtgtattagtattttgttcgtcaattcctattttattcacgtgatgcatgatatttgactgtttatctacagaggcccgcgatacaatgtacatacatacatataatcaaattcacctttcaacgtacggacatttctatttgtcataaaacaaaattgcaatgtcatcgataacccgaccttagctcagttggtagagcggaggactgtagtttgatgcggattaatccttaggtcgctggttcgaatccggcaggtcggaagtttatttctttattttttttgttgtgcgaattattttatgtacctcacgaaaagaaaaaagcaagctatttttgtaatatttttcctgcacttcttttcgtgacatgacttttaagagcaagcccagtgtgtttggctgcttcgctgctgtagcagatattcgcaattgcttcgacactcattttggaagagccgatttgactctcctcgatagactaggatttgcttgcccaaacctcattgccaaataaatacgccttttctttttctaaccaaacaagaataatgattattcgtcaccatctgatgattaattattcttgtactttagttacacctatataaagctcaattcccatgacagtttttgtcttattttgttaacctccactgatccaatgcttaattaaaataagctttaccggtcaaataaatgattcataaatagaaagacatgacgattgaaaccagtgacacatcctgaaccttattaattttttattggatacatgtcatcataaattttacggtttaaaaatatgacattactattcatatatttagaattatgccattacaattttacataaattcaagatatgccactacatacctgttcatcgtattttctaatattttaggaccaaattgcccctatcctccttccactaatttcttgttccttccttcctactctctccagtggggcttggcgttcgtctcgctggcgattgagctcaacgtccccctcttcagtgctacttgtcgctttgtccacattcgcctcccactctccggcactaagagaacgacgaaatctacggccacgaggaggcacaagggcagtgagctcagaggcagggagatctagggcgacgggatcgtgacagggagacgcaggggcagcacgtgtccctctcgctagcggtggagcttggtgtccctctcactggtggcggagcttggttcttgttgtccctctcaccggtggcggagctaattggcgtccctctgtccggtgctcctcatcgctctgcccacatcctcctccctctctccatcgtgaagagtacgacgtggcctacggtggtgtggaggcacagtggcagcggagagacggggggtggtgggctcggcggcaagacatggtggggtggtgtgctcatcgaaggagagatgctggggcatgggctcctcctcctccccttgcctacagttgccatgacgatggggaccgtgttttccttgaaccagatcttacatgttgagaacgacaattgtgcactcaagttcctgtgccacttatgtgatggcaagcgaggggaggaggaggccgacgtaggtcaaaggtggaggtggaagaggtggctatggtggccagaaaaaaaatgcactgaaaaagatatggaaagaaaaaaaaacagaaaaaagaaaaaaaaaagaaaaccgtgcgccaaaaaaaaaaaaacccgcgtgtcgcctgcgttccccgctccgcgcgcgaaagtgtctagtggcacgtgtcctctaagtgcttaacacttgcaagttaaacatgaattgtattgattttgtgtttgtttgctgattaccagttgcaagttaaggattattgtattaaaaaatatgtgttgccactgctgaaaatgccaatgaaaatgcacttgtatgttttatgtacgagaatttacatcttactttgcttttaagcaacacacattactatgacaaaattcttcaattaatcttttaagctttgtaaagatgtacatttgtatattgcactatcacatcataaaggtactgcatgcgcagttgcagtgcaattagatatttcacattattgaaatatttactttgaagacaaataaatcttattgatggttctatgtccttacgagaaactggatactatgcaaacaactagaattgcaggtcgcatgtacattttaactgagcacaccttagctttacatagtgactacaatcgtgtgggataatattaggacaatgctgctggtagccttataactgtcctcagtcagggtaaactatattgacaattcactcagcaagcctaaacccataagctttgttgcttataaattttttatcctattacgtctttatattctaaactgaccacttttttgctggtttagtattcatagagttacatcacgtcattgtgtttgctagtgatgatctgaacgttccatgaaaaccatagggtactctttgtggcaatactattttggccacaggagcaccttcaaatgtttgggcgtcaataatgtgcacctgcaacatagaaacatgaaaaaaacaaattcaaattcaaatttgaatctgtgtgtcattcatacagaaaatggcgtgcgcatgtgatatgatgtaacaagcacttgcctgtgatgtattagacctctcgtcatgtacaaaagaaattatccacccatcatcttcgtgtgagccaccaactcttggaacaaatgctgctccagagaagaattgatcttctccaaacccgtgatattctgtctttattagatcttcagatgtctggttcatgacatgaatgcagtgagttaataatataagataaagattggttggagtactgtagcaagtccatttccaatgtacctctgcaattacattatctgcctcttcaagacaaagttttgcaaggcctccatatttcaggattactataaaatacagaaagaactatcaatcaaggtgtgatgcacaatcatatttcttgtgaaatatacttctaatccatgccatggacctccagatttgataaattacataaaaactgttttctttaactaatacctttctcattaacgccgtaagagctttccaaagaatccaccacttgtgcataggcataactatgatgcaagcctgtgtagtggtcattgatcacagggaattccatggaaaactcagttccacttaaatattgccctgaaacagcctttgtcttcgtgtttaatctccactggtataatcgagagaaaaattcttcattaattccttgtttcacagaacacttagaaggatcagagagcaaatcatttttgtttaggctgatccgagggcctggaatgatggagtcagccgcacgaaagcccctgataacaacctattttaccaagataaaaaaatgagattcatactggatatgcttggtaatgatggatagttgggtaaaatcagaattactatgctaatgcaactacaagtatatggaacaagctttacaaaactataaaaatactatacctcatcaccctcttcaaagcagttgataaaatggaacatgcagaatggttcaacgtcaaaccacataactgattctgcatcaccataacggggcataactcctattcttgcatagctgtccttctcaaacttgatcaacctgttccaggggattgcgttcttatggtttgcaggtttaagccaagaatctctttaataaaataaacttgagtgaaatacttactgattgcctctgataagtctactgatgtcgatggtaagaggtatgtccattattatgttgtacctgcattagtagaataaaatgtgtaaattgaacttttgctttactggagactgataattaagtagaatatgttgaaatagattgtagtttagtcattaaactacagcgaagaggctctgattggtacccggacatacttaacagtaactcctatgtcatggcagagtatacatctgtccagtttgaggtcaactttatgttttagttgagttccatcagctgtcatgaaataaaacttcaattggggtcaaactttaaatttaaccttgatagagaggacagaagtaaattctaactatacaattaaatacctgagacaactccgaccattaggaaaggcctctttgcatctgaaccaaaaatgactagctctcctgatccaggagcaacctacatccatttgaaccaagtgatttaaagcgatttaaatgataaaacaaaatagcactaaaacatgattttactcagaatgtgaagtcatgtgatgtatcatactttgcagttgttcataactatatatctatagtgtatgatgttcaaataaaaaaaatattctacattatttatttatatgtatttagttgtggtgagctcctcatatgtttgtctttgcagttaaatggcaaagatgtgccatatagcgaaaccacttgctattctgcaataggcttccatcctacgtgctacacatctcattgcgtgacaatatagtccataggcaataatgtgccatatttttggctcgataatcttcttattgaataaaatttccagagcacagatgtaattgaaacaatctgatgattctatttgaagtgcctgggcacctgactttgcacatgtgtttttccaataaccctatatatatctataaagtgtatcccactaagtgtgtagttaatgttaattctttcttctctcataaagccacataaccttaattatttttagcctttagatcattcattaagggtgcaaattgcatctcttctctctaaaagacatcatatttataacctttagataattgatcaatgtacaaaatatgtaagcatatgaaataaaatcgtatagtacgtaagaaaattttaccatatctcctattttaacacacaattcacccgcagcgttgctgcggggtacccatctagttatatcttctgcctataaatgcttcaattactgattcctattgctcatgtagcttacagaaaatgaccagccatacctttgggtgagctgtgaaaggccttttccattccccattaatgtcccagctatcacccgtgtcgagattctgaatgctgatttcctgaggcaggtggttctcagaaacagcatacacctttccagcatgctcaaatacattggtgttgctgatgttcttgttcactttgccaaacctcatctgcattgcatataatttatccatttcagattgtctgaaaaaaaataacatatagtttattaggcttgtgaagtgttatttttacatagttgagaatgtaggccgcgacgatggctgcagagtcgcccatgatggcagggaggaaacatggcttctgtctggttttctcaatctttaatgtttcagattgcacatatcgatttgcataggagactgaccaagtatctgaactgttctttgtgaagtagatggcatggagcatgccctcgccttcaacccatatttcgctggattttccgaagattgagacggtcgaatggagggctccaaacagtggattggaacctgttgagattttccaccattagcttattattatggtcagcaattctcatgtactgcacacagttatacttatttgttgatactgta

SEQ ID NO: 28517 - DNA, 602 bp, Oryza sativa
gattcaacaccggtcagaccggcggcatccactcggtcagaccggtagatcaatctcggtcagaccgacttccgtcgatttcgagggtaacttttatttccgctaaaaattttcggtttttgggtataacaactattcacccttctctggttggcttagtttttgtgattcgatcctacagcttccttcacatgcttcattccgacgactacagcaaggaagcaaagcagcaggatgaagggatctggcgaaggcagatgattcacatacaaaaatgatggtggcgagatggcggcggcttcgacttctcgggatagctacagcgagaacaacggcagtagcttctcgagacagctgcggcggctgcccgcacggcaacaacgcggcggcggctgctcgcgacggctgcggcgacaacgcctgcagcagctttgtctggcgacggcttcgtgcacgcgtgcagtcgaatggaatcccctcgttcttcctgcgtggaagacggattacagtagcaaactgaaatcgtggatgcgcccggaccttagccgaccaattatctatctatctatcgatctatacttatacttatactaattggacac

SEQ ID NO: 28518 - DNA, 470 bp, Oryza sativa
ccaagccccactggagagagtaggaaggaaggaacaagaaattagtggaaggaggataggggcaatttggtcttaaaatattagaaaatacgatgaacaggtatgtagtggcatatcttgaatttatgtaaaattgtaaatggcataattctaaatatatgaatagtaatgtcatatttttaaaccgtaaaatttatgatgacatgtatccaataaaaaattaataaggttcaggatgtgtcactggtttcaatcgttcatctatcactggcattggataagatccctttactgtgatagcattaagctgtctgtagtcaatgaccaatctccaagtaccatccttcttcctaaccaaaagagctggtgatgaaaatgcactttggcttggttgaataactcctgtttgaagcatctcctggatttgagcttcaatctcatccttaagtgcaggattgaacctgtaaggt

SEQ ID NO: 28519 - DNA, 676 bp, Oryza sativa
aggagaagaagggagagaaaaagaagaagggagaaaaaaaattccatgtcatcgtccacgtggcgtgccacgttggtaagaccacggtcaaacgagactttggaccgggatgatacaataaaccaagtttagggatctcgacgtacgttttacaagttcgtggacctaagtgaaacctcacgacaagtttaaggaccgctgctgtattttactctaaatttaatatcaatcatcatatttctaagtcctacatttcttctccagattttagtacttaagggaagggatgatgagccatagtaatttataaaaaaatacaaatcaaaacaattattaaacctatatccagaatatatcccggtagcacacataatacatcaagctgccactcaaatgaacaagagtacatattaacttttgctaaaaataaaccatcccttaattcttacttcaagatcaatcacaagaaaattgcatcaaattaaagcatatcatcataaatcttgagcactactgattaaaagaatggattggcccaagatgttattagaaaatttcagaggttgcagagttggacaaaaaaagatggtttcagcaggggttctcaccaacaaggagtagtgattgaccgtgaaaacgacgaacacatagtgattgatggtaagagaacctcctg

SEQ ID NO: 28520 - DNA, 655 bp, Oryza sativa
agaataaatgggctaggcccaatttatttctattaaaatctcaagggcccataataaatgttaaagtaataataccaccttgggaattaaaagcgtagtatctcaacttaaaaggcagttatcggaggctccccgttgaccggttaaagtgggggtcggatagccacacgcgcgcgcgccgagccgagccgaggctgtggcccggctctctctcgatccttttgcaacggttaaaaattcactccacgagattacttctgtaacgggcgagcgattcaatactgattgatcgtgtcgttacagaagcgaatcctcctcgtgcgctattaggacgagacagagaccgacgatcagcctctccacgaattctccattgtttgttctgatcgcttgcatgtacaagtgattgggacgagcagggcctccagaaccacaccctctcctgagatctgcacgggtaggcgggtgatcaggtttttggggagtgcttccgcacgactgctcgcttcttcgtcgtcgttcggttctatctacattgcgcaatgtctactggtggtggcacacctggagcctctccacaaattctccattatttgttctgatcgcttgcacgtacaagtgattgggacgagcagggcctccggaaccacaccct

SEQ ID NO: 28521 - DNA, 1423 bp, Oryza sativa
atttttgaataagacgcatggtcaaacatgtgagaaaaagtccccggcgtcatctattaaaaaacggaggtagtatattctatgccaatagtgtcacctatatacatatgttagtgaattatagggaagtgttctacatccaaaatagctgcttactgctaatcatatctgccatgtggctatttactggctttctttttttggtaattgatatggtccaagtgttcaatccttatcgatgagatgttatgtatattgtcaggcttatggagttcatatgaatgggtatgttgagaaggagggccagaaatttctttggattgctaagagaagtgatacgaagcagacctttccaggaatgcttgatcatcttgttgcaggtggcctggtgtgcatttccatcactctctttttttggtccatcttattagcagtaattatttttcagttatcatcttgttgtagtaaattatgaaactttaaaacaattgcatagggccttttgatgccttcattccttcgtaaaaaattaaaggggaactgtgcacatatcagaccgtaacattttaagcttctagttgattattgtcagattcagcctaggattgacttggctgaagtgtctggttagtggtcactgggtaaccagttgttccacttggtcagcgaccaaacttcattttccactataatatttataatgcatataatctccaaaaaatttaatctatgataacatttcattctcttctgaacgttgtggtcataaccagctacatcagatatcaggaacagaaagtctcagcatactttgggcaacataaacatccatgttcttgctggattttgttttacgtgcaaatgatgtgcctcaaatggccttaaactcttggccatatgattcttttgctcctaatgttttggggcatcccgacaattatatacctggtaatctgatgttcttggtaaagcttagatgagaaatttcagctggtttatggggacaataaattgtaatatcatacttcttatttatactgatgtaggctgcatgaacaggtggccactttagggttcatataaaatttctctaaagggttttaatctgtcttgtatgtcaaaaagtcaattcaatcaaacaggtagggatgctttagtctcaaatgtgtggctcagttcttctctctgacctgttttttttttttttctgttgtgaaagtgaatagctagctattaacttacattgatggtacactgattccccttgaaaacttttagccatatggaatctcctgtgaagagaatgttatcaaggaatgtgaagaggaaccaggcatcccaagatccatttcaagcaagtaatatgaccgctgttgcctgaaaaattataaatttctctgtgatcttcatcgtgtttgccgtg

SEQ ID NO: 28522 - DNA, 23787 bp, Oryza sativa
  unsure (1)..(23787): unsure at all n locations
tgcttcagcgaatttgtgatgatggacaccaggcgttgcggaaggtggatcacatggcatggaaccatggatggatagttcgtcccttatcctgtctctttttttttttttctggaaaacagaggatagtactggatttgagtatgaacataaatagtgagggaatatgaattcatatatggaggaaatatatgtcaagctaaaagggaattgccctggtctcccggcaaaaaaaatagagaacatcactgatcacgaatacttattagtgtgatatactatcacgcaagtaattatcatatgactattcgagcgatatgtccatatgaaatcagattagcaacttaacaagcacatttagccgtgtatatgatatgtactgagatttttcttaaaaaaggaaaataggccactagagcgcaggggtttccagcacaccttaaacaggagaccacaacttagtacgaaactaacactaaggcctggtttagtttccataacaaaaagctaacaaacactaaacgaatcttttaagactaattacgctatgatctgacaatgtggtgctacattaaacatttactaatgatggattaattagacttaataaattcgtctcgcaatttcctggcagaatctataatttatttattttgttattaaactacgtttaatactttaaatatgtgtccgtatatcccatgttaactaaggttgtgtttagttcagcgcaaagtttggattttggttgaaattggagatgatgtgactgaaaagttgtgtatgtatgacaggttgatgtgatggaaaatgactgaagtttggatccaaactttggatctaaacacagcctaaacccaaaatttcccagatttgagtgctgaaaagatgtactccctccgtcccaaaaaaaagacaaaccctggtttccgtgtccaacgtttgaccgtccgtcttatttgaaaaaaattatgaaaaaaattaaaaaaataagtcacgcataaagcattaatcatgttttatcatctaacaacaatgaaaatactaattataaaaaattttcatataagacggacagtcaaatgttgtcacgaaaacccactgtttgtctttttttttgattgagggagtatctactgacagagaagctaggcttggtaggcgacgagattcaacatggtatgttctgctgcaagcagtaacctttgtcaattcttggaacgcatcactctccagtcttacacgttttgcccttaattagtccatcatatcacttcactacacatatgttctgactgcagctgtgcattctatctactctctccgtcctagaatgtagctatttttaggattcaaacttgtcccaaaagaagctatttctaggtagatgagaggctgttatacctgttttacccctgcaccccacagcactgacacaccacatatccccagtctatggaggagacgaggagataggcaccagacttctttggtttgaattttaaaagttagtcccattttttattctggatatgcaggtgttaggggaataggagctgtggaaggaatgctgcgtgtccttgtgccagcatattcatgattccgtcaaagaagggcactatggtcataacacccaaaaccttaatccatccaaacaacctagaaatagctacattcttgattctgagacggaggtagtaggatgttttatgaacgtacggttgagttggcatgttaaatttgttgttatcttctaggtgcacgaatattggtaggagatgaatcattcgggaatcggatgtatctcttgtgcaaattctggactaatctaatcgtgtagagtatactcttgtgtgccttcttagccaatggatgtcagggatgaattagcagaacacacaacatgagtacatcagatcgatcaaaataatgattcataaatttctgcactaatctaattgtttaaaatatatacttgattgtggtggcaatcaaattccggttcagctattagaaaggttaaacaatgaaaagctatgattttaaaatgggtggtgatagtagcacaacaatttcaatatttgaaaccgaacaattgggttctcgacatacatgtgcattagacccaccactatttatacatagaaaaatatttgtacataaattttaattggacataactacacagctagtgctaccactccatctataagaggcaccatccacctatacttcaaatacatttttttcttaaactactcatccgatctatgatccgattacaccgttgtgttcgtaacaattaaatctttacaacaagatctcacatgattatattttgatgaaaaatcacaaaatacttttataatatgtctaaattacttttagattttacttagttacttcttagatatataaaagtaaattcagtaaaacctaaaagtaatttacatatattatagaagtaacttagaacaaaaaggtaactttagcatgtcatttgaagtaaatccgtagtagagataaaaatatgactctatctagaaattaaattaaccagcacaaattatggaattaactaaaataataataaaagtaatcaccccagagcattatgaatgtataggaagtattttaatcaaatctaaaagtaacttttaactcgccgacgacattctgccctttccaccggagggtttctgctccatcaaaaaactgcagaactaaatcttcttgctcacaaatccaaaagaaacttctgctcactccttttgtgtcctacatcaccgtctacttaaatagagtctctgtagcaacctccacactaactactctcctggtcgcacggccttgcatgcatgcggatcaacaagccatgcatggagaaaattcaaatgcctcaccaagcagaacacgcagcgcagtaatccgaattttcaaaaaaatgaagaataatcaagtttctgcagcggtggattagtggatcttttctcaccatccgttagtgagttgaaccccgaaaccttgatgtgagatggacaggtgtccggtggttacaataggagtagctactcctgggagtagtatataggcttcctatatatatatgtatatgtacatacatatatatatatatgataatttgttcaatgaaaaaaggcattaattaaagttactttctttttgttataataatatatgtaaattacttttaggctttactgaatttacttttatatgtgtaagaagtaacttagtgaaatctaaaagtaatttagacatatcataaaagtaatttttgatttttcatcaaaatataataatgtgatatcttgttgtaaagatttaattattacgaacacaatggtgtaatcggattgtaaatcggatgagtaatttaagagaaaattttatttaaagtatagatgataggaatatttcccctacatgctcaatggattaatagcaaccaaaactcctaaagtactagcacgtgggtgtctccggttaagactaattggagaggcctctccaattaaaattaaatttaccgtatgtcatttttttatttttcataggacactgaaaataattcattctgaacagaaaaggagctagttgcggtactctgaagataagttcagcccaaagaacagagcatgacagtaaaatgatgaaactgattccagaatagcaggagacgctattgtttatctattgtccctttatgccgaagacatttgcaaaataaaatcccatgcaaattatttttctcaatcatatgtcattcacatgaagaacgaagtagttaccagaagattccaatttttctaataattccatgtgaactagacagctcttggttaagttcatctgttcatatgctgacttgtcaaaaaagggtgacaactgaatgacaatcctgctgcttaacaaaattaagtaagcaaacatgcttgtagagtatcttgttaaactttgtagattagtactgctagttgaaacaactagatgatgttcatggagaagcagaagtggaaagcttgcaaagcagttgagatgggttaacgtttctcaggtccgttgaggatgaatgtatctttttctctctcacactctcctctacaacccttctcgctgatggtgcctgagaggccaccgtgtttcttagttgtttggacagtttgctgggcagctactttgtaggtctagcggtgtctggtcacacgcacagtggtgttgtcagcatgtggtggtgtgtttgtttttcttttcattcctaattacagattcacagtattataggcttatattttttttctactatattaatatgagataggagtatcacactgtccgataccgtttgtttcgaaaaagaagagcttgcaaagagaggaggtaaacaacatgttgcaaagctaatgtgataggatgctaattaaggtgagagaacggaaaccggtggacagaccacctgatgatcttttttctatatgcttgtgtatttagtctgctcctagttttccaagggtttatggctctttagtaggaaaaggttggtttttttcttctatgttaatgcctaaatataaaagtaggcctttttatgttgcaaaaatcgtgtttttgtaagatggaaatcctagcggatcggtgtggtatatgaatgtgggtactctttttgtttggctttcttccaaaagctaggtcattatgcaatataatgatcttacttttaaaaaagttgaaacaactaaggatggaagtatcccagatagaccgagtatcttctctagcatagttagtactaatgtattatgaaaaccaattataccaaattgccaaccaaggttctcttttgagaacaaccagagacctgcattattgtcattatcttccttcctagaacatggcattgtgctacatggttagtagattgcacatggcggcaatgccatttgccgccattgaaggtccacagcaagataaggttactatcttttcagaaatagtttttcactaacactaataaatgggtcaacagctcccaacatcttctgagaacatggaaagactattgattttaaaattgtcccaaccatttccatatatgatgagattaatgggtacaaatgcatacataattaacttaaaagacaaccgaaagcaatggcggattcagtatggaggctggggaaaaggaaaccacccagtggatctccaatgagaacagggaaggacagctagaggaagaaggcaatgagtcccctcctacctcaagcttcatccctcagtgaaaatcgtaaatgcatttccaattaacctgacattccaaaccttcttttaaaatatatattttagcaggatactagatgccaaaattaaagagaaaaggaaaaatctatatctatgcctaataattaaaagataagtaaggtttccgggttttttcgtacgttgtttagttttccatgtcctacgtgcgtgtaaaaataagtaaggattgtgtttttcttttcatctgtcgtatgcacgtgtattatgtcgtccgactcttctctagatcagtttcctaatttgcacagctaggtccagttgcccaacatcagacacaaataaacacaataatcagttttggcccaatgtgtgaaatggtcggcctgtgtgctacaatttgcattgaacactgtatgccgtcatccggcaaaactttctatgctttctactaaaagcaaaacctttgtgcctttcgtaaaaaaagaaaagaaaaaagaaaggcaattagtccactcgaagtctcgaacccccaagctacatttgccagtaaatcatatatacatttccaattaagtcaacattcaaaaccaattttttttgaaaaatataaatctttttaagcagtgtccaacatgccaaaattaaagagaaaagaaaaggaataagataaaaaaaaatcatagagagagatatgggtctctaatcgttggatctctttgtaccacaacgttgtgcacatagcaattaatccaatgcacagaatcaaactgccaaatcgtgaaactgactgagatctcgccgcagagctgggagaaacgccaaaagaacatgaagagaagcaaaagcaaaactgctgccagaacagcacgacgagtctctttttatgatcttaataatactccctaagtttctcaatataagtcattttagcattttccatattcatattgatgttaataaatctagaaatatgaatgtggaaaatactagaatgacttaaattgtgaaacggaggaagtaattagtaatagtccctagtctctagtcatagttaaaggtttgcctagttaaagcgatgcaaagctttaagcagcagtagctctcactctataggaatataggatccagcagatcattcgatcgagtgaattcgctagtcgctacggttcaaatgttcaatgaaataaaataacgcaaaataaaaggcactgtgttatgttttatttttcgcttggatcgtgtcactacttcagttaaatataaaagcagtgacatgtcatctttgaaaaataatcatagtaggcaattttatttggataataatatccacgacacagaagtacagaactcacactgccaacgacacttaggctcagttcggcaccccacccaaacatcagtacgaaaacggaacaatctattagcacatgattaattaagtattagattttttttaaaaaatagattaatttgattttttaaagcaactttcgtatagaaattttttgaaaaaaaacacatcgtttagcagtttgaaaagcgtgcgcgcggaaaacgaatgagaggggttaggaacattaggtgccaaagacacccttacacatatccaaaatatttagtctgactcagattggataatatgtattcccttcgtaaaaaaaccaattgagtgctaggctgcaacaaaagacatactctatgtctagattcattatactagaatatgttatatcgtagtacttgattgccttttttttttggacctgcttcgttccaatataagcttagttttaggggtaagaggagaaattaagagcgaggaaaaattacctaggtgtcccctaataaataaaagatgataggaagtgagtaggtagttacgggtagaatgaagagaaatttaaggtagatgtgattgatgagataaatagtactttctcgatttcatattataagtcatttgaatttttactaagattaaataaaaaattagcaacatctaaaatatcaaattagttttgttaaatctaacattgaatatattttaagaatatatttgtttcggggttaaaaatactaatctatttttctataaatttgatcaaacttaaaaaaattcaactagaaaaaaaaacaacttataatataaagcaaatatagtagtgtaagattgtacttattctgggacagaattttgagcctaaaaatgtaccccctccatccaaaaatataaatatatagtactggatgtgacgtttcatagtatgtcaagatacattatactagaaaatgtatgatccagtcctaaatttttatatttttgggacggaaggagggagtatttattttaacaataatccgctcattaaacgaaaaccgagagattgtattatctgcgtatgctgtaggacatgcgcgttcacagctcacaagacgcccaaattgtgtgaacaaacaaacagcggaactcatctgccacctatacttcctgcttgttctagccgcctatttcctgcttgttttatccaacttgtttgggtttgaataaaaaaagtgcgtctacatcaaactggcaaagtacacgctacctcgttgaattttgctttgaccgaagccagcttaagctgaataaaatagaaaatatgcaacgtgtcccaaatttgtaccaaggccgacaaacttggtttctatgcctcataatgggtttgtggcgtgacaacttaaaaaaaaaacaaagaaaagtttgacaacatcacaaacattctataattagcatgtcggtattatctcatttatatgtatataagttagctaaaaattggtgaacaaatactaagtttagaatttaaacccatatatagagagcgaagtacataatcatgtggctgccatctatctagtgcttattagtttttaacttatagactcgatcttaatcaagctatttacttgacgattaactttaccacaactcaaaataccaatgtgtgatatgccatataaaataaagaattgttagtcacaagtgaaatactttggctaaatatatagtagcatctccaacagcttctccaaacgcctctctaagctaaattttagccactctagtaaaaaaaactccaacagcctctccaactggatggccaagccatctggccggccaaaatactccctcccctagcaaaatttggccagccaaagtcactggctaatggtgggccccacgaaaacacgcactgcgaggggagatggatcgcggcgacggcgagggaggggcgaaaaaggccggagaggagcgaggcggctcgatggcgaggacgcgaaggctcacggtgagggcgcgacggcttgacggtgaggtggatctacgatgagggcgtgacggcgagggaggagagaggaaggccggcgaggagtagatcctgtcattgcccgtcgtcgtctggcgggatggtggcggcagtgatggccccgagctccgccgctgtccccccccccaagccgttgacgccttctgccttcctgcgctgcctccgctgattacggactccattgcgtcgccttcctgcctccccgcacccgcctgcgcccaatgtcgacgggaaggaaggaaaggggaagaaggaaagagaaggaagagggggaaagagaggaagaagaggagaggagaggctgacatgttggtctgttgttattttggagaggattaatagagagtttgttggagtgagtatctcgtttggctaggcaaatcagataaagagttagctatatggatatttagagagtacaatttagagagactattaaagatgctctaagggaatgacatgtagggcaatatgctacaaagtacgattgcctcaatcttctcatctcaacaggataacatcattttttacactgccacgtcactacccacccgacacttaattttttatcccaaccagctcaacaatatatccatcccacggttaaaaacttttttctgtgctaatcccatggctaaaattggctaattatccacacattatccacaaatccagtgcaacaaaaaccccaaaaaccgcacgcacaagacccgggggtgcgtgtagctcctcaaccatataaaactccacgcatccaacgacctcgatcccctgattactctctcctctgttctgctctgctgttcgtcgcccagcctagattagggatgatcagggattagattagtgacagaggcccgattaaacaagtgatcaaactcactgttaatttgtttaatcactgctgattgatgctgctgctgctgctgtgatttttttagggctaaagagtccaagacgagaggtatctttcttgaacaattggttctgttgactcgcactgcactctctctctctctgtactcttcttatagctgttgctttctttctctcttttttcagagattcagagttgtcgtgtgtgtataaacagatttggagttgttgcgaaatttcttggggaggagaggaggaagagtgtgactctgaatctctgtctctgaaactcagagagggagagagagagagagagagagagagagagagagagagagagagagagagaagatggcaggagggttcggcggcggcggcggcgaggcgatcgccgggagggcggagcagtacgaggggaagatcaccggatacttcatcctcgcctgcatcgtcggctccttcggcgggtcactcttcggctacgatcttggagtctccagttgagtatcctgcatcttagttcttgtgtgttcttgctagtgatgttcatctgttcagttcttggaatttacattttcttttcgtgtccatgaaagatctgttctgaggttctgaggtttttgtctctgaattttctgaactttctttccaaaagtttggtccattatcactgaacatctatcgaaagaatcatttccaaatttgaaaaaggaaaattaggagcctggattattctgttcgaggttttgttaattgtctcgatcgagggtaaatgatgactgaaaaagaattcgttgtcgatgcaaaaaggagtgtgttaatgatggcgtctccatcttgattctccgtgaaaatgtttattttggggacgcaattatttgacacggctgcagagctgtccggggtaattaggaagctattgttagccacttaacgtgcagtgtctgtcctctcattttcagtagagatatcttctctcatgaaaagcatttaaaccccaagaacactctaaaacgtttttatacaacaccataagaaaaacatttctttttggtgaaataacaatgtaaaagccaacgccaattctgcaaaatctttatagtttgcaactatcggaacaatctttgcaaaatatgcattccatgatgcttctcaattatcaaacgaacaatctttgcagaagtgcaatctttgttctttgaagttactgaacaatctttgcaaaaatgcagtcttgatgctttacagttattgagcaatctctgcaaaggcgcaaactttatgctttgcaattgcagaacaatctttggaaaatgcaaacttgatgcttttcaattatcgaccgaacagtcttcacttctttacataagtgcagtcatctgctttgaatttgttgaaccgtcttgccaaaaatgcagtcttgatgcttcatagtacaatctttgcagaagcgcactttgcaaaaattacagtcttttcaagaacgcaaaccttgatgctttccaatatttgaacaatccttgcaaaactgcaatgctatccaatcgatctctctttctcaaaaaaaaaaaaaatcaaaaatcaaaatgtgcaggtggtgtaacagccatggacgacttcctgatcaaattctttaatctttcatttctgtccaacaatctttttcaagaacgcaaaccttgatgttttccaatctttgtacaacacttgcaaaactgcaatgttatcgaagaagaaatcaacaagaaaactaaccaatctctctctctctctctctttcttaaaaaaaatcaaaatattctggtggtgtgacggccatggacgacttcctgatcaagttctttatgcttttttttttaacatgcaaaaggattgcatggcagtataatctgatcaagttctttatgcttccaactctttctaacaatattttcaagaatgcaaaccttgattctttacaatatttgaacaactgcgatctttttgctctgcaagactgcaactgcaatgttatcgaagaagaaatcagcaagaaaaaaaaaaccaatcgatctctctctctctcaatgtgcaggtggtgtgacggccatggacgatttcttgatcaagttcttcccggaggtgtacgcgcggaagagcgcgcacctgcacgagacggactactgcaagtacgacaaccaggtgctgaccctcttcacctcctccctctacttcgccggcctcgtctccaccttcgccgcctcccacctcaccaggcgccgcggccgccgcgccaccatcatggtcggcgccgtcagcttcttcctcggcggcgccgtcaacgccgccgccgccaacgtcgccatgctcatcgccggccgcctcctcctcggcgtcggcatcggcttcggcaaccaggccgtccccctctacctctccgagatcgccccctacaacatccgcggcgccgtcaaccagctcttccagctcaccacctgcctcggcatcctcgtcgccgacgtcatcaactacttcaccgacaagatccacccgtgggggtggaggctgtcgctggggctcgccatgggccccgccaccgcgatcttcgtcggcgcgctgttcttgccggagacgcccaacagcctcgtcgagatggggcggctggaggaggcgaggcgggtgctggagaaggtgagggggacgaggaaggtggacgccgagttcgaggatttgagggaggcgagcgaggcggcgagggcggtgcgcggcacgttcaggagcctgctcgccgcgcgcaaccggccgcagctcatcattggggcgctcgggatcccggcgttccagcagctgtccgggatgaactccatactcttctactcgccggtcatcttccagagcctcggcttcggcaactccgccgcgctctactcctccatcatcacgggatccatgctcgtcgtcggcgcgctcgtctccatggtcgtcgtcgaccgcctcggccgcagattcctcttcatcgaggccggcatccagatgatctcctccatggtcagtacactacacagacgtttcttgatttttctttgacggtgctcggaggactgacgccggcaaggtgtttgtggaaatgcttaggtggtggtggcggtgatcctggcgctcaagttcgggcacggcgaggagctatcgaagggcgtgggcacggtgctggtggtggcgatctgcctgttcgtggtggcctacgggtggtcgtgggggccgctggggtggctggtgccgagcgagctgttcccgctggagatgaggtcggcggggcagagcgtggtggtgtgcgtcaacctgttctggacggcggcggtggcgcagtgcttcctcgccgccatgtgccacctccggtggggggtgttcatcctcttcgccgcgctcatcgtcgtcatgtccatcttcgtcatcctcctcctgccggagaccaagcaggtgcccatcgaggagatctggatgctcttcgacaagcactggtattggaagcgcatcgtcaggaaggaccccaagtatcagggccaccaccaccaccagatggccgccatgccaaccgccgccgccaagtccggctcgtcggaggtttagatgatgatgataatgaattgatgatggtttaataaggttttagtgggtggtgattaagacttgatcttgaattgttcatgtggcagtagcttttttgatcttcgattgatgcaaaagaagaggtcagagggttaatgcatgtgtgtgctcgtgtgtctatagttttagtttcatgttcttcagaattcgattcagtgtagtggtgggctgattaatggatcttgatgatgcacaaggaatgcagtgttctgaattcttgaaattattctcaatataacttgtagatttgtgtagagttctggttttgctagttggctagagctaagtactacctctgttttaggttataagactttttaacattgcttacattcatatagatgttaatgaatctagacacacatatatgtctaatttattaacatatatgctatgaaacgganaaaggagncactttctccgtatcgtggcatatatgttaataaatctaggcagtgtctctgcccccagctgaaagcctgaaacactgcctatgtggctttcgataaaaagccgggtgttgaccttttctctaaaaaacctgtagatttgctttgatgtttttgcaaggtgtgttgcagataattcttcattttgcaggaacgatttgcttctaaaacgattatagtgtgacagagaccatcgtggcaccaatatttctcttgtaattaacagttttacctaggtcatttgtgactgatgcgatgctgacaccacagttgagctagatcagtggataaagtagatattatctgaacatcatttgtgcctgatgcaatgctgacactatagttgagctacacctcaccagcagaactaaattaaaatgataaatgctatctgagcatcaacaaaaaattaaagattagcagtcgctttcatccgtcaaatggtcatgggacgatttaaataggacaggccggaaactctgaacatttcagagtcaaacgatcacatgcatatgtctgactcatcagttcttcatccataccatagttggagtcaacagtcagtgcagcttatctctaggctctagcgatcttgccatgctcattgcttctccttataaaattctgaaacatcgcaatccccaattctcgccgttctttgcgcctttcaggaaactgaaaattcagagttggcatcagcgtcatacctctggtggaatttgaagtgtacgtgaagattttcctgctactatctgtagctctctgtcatcattttgggctgaccttttgcactatttttaagttttgtgtttataaagatttgtactctgtccgtttcaaaatatgaaaatttttaggatacaaaatttgtaccacaatataaatatttatgggaacaatttaattccaatacacagaaatctattaattttcaacaaatgggattcttaggaagggaatataaataattcaaaatgtacaatttgaccaccaaagtcacaagggagaatcttttccctctactttaattagtttatgtacttcggaacggataggctatctgtcatcaagaaatgtatgtgtttcggtttgaccttttctaagtgatcacatagtttagtcagtgctacttatctgttgctaattatttatcttgccattgcttgaagtaatacgatacactagtaaaatatactacagtatccaagagttcacctgtttctgaaaagcctattgtctacagactggaagcatcagacttttctcatgaaacagacgtgaagacttgcgtagcatcagcgacttgaaatcaccattttataattccagaactgaacaagatcacacagtgctgcaactgaaactgactgccctgaacaatggtaaattggtaatttctcatgcacataagtactctctccattccaaaatacagtacttctatcgacttagctatttttctacctacttctttatctcaatcaattgttcgtctaacatttaatttctcaatcgctttttcatttcaacacatcacaatttagcctctctacttaattctcgtgaaaaactttaaaagtgcttatattttaggacagaaaaggtacatgaataaattacagaaacaccagtaaccgacaatacaaacatttcagtaccttaaatcgtattttctggcgtagtactacttttcaacatgtattcatgtttcacacaaaattaaagactgtcacatcagagtttgaacgactgaacatcgagtgctagactctggtgttgatgaatgcatctgaattgcaaatggtgaagcatttgataaaatgaacttacaaggtccaagcctgaagatcctgaggcatccagggttttcattatcctgcagattatatatatactgggtgctattagggataaagcggtcgaaaactatatcattttttattatttttgaggagcggtattggtacggttaggaattttctgtgtttgtgaatttaactattctttgatgacttcaaaaaaaatgcaaataaaaaatagaaaacctaaattttacatatacctataaacagaagcaatcagaaacaatatcattttttattactgtttatggaaactgtatgggtaggaatttccatatggtttgcacccttaggtgccatgccagttcactttgtggcactctgctgaacagcctgctcgtataaaactgcaattgaatatgttccacgatgtatgcagttgctggaatcttataaggattaaggattaacatattaggggctggaaatggattaaatttagtcaagtggaaacatcttgtggtcatgggggtgacaggggtgtgcattgggtacccctgagactgactctaggggtgtgtattgggtacccctaagactaactctacaacacaatttaagctaaaagtacatgatggtatctaatgggaaatcaatatatgtttcgattattaatttgtgatgaacaatgatatatgagataactggttttgatatttatgatatgagtaaattgcacagtagtataagaacttgccaggtgggtgcaatttagtgcaaaaacttaaaaaatatgcaaactggtacatgaacttggcaatcaagtgcattttggtcaaaacgctgttacatacatatgattcaacctattttgtttgttctattataagcataactactagattattggtcctgagtataattgaatatgtttgactagtagaatcgctcggaaatcatgttacaacaatttttttgcccctagtgtaacaacttgaaaaatgatcatgaatacaattaacgatcattatatttttggtttcaaatcgacaggttatttattattgtaagcaagcaaatacaatacatctagaccattattatttgacaatcattatacttattagattattggcaacgacgactgctcttttttttactacgtggcttaaaaaaggtgtggtgtctaatattgattctttaaccaaaatgcacgtactagccaagttgttgcacctaaatgatcatttttcaagttgttacactagatcgtacctacctaccaaatttatataccatggacacaatttactcttatgatatttagcgaagtggtgctagctatgtgggaccaaattgactaggccagtcagaccagccaacccgaaagcctgatggactctgtgttggtgtagctgtcaggttgtttatttggatactcgtggttatgaatcctagatgatttatatacgtgtatcggtgatttatatacggtgtatgctaatgttgagtcaagttgctgccccctgcccccccaaccatcaccaatgcatgcaaaaataagggtctgttcagattatagccaaaataaactttactaaattttggcaatgccaaaattttagcaagataataatattgccaaaactttgataagattttttatgtatttatcaaatttgacaacaaactaaacgtagacattttttttggcaattttttttaaaaaaattgtatcgttcgttgaaaatggtatcaaagtgaataagccctaaatctagctaagttggcaactaagaaccacagcaacaaaaaacataactgtcaaagatagttcactttcacacttacgattgccaagttccaaacatcatttgacatttcagtttaaacatcgttgcgcttacatgattccagtacatttcaaccaagcatcattcatactcaaatgtaacacaaatatgtcatttcttgggcaagtcacattgttcagattgcagaacggtattcaggagtaaggtgggcagaagccagccacagagcaccagcaaacacacacctttacttacaccttggaaaatgcaccctgtcgacatagcctcccgacatcgccgtctgaacattcctccggaacttttgtgggtcatctcggaggacagccgcagcatcatggttcaagggatcctcgtcattgggttgctgcaggtaatgtagcaaagataattgttacatgagaaaacacagtgcaaatggtgagttctatcccacaaagacaacaatttcacgtgagatttaaaatagtaatatggcaagtagcagactagtttagacatatctgcatgtaaaggttcaatctggtttaatcatgtgccacttcatatttacaataggaaataaactactaagccattattgctgatagaaaataaaagattgatcagttcctaaaacaaatacttacaatgaaaagaaggttcaaaccatatacaatggtattgatattcaagacaggcttccagtcttcacgcaggatattcaggcagacatttccgtccaagtcaatattagggtgataaacctacaaggtcaaatgatcaatatattaccgataaagcccttcccttggcataagccggtctggctgattgcgttgtgtaacaaaaattcattttcttctaatatattgatgtgcaattcttttgcgcgttcgcgaaaaaaaaaaccgataaagaaaggagtaggctacagttaatagaatctatgttaccttagtcgtgcacttgaccttgggcggctcgtgagggtaagtaggaggaacttgtaaagtgaaaacaaaagctccacccctatgaacgaaaagacattggatgttagaatacttcaatttgaaataatctgaaaaaagtaacaccttgtgtatattgaaaacacacaaatgatttatttccaattaccatcacttctgttttttagggcaaatatgtcatccatattgttcataatgtttttacagcaaaggagagggaacaaaaagaaacatctaatgaaaaaatgaaagcaatctacaacagattattattagctacttttatttgtatttgaaaattttaaaagaatggaacaaccctttgtcccttctacatcaagagaaatcgtcaggtgtgatgtaaaatatgagctaatcctcctaaaccatatttatcaacaaacatgtctccaagtacatcaaaagttaaatgcgtgcgatttaaagatgtcaagaagcatccaatgcctcgtaacactctacatgtggcaactttcaacagtaaaaagttttatagtagtttaaatgttcagtcaaaattgaagtacagaaaaactaaattgatataagagcatgtgtaatagaacagctaagagatttaatgggcttaaaagaaacatctagaatatacttacacatagtatccttcgtcaggccgaagagtaatctcaatgttcatcagatcatcctttccattaggaaaagtaatgttggttttctttggaagattaagctcagcaatgtctgtaagatacaatatcaatagtcagcgagatccatatttggaaaaactatactaacgaaaaaggaactatttccatcacataaaaagatccaaagacagtgagagtcatgcctattatgttaatatttaaataggagcctggacaaaaagataggtttctagcaatagtgtaatcaacatatctaaacatcattatggaattatttcagaagcgaattatatgtgtgccacatgttcaatttgagttgaaataacgttaattagattttagttgaaaatgcagatttagtaaaaattaaaattggacatttggatctttctctttattaacacatactaagtagaagtcatgatgttgtcatggttgtcacatgtagcagcatgttcttgtgtgggccagcaagatactatcagcccactcacccacagcccaccctttgtctcaagcccaccaacatcctgtttagtactggctagtgcccactactcccaagtcacaccacgctgcatgtcctatccctaaccgcctcattcgccccctccaactccccacaaggtccatatttctatagaagagcggccaataaagctaagtacacgctcaaccaatatggtgacaaaagtacaacatagtttgtacattcacggacatttcatatatagataatagttagcatttagatccttgtttaatgcatgttcatttgtatgacacagttctagagatgtaaatacataaattagcaagaaagagaagttcaatctagcactaatcagcacacattgaatagtataatatcagaaagctagaaaccaaataacacaagtaatacaataaaaaaaaacttctgcaaaaacaaacctttatggagacgtaattctcctggactttgcttcttagcaggaggtctcccatttgtatttgccgcctcttccttcttctgtccctttatcttaaagaggttcaacatcttctgtgaaacaagagagaaaagcttatagaatgaagtattaaaaagaatgtgtctttttgacaatataaacaacactaacatatatatattaacagaagaaaagcatccacttgaaataaaggatcattttacatgcaaataagtacaaattaatgatgaaccagagagcaactgttcagtcagttatctcagtttctttaatcattgtaatagggaaacctgccaacctcttcaggcctgaatgcctttagcagccatcaggcatcccacatcaatttctcttacccaatatattaaatcagtaagtgggccataattcattccttgaccctattaataggcagaatctcttaaagacagtcaaaatttttgtaaattatgtgagacacaatcatatcatcgtaccgttgaacagtaaaaagcaccatgataaactccatgatagaaaaaaaaagagaaacacctaccaccacaggacataacatatactatacattgacaacctgaatttctttctttttttttaaaaaaaaaggcaatgcacagcttcattctgttgaataatcgatagcaagtactaagtactacccctaaaatcatgagttaatacactgaattcgcagtatacaaatttcaacaaatatactaatccatagaggtgtcgatacattacacaatgagatgaagggtttggataaacaatggccattggttcaaaagggtacatgtattaaaaaaaaccacaaataggctaaacatatgaaaatttccggaggttttggtaccacctcctagacacatgataaaaaagagaggggataagagaagaaacatgaggcttatagtgacttctcttataaacatatagtacaacttagctaaatctatagttggctagggaaatcaatactttgtaaacaaattaacttattatgtcaaaaccttcttaaaagcttacctaaactaatagatcatacacaaaatttattaaacaatcaaaagtcatgcaaagcgcgactatgtgggtagttacagagtgaattataaaatctatgcactaaaaaaggttttccttaagcctccatcgtttccaagaggatgctcgtttttaccaacaaggtgacaaaaacacaacaaaagtaacagcaaggactaaccctaacaagatactagttaaactcccgactccagccaaaaaagctgcggcataaaaaaaaggtttttcaaaatcaagaatcagcctatcatcagcaaaggaatttaactttggataatcggctaaaattccaccaaacgatcagcattactacaattctcctacatccccaactattcatatgcccaattcccagtgcgccccccaaacctgaaaacctagatttccacggaaacacccagcagatgaatccagcgaccacaacggaaaacgaaagcttcatcgaaattgaacccaaaaaaaaaacaactagaacaagaacaatagcagattaaaattaaccctcctcccctcatggtttctttacccatgatcaaccggcaaaataaaaatataagggaagaatctttccgcaagaaaggagacgcaccgtacgaagcgccggtcgccggtggacgacgacgaggaggagggaagagcccgccggagtgattcgtcggcggcggcggtggcggcggaacacccgagcagagcaaagctgctgcctttttgtgctgtttgcgggagagagagagagtttgggccttttgggctgtatacaggaaaactatataaaaagatagataaatcaaaaggagaagaattcggaatattacgccgactcgcttttgatttcaagatgcgacctaatttcgcacgtcttttcagtttttcacctaatcacggacacgacacgacgttactatttcgcgatgtgattaaagagatttaatttaaaggtgtgatttttacgtctctatgatatattcggcttctgttcttgatcgtccgtataattggagatggactcggaactcatgttcggactatggcttggaagtctattacatttcgaatcaaagtatgttggtgatttattactgatcggtggtaatacgcgagatgtgtttaaaatttgagatgtgtttaattttcgtaccatttgcacctttgcgggcccaactaatgcacgcatgcccctgtcttgctaacgcaacttagattatagtatgcatttattatacaaatttcacgtggaactgcttaattttatgatataatagtatagaattacttggtgagcacattttgttgtactgtgtgtatataaagaaacggatcaatcgaggactttttttgtctgtatttaacccaatatggcgaaatcttgaacataaagccatggtttaggttgtttagtatcttggtccacccttgtgtatacgctagcattttcttctagacatatttaatttattttttaaaaccgcaaacctctcgatctttctaaggaaaaaagtctgataatacttttatgcaatgggagacccgatcaaatacccttagctcacactacacaccaccaactgccctaattctttaacgttctgatgcatatgtcctcctcctctacgattccattttccctactgatatgttttagtgtctcaccctctatgatctcttactcctccctctctgtagaaacatgcgaccgtcaaattctccaaacacttttgttaatctttcagcgatgtttagggacatataagagaagggacaattgcattcttaccttgttttcaactccaatacgatgattttaccccttcttttccaaccttgtgatttgccataatttcttttaaaagataaagcttgcattttcccctcattctattaagagaacttttctcaggccttttgtgattttgccactattttcacatcaagaattcttacttgaatttcacatatttagttaaaaatatgggcaagaaaaaacttggcatgagatacgggtagattagactaagatcctgctcctaatttgttagatttagttttcacatggaaataaacataattgcccaacgaacatctggcattcatgtaacatcctagaatgagcggctgcgatcaaaccaagagagtggtgaagtaaagagttaagggcaacgtgtaaaagactaaggtgatgtgctcgaagtactgctagagcttatgctccagcgcacacaacaagcatgcttgcagatcatgccatgctgaatcctgtcgcctaccaagcctagcttatcgatgagacgatgaacagatatattaggactcgacatttttttcagtactcaattttagtactttccattgtgtgttgtaatatcctgcaatgcttggtagctaccttgaaccatcctacgtctaatatccagttcagggaatgcatgctttgctcagttaaagtgatctctagtcctgcctcctgcatctattaagtaggctcttataattgtcaaagatattgcctttaaacctattcttatttgggtgattttttccttttgcaatttcgtagtattactatacagatatacttacaatgtacttgttgtaggattgaacactagcaaccaagtctaccagaagaggaggggagtgtgggtgaatggtaggaacaccaaaaaccaaaatatttagcggaaataaaagttacccacaaattcgatcgagatccggtcagactaacatgttcacaccggtctgactacacctttgctgccggtttaaccggtgttgtctagccgatttgaccagtacattggtcgctgtcgcaacctcttgatgccgccggtctgaccgctgc

SEQ ID NO: 28523 - DNA, 15037 bp, Oryza sativa
  unsure (1)..(15037): unsure at all n locations
tcgatgaaactcttgaaagtatatctaatttgttctatcaagttgagttctctcttaactagaattaaaagctcgaagaaaaccctaacttttgtgtcccaaaaaaatcgttatacccaatatgtctctagccacaacccttctactatttatacctaaaacattcatgcccctaaccatgaatcctactagaactggaactgctaatcacataggaaacccaacaaacgagggaaacaacttaacatccccatacaacttcacatttcaatcttttcaaacttggactcaaatccaaatttgacttcactttctatttgcacacaacaccacatgtataccatatggaaagattcacctccacgtgcattgttgtctagcctgagcatccccgcgtgatatttttgactctttggacctcaacttctcctaagcctagtcccgatccatcaccggctataatctcatggtctcaagcaacaccagcacacgaataacaaagaaactccatattcaagtacaatatcgcaccaacttgactcaatcaacacacaatagtatcacatacgaatagaaatcatctaaaagtcataaacatgaagcaatctagaaattccacgaaatcaacccgaaaccagctccctcctagagtctgccggtcttaccggcgacacccgcccagtctaaccgaccaccagagctaacaaccgaaaacactattcattgtattttcacaaacacttacatttgaaaattgtttatcacatagaataaattatccctgttcagaccgttgagccacctggtcagaccggccacatatacctatagtctgactggccacccagagccaacaacttctgaaaacactatttaccgtattttcaaccaacacttacatttgacaaatgttcatcacttcgaattaaatcatcacatgattttgcacttgctactatatttaaagttgaaaacatacatgtagtatgtttaaattcacaggatattatttatatcactatcctctcctagtgacatgacgttgtgtaggtgcgtgagtatattaaagcacaatgcttacacgctagcacgaaaaacatttgcgttttccattacacgctagcacataactgctggttccttgtgtatcggtagtgattggtaatcactgctatttcattggctgtagctcttgagcagagaccgaaatgtttcattccattatctaaaaaaaatcactgttatttcagaatggtttccggcccaaacaatgttgtaaatcggcagtgatgttgtcgtgttgagcatcagtaccgattaaaaaacccacagcaaggccgtcttatgagtggtgctaaattatatactactagatctacatgttatagacacatgaggacccacatgtcatagaaaacgagtggcgacacatcttaaaagtggcaagaagtgaaatgtccctcaattttgcgatctttttttttactttttttaccttttttcatttttaatttttagaaataaattggaataattttttttagaaataaaccctttcaaaatctaaacctttcagtcacaccacctgggctagtgtggcaaaacaacaatgtcataccagtctgaatagcatggcaactttatttgcccatgtcaatctgctggcgttgcaaccttcgttgtgggtgaggtgacagtattattttgtgacggggtgacgtcgctaaaagattcagattttaaaaataagttttagaatggtttaaataaaacaatcaaaaagtaaaaaattaataatggtttaaatgaaacaatcaaaaagtccaaaattaataaaaattcaattttgtatgtctttataccacacaaatctcacatataaaatgatgcgcgtcgtacattttggtgattccactgttctgacaaatgttctggaaatggttagcttttgatgttctcaaaatattttgtgaactagttgtcactttatcagtgttaacgattttttttaaaaaaagacaaataactcaatcttgcagcggctctttaccgccgccaaacaacattacaatcatgtgctcttactaaccatgtagcgcaataataatgcagcttttgttgttctcaaaagagaaccttgttggcacttgttaatttggtaccctaggcttccataggaatatgacaaatcattatctaaaaaaaagaaaatgacaaatcagcagatgagcagatgagcttctccaagagctgtgtagttgacatagtattattataaattctggcatattctgagaactactttgttcttcgggtagatgacatatgaatgacaaaatgatttgcatgggatttaatctattttgcagatgtcatctgcataaaagggcaagagatggccatagcatatcctgctattctggaagcagtttcgttattttatcttcatgccctgttcattgggctgaacaacttgctagctccttttatgttgggaaggaattattttgtgaacccctgtcaaataaaaatagtatgccggttgtgtaaactactggattagagctatctttacttgagataaaacttagagcaattttacggtccttgaggaggtaccatgaggtaccattttttctattataaatttggtacctcttaaaaaaaaagtacctagtactacgagataccagattttacactaaatttttggtacctcatggcacctcctcaagaaccgtagaattgcttattgctctaaaacttagtagtactcaggacaacctcgatgtacgttccgcgacaactatcatgtcactatcagcaagagcaccttgccggcatggtttaatctcacacctgccgcagctgtggggatgaggatgacccaccatgacgaacatcatcttggctttgctaaaactgaatgaaagaaacatttgcactagaaaataggcccaatcttcagcgggttcatatcatttgctgtgtaatagatcaagtattttcagctcaatcagtcacagctgttcataacttctcataggcattcggcaatttagtagcaagcttgctgagcaggttctcgatgtctcctaggcttatactccctccgtttcaaaatgttttgacaccgttgactttttagcatatgtttgactgttcatcttatttaaattttttttatgaaatatgtaaaactatatgtgtacatgaaagtatatttaacaatgaatcaaatgatatgaaaagaataaataattacttaaatttttttgaataagacgaatggtcaaacacgtacttaaaaagtcaacggtgtcaaatattttgaaacggagggagtaatagatagagtaggctgtgttgaccatgtctaagctagtcctagctcttgccatacttcttcctactaatatctttccattcaatttgaaaaattaatctcattaacttattaacacacagattctcctataatgtagttctcctcttttaccaatgttcgtgcacaaggacgataatgcgaggaggttagatccactgtgcatgtaacatcctagaatgcggctgtgactagaacgaatgtgtggtgaattgatggactaagggctgtgattagaatgaatgcgtgatgccctcaaagagttagtactcagtatcttaactccgttttatatcagcattgcatttttcgtcaaggccaacacacactcttattcccatctacaacaagtttaactccttgctctgtgcaacaaactatctatcatatggttattacttgagataagagtgtacttagtagtacacaggataacctcgatacgttccacgatagctatcatgccactgtcagcaacagcaccttgctggtatggtttaatctcacacctgccgcagctgcgggatgaggacgatccacaacgacgaacatcatctcggctttactaaaacagaggaaaagacacttgggactagaaaataggcccaatcttcagcaggttcatatcaacttccatgcagcatatgaagtacttcctgctcaatcagtcacagttgttcataacttcatacaggcattcggcagtttagtactagcaagcttactgagcaggttctggatgtctcctaggcctatcatagatagagtaggctgttttgaccatgtctaattaagtcctggctcttgccatacttcccatttactccttattactccctccattactaattgatctacattttacctgtgtgcaccaaggccaagaaaatacaataattctctcatgctacatttactttagcaataaacttgatgcatgcacaatctccactattttctagccaatagcaaatcaaagcacttgtatgcatggatgcatgtatcaatgctcatttacccaatgcacaaataacgaatagacataataaatgaacacaaatatgaagatcatttaggaatattttttaaaaaatgatatgtagatcaattaggaatggagggagtaacacacaccgattctcctataatgtagttctcttttaccaattttcgtgcacatgggcgataatgcgaggaggttaggtcaattattcatgtaacatcctagaatgcaaggctgtgattattacgaatgtgtggtaaattgatgatctaaggccatcgtgtcaaagagtggcgtgatgccctcaaagagttgctggagctcctactctagaacacgtaggggaaatgctagcagagcatgccatgttgaatcctgtcgcctaccaagcctaacttctctacgaggaaatacattaggattttagtttttttagcaatcgatctcagtattggcttttttttagcaaggctcgctagctataagctccgggaatgcaagctttagtcatttaaacaatttaatctctagtcccacgccaccatcctgcagctattcagtaggctctcataattgttgatgatgttgccttcatagctatatatattatatgtttttttaccgtccaacactgtacagtggtaccaactctcaaccgttggtataaccggatccaacgactagcggaggtatcacgataccacttgatctttgagatggtaccgcataactgaagaaaagtggaagggtaagaatatattttcgtgttggatggatggattggctgtatgaatggatgatgtgttcttactttctcattggttcacatacattattccccaacagggttatccggctagggcagatttatgctgagcgcaatagcttgcagggtgacaccgtacaccgccgatgacacatcactggacctggcagggtgttgtgcgcttcgtcccctcctttggtcactcgatctccgccacacactaccgagctgctgcaggaggatgccccatcgagggagataggggatgctgccaccactatctgacagggtcaccaggcttgtgtcgccgttgtcctttgagagctcaccctgctgccactggctttgaggtggagggaagggtagcggcgttaccgccgattagggacgaggttagcaataccaaagcgaaatccgggagcagggtgcttcgcctatttcatcgctgatttcgaggggaaagtcggtagctcattattcagtcagcatggtttgtttatagtccacaagcaaatagaacctcaggaacttccggggggggggggggggggggggaagannaccnngncnnnnntccccnctataaaagaaattatttgctaaaatttgaactacccaaatcttgaatcattgtcccataaagtgaacgcctataactaaaatcagccagcatttgttggactaggagataatccgtgaaaaagatcaaaactagcgcactcatataacatcctagaatacacagctgccgtgacaacagatgtgtgatgaagtggtgtactaagagcatcgtgaaaaaatagcatgatgcaggcacagagttgatggagctcatgctccatgatgtaggattgaacacaagaacctggcctaccagaggaggacaaatgatagtaacaacaaaaaccaaaacttttagtagaaataaaaattaccctcaaatttgacaaagttctcagcgtagccggtctgaccgccatgtccacaccggtttgaccacaacctcaatacgttctgtgacaactaccatgtcactgtcctacaacaccttgccagcacggtttaatcctacacctgccgcagctgcggtaaaggacgtccacaacgaacatcttcttggctttactaaaaatgaatgaaaaagacatttgggactataaaataggaccaatcttgttcacaataggtccataaacttactataaagatatctctgtcaaaactgaaacaggagaattcaacttttttctcaaaactgaagaactttccctcaacattgaaccctcccatgcttcaacctcttgagcctgttcacgcaactgttgtgcctcgggtgtgttcttttcatgaagttgggaacttcttccttccacacgcaaaacggggtggttcattagcatatgattaataaaattattagttaaaaacttaaaatatagattactacgattatttaaaacatctttcatacaaattttttttttcaaaaaaacatactccctccattacaaaatataaggcacaaccacccttaacccaaaggccaaaaaacaattattatcatcgtgtagtttgaatcatcctaataaatataatgcatgcgtccaatagagttagagaatgtgagaatgaaggatttaaaaaagtagtaatttaatggagaatatctcatagttaatggtatgcatgcatgtatgccttatattatggaacatgtaaaaaaagtggttgtgtcttatattatggaatggagggagtaccatttagcagtctaggaaatgtgcatgcagaaaacgagggagtagcactcggaaaggctgatggacgggtgatcgctcccccacccgcccaccctctcccctatactactagatgtactcctctctcttctcccccttcctcctccccttctcctctttctactacagtagaccacacaattttttaaaaaaaacaaaaattagaaaaatttatgtatagaaatactatatataaaaaatttgaattcaaattcaaatttgaataggatatgtaaacttttgacttataaactttgggtctataaactttaggtgtataaactttagatgtatagaaatactatatatagaaaatatttgaattcaaattcaaatttaaatcagatataattcaaattcaaatttgaatcgggtctataaactttaggtctataaactttagatgtatagaaatactatatatgaaaaatatttcaattcaaattcaaatttgaatcggatatttgaattcaaattcaaattttaaacgggtatataaacttttgacttataaactttaggtctataaactttaggtgtataaactttagatgtacagaaatactatatataaaaaaatatttgaattcaaattcaaatttgaatcggatatataaacttttgacttataaacttttggtcagatgtgtaaactttaggtgtatgaatttactaaaatagaaaaagtaatgcggtgccaaaaaagaaaaccaggtggagggagggaggggggaggtggggagcgaatctaatagctaccccatccccacggcgatcgatggcctattaggcgtacccagtagcacttagcaaagtggggggaagaacatagccgaagtattgttagctaaatcaatcgcagctgttcataccttgatctccggtactttgtactgctagtattatattagcaatattaccgatatgaggagttggtttatatgatcatattactactttaataactttatgattagggtaattttaccatttagccttttttttttccttgcgttactcaggtccatcggtcgatgacaggacagcgaattcttccgccgctgccgtccgttcgatcgttccccgtcgcctcctcatctccattcgttatcgtcagaatcgtttaatttgtcgatggtttcgtcgtcatgcgaggtccacaagcgccctctgcttggtgccgattgcggcggtggcgaccactccggcagccacgccgacgatgggctttggtccggccgcacacatcgttttcgcactaatgcagcaatctatgaaaaatcacagatgttaaacgcaatttgtaatgtcacaagtatgtccgtttcactgccagaagaatcaaaagattgggctagctaatcaaagcaccataacagaattcgggggatctcagtaagctcattttgttctgctcctttgcaagctgaagtctggggacaaagatcaggtacgagaaggcatcggcgtcttgtagagagggactgaattggcgctgtagtcgtccggaggagaggcgcatgagacggctgcggcgatcggggtagtgtggatgatggaggttgcgccttgaccagaacgccataacggcccagaagtgctagggattccaataatcggcaaaactattcagttttaccattccatgctgatatttttatggacgattatatccctttttgtttctactaccattaattaagatggtagcataaagctatctggcccattcgagggaaatagatctatggtttagattaatttctattaccagtagatcagagcaccgtagagaaactttcataatttagtagcaagcatactgagcaggttctggatgtctcctaggcctataatagatagagtaggctatattgaccatatctaagtctgggctctttccatacttccttatattaacgtgaacttttgctctggctatttaaatcaatttgtggatcaagtaattgttcaccacatgatcataactgcaatgagagagcactttgtatctgtctgcaatttgtatatttttgtttaccttttagaaggatttctgcacatgttctcaaatggattcagcaccgcaccaggaaacatttaaataggattagaacatttgggccgtgacaaatgtatgaagcatgagtttgtcgtagatggaaacaggaagcagcctctccctgggttgtcctcgggcgggcagctcggcggaaaaccctatccacttccgctgcccaccctttccggctctctctgtctcgccgccgccagacaaccgtgcagggagccaggatggtggcagcggggctaaaacacagcgacacgcagtctctggtgcgagggaggagggcagagtacgtgttagaataaatgggctaggcccaatttatttctattaaaatctcaagggcccataataaatgttaaagataataataccaccttgggaattaaaagcgtagtatctcaacttaaaaggcagttatcggaggctccccgttgaccggttaaagtgggggtcggatagccacacgcgcgcgcgccgagccgagccgaggctgtggcccggctctctctcgatccttttgcaacggttaaaaattcactccacgagattacttctgtaacgggcgagcgattcaatactgattgatcgtgtcgttacagaagcgaatcctcctcgtgcgctattaggacgagacagagaccgacgatcagcctctccacgaattctccattgtttgttctgatcgcttgcatgtacaagtgattgggacgagcagggcctccagaaccacaccctctcctgagatctgcacgggtaggcgggtgatcaggtttttggggagtgcttccgcacgactgctcgcttcttcgtcgtcgttcggttctatctgcattgcgcaatgtctactggtggtggcacacctggagcagcaggtgcggcaggaggtggtgcgctaggagcaggaggtggtgcgccgatcgacaacaccaacggaggcaattctgcctcacattccagcggagggactttcacagggtataacatccttctgttacctttcattttgttaaaactgtcagtcgcaatattattgcgttgcctcaatgttgatgcttattttaccttaagcatgctgatagttatatttagttttatcactagatcgcttcacattgtgcatgtcatgtttattgtcttaacattttggattaaaatatgccgatttatggccatatttccaacagtacggtgagctggtagcctcatgggcgcttgctgatgagcgacggttggggtccgacaccgctatggccgaattcagtgctcctacggttggatcgggccgcgcagtccagcgggctgcagcaggaggccggctctgcgagctgcaacaggaggccgacgagggcgcggcatgactggcggtagctggaggccgacgagggctgggcaatggccagatctgatcggtgcggtcagatccgtcccctcccagccactaagcatggcaggagctaggagcccgttgacggtgtgtgtgtgtgcgatgtttcacgtggaggcatgcagaggctggccggtgggggtcatcggtacaatattgtccaggccggccatcctccgtcagcacatgtgtaaacctagcccgacgctttagtcatcgttttccctcctgggggtgttatcgagtcatctctctccctctggtagggccgcctggcgaaaaccatgtgttggttctcccaagggcctcgacagacggcagcggtagtgctcaccattgctcttctccttagagacgtcgtcttggaggccctcttgctaaaacttttcttaggcagctagtgcgagctctctcttgaagttttatcctctcggggcaacactctagctaatgcaagttgatcatattggtgggcctagcggggcagagcggatccattcttctatttcaccctctccccctcaatcccaaaggagagttgagttcagtgctcggttgccagggcttggtttcaagcggtttccgttgtagcttccttgttgtctagcggcggccggtcacgcttagcggtggctgattcggtgcgagccttctcattggctctatgttggagctatcggtgtgttgtggttagagttttgtttttttttctttgtaatttttcctactttattgatggaataatcgtgtgctaatagttcaaaaaagagtttgccttcgatcagtttttcggataccaacaaaaaaaacatgtaatttggtccgagcctttgtacctcttacttatgaacgttgctcaacatgttttcacaatattatgtccaatggaaggcattgttcatgcaaagcactgattccaacaataactcgatcttgtgaaatacgagttcttcggccggctcatgatacacatgaaaatccttacggcagacaaactacagattcagggatgggataacaacgagatttgccccgtctatagtttagaacctgagacttctcatgacctcctcatggagtgttcctttgcaaatgtggaacaaacttagacgtactccacatgtcttccccctcccttttctcaggaaacatgttaggttggtgggaaacttgcagaaaagaaatgataaaggaccaaaggagcaatttcgatggcctcttcatctacacggcttggggcatctggctacaaaggaatggtagaatctttaatgggaagtacagtactgtgtctcaggtttttgattccatcatagacatgtgcaaagagttcgatgaagcccatgtttatttgatgagtctacaacgcattatgctgttagttgctttgcatttcctaaaactcttgtgcctttattagaggtagtcttcccctttcctttgtcctaaagaagaattaggacctctccgttcttcctagaggtccttctaagggaccgttcaaagccttgaggccatatgctgtaaaaattgtgttttctccccctacttaactgaaattggcagagctcctgcccttttcccacaaagaaaaaagggtgaatagccaaagtggtcctccaagtttcatctgagactcagtttagtcattgatgtttcaatctatccatattagtccttcaagtttttattttagttcaaacttatccttgaaccaacaactctcttcataaatgacacttatacccctcatcattcacatatacaagagaaaaattgcatgcttgattttttttatagataatacatagtatattttgtaaaacgaaaaaaaattatgtactaacaagtgtatacgatagcaattgcttaagttttatgtgcacatattgaaataatgggaagtacatctgtaatgttgtttattcatgttggctttctcttttctagtatatagatgtatacaaattaagggcaaaaaggatattttctaatagaaatattgactagaaatagccatatggcatattaagtggacctaaggatgatttcaagccaaaacaaatatttgaaggacctatgtggacaaaatgaaacatgaaggaccaaattgagccttcgctaaaacttgagggactaaattagctattcacccaagaaaaaaaagaggaaaaatgtaaaattctagaacagagttgttacgtggcacaaagaaacatgagcaaaacactagctagattgtcaatgatttagtgtagcatgaatgagaaaggaaaaaagaggaggaaaagagaaacaggtcgatcattcctaacatgtacatatacattatacaatagtaaactttttttatgaaggggaaattttttcttcatctcagaaaatttactgtaagaccacttctgacctcttcatagctaggatgcgaacatcctataattattaaggccctgtatattccctggtacaattttacaccctatcatatcgaatgtttggacgcatatatagagtattaaatatagacgaaaaaaagctaattacacagattgcgtgtaaattgcgatacaaatcttttaacctaattgcgccataatttgacaatgtagtgctaaagtaatgtcacgtcctgataaattcatgctgaaataaaaatcattctctaaaaggaataatagaattaattaaaattcgaaaagaaattgacaaacactaaaatacgtacaagaaaaattcgaatgtggcccagagaatttttgttaaattctccttggtctaaaaggagctctcaaactttacttgaattttcatagcaatggaattatttattaagcaacaacaacaattcagaaagtttattaaaaagaaaactaaaaataatcctcctccctcttttgggccgagtccagcccaaagtccttctctcgtccctctcttttccctttttctcccgggctgcccctcccctcggcccagctccctcctcttctcctcctgggccgcctcggcttcgcacggcccaagccgagccgagcggtgccctcctgccgtgccgcgcacgtgcgcgcgcgctgatcgcgcgcccgaccggtgggtcccacccacccagtcgtctccttcctcccgttcggcatcctctctctcttctctcccgtgaaaacctagtcattccctctctcaaatccgcgcgattcaaaccttggattccaaaatttattgggggaaattaatcccctttccctcctctctctttccccttgattcccccttgattcgtgcttttaatcaccgagaacggacgcatcttccctggccgctttccatggccgccagccgccattcccgcctccgttccgccctctcccgtggccagatccctccccgcgcctatacaatggaatccccatccttcgttctcccgttttagcctcctcccgcgtctccccgtggccaccccgcctctccccgccttctccttctctcactccggcgccggccgacctccagccgcacctcccgccacgaccgtgcgctgtccggttgcggcgtcgccaccctcagcgtcgaaggtgcatcctcttccccagcgtcgcctccgtttcgcggggaaaccaccggagacgcgtcctcgcgggtaaacagtgatgttgccgccactgcaccacctccggcagccccttcccctgtgcccgagcaccgacctacgtcgccgtctcctccgtcgacgtcgctgcatcgtcctctcctccggctgctcctctgtttcgcccggaaaccgctgcaagctgccgcacgtcgcctccacgccatccacgccggagtcccttcggccacccctttctcctcgcctgtgcgacggtcggccgcacctccaccaccttcggcatcacagcggcaaggtcgtccttggcctcgcctcccctcgtcgcctccctgccggtctttgtcatcgtcctctcgtcgttcccagttgcgctcgtcgtcggccctcccttcgtcaagccgtcctcgttcgttgtccgcgtccatcaagtgagccactgcagccccatcatcgtccttgtcctcggctctgcgtcgtcaagccctgcgccggtcgtgtctcgcctccgtctaaggatcgccgccgaagtcgtcccctcgccgttcgtctccgtcaccgccgagctgcctccgccgtgcccgttcgtcgtcgtcgttcccacgcctcgtcgcgtggtggtaaggatccgtcctctcgctgcccccgtcctcgtccttttggtgtcgcccgtgcctgttgtgcggttatcgaccccggtaccgtgtaccggtgtcggtagtcgttcgtgtgtgcgtgtggtgaccgtgttagtgtgcccgcccggtagccgcgtggtttccacgtgtgcagctcccgtggtgtttagtggagtccgtttgtcgaacacttgcctgggttttgacacacgggatccgcttccgtcgatccgtggaccgtctctgtgtactcgatctaccgtggccctttaggttgacatgtggggtccgcatgtcaacggcgcagccttcctgtcttttccaggctagcgcttacacatgttttataattgcaaaacctaattataataatccgtaaatctccatata

SEQ ID NO: 28524 - DNA, 1448 bp, Oryza sativa
tttttatgtattgttattgcttctttatagggtttagctttgcttgtgtgcttcgcgtagctcctgtcgttccggaggttcccaaagcgtggttcgtggtcgtcgccgaaggatcggaaggccgttctctctaagcaaggcaagtcacatcatccttgagcatattgaatcccagtttataaaattattttgatttgaattattgcattactgctttatttaaattcccgcgttatcactgttttatttagcattacctattaattcttgttatagccttatcattgcaattgttattatcaccttgcttaccctaggcaaataaaaccctaactagtgggtactctattcatggttccactagtataaatttaggtagatgcttcgctgattaattaggcaacatttggtggtttcataacttcagactttggaaattctcatatcacttagacactatggaatggttggcttatggtggaattggacgtacacctctcttcctctttcaaaacccctaaaacctattttccggtggggtttgggtgcatgccagttatgggaagtagcaccccagccaatataaggataaagctcgggcctttgttgcaaagcactaccgtactaaccacatgtctaatgggtaaggcttaactcggtgctcagtctagtcctgaacaaaaggacacggatagagatggatgaagtcgttgcgacgatagatatctctgaggcaaatgaaggctacgcgagctgcggctcggtaatcgagatgtctaggcaaatgaaggctacatgggccgatgtccattagtcgagatgccatggcactggactagtatgccggtggtctcacccctatgtgtgtggcgcaaccggtctagatcctgttgctaggggctcaatcctggcctgcctgtctgggataccagccgatacttttgttcacggctaggatgggtaaagggttatgtcacattttttatgatgggttccaattgcaatggaatgcagagtaaaggcgtatcttataggtaaagatgtacacctctgatcagagtataatttattcgaatagccgtgccctcggatatgggcaagcctagcaatgtacccaagttagtggtttaattcttaaaatttgcttaacaactaaaatatggaatggttggcctgggttggcttgggacgagctgggacctaggtcgggttgccagttcggtccgaatcattgtaggccttgggttaaggcaggttcgtgagggttcacggccttgattaataatattgtgtagctctaggatcgtgtttacaaaatagctttgagcaactaagtgtcttttaaatgctctttactgcaaaacccaaccctattattgttactccttgtaccccttgcattaatcatgtatctcccggtgtaacttgctgaatactgtggttgtact

SEQ ID NO: 28525 - DNA, 1120 bp, Oryza sativa
attgggatttaatccccaagaggatcctatgcaaggagggattgagagtggatcccaaccatatcaccctaaccctctggggatgaatttcttcctaccctctaaacctcattccgatacatgtgttctgtatagtctgatcctcttcaaaatgattgtaaagggttagctctataatctttcgacacaagcaaatccctggttttttttttctgacagaaccaatgcgcaataagcatgttatctcatacatatgtcatagaagtcattcttgaacctaaataaaatgtgaatgtatcaagacattcatatagtatatatctgaacgagagaaagtacgtgaagtttggccttgattgcttgctggtgtgtgctgcaggtaagggtatatagcaagaccattatagtcttttcacgtttattgtgcacatttatatgctcatttaagcctatctcaatgcatataatttttattcccaaatttcccttctgctataccggcaaggtttgttctcagagcaaggtttgttccggaggtcgtcggggcaccggcggtgccctaccgccagcgctgcaatcccatccaactcgcactgccacttactagcagcagcaagcccttctcgtggaggtcggttatacgccgctgggttgtctatgactgtgtttagatctaaagtttggatccaaacttcagtacttttccatcacatcaacctatcatacacacataacttttcagtcacatcatctccaatttcaaccaaaatccaaactttggatccatccaaacacagcctatatggtgcatcatcgtggtcaaccgcggcgccatccgccgcgtgcatccgtcatgttcactgtctggcctcgcccatggccgccagcggccatcatcagcacctatggtccgtctgtcctggctacatcaacgacggcgatcgccatcttcgcgctgctgctcacattctacctcttcatgtgcagttcccaggcttgcactatccataacaacttccccatattccattttatcaacatctggtgcctttgtgtcaaatcctgggaatgcatccttcaatgctccagctcaattctcccatgtgcagtaccgacaatt

SEQ ID NO: 28526 - DNA, 15165 bp, Oryza sativa
ctggcagcacttcagatagcttctgaattttagtgtgaagctagagggaccgagtgccatgttgatgcagaccagaaatgtatgaagtagccatcagcaagaacgtcatcaggcatccattcacatcgtctggtaatgtcgggcgatctgcttcacctgcattggtgctcagaaactggtattttcatgtgcatcacagagtgtggttttcacctaggaaagataaacgattctaggctgcaaggcaatggaatgtatggctaatattttcctgatacatcccagtcccacttgatagggatgtgtacaagggcaacggcacaagaaagctttatgaaaaacatgcgttgtaacgagaagtcactgctaaaaaacccttataggaccggctttataggtgccggttatgagcctttttccacatccacggaataaaaaaaataaaaaaccaacacctttaagcatattggtatatataagatttaacagttatgttttataatcagaatgtttcagtacatgtatttgtggccagggtatcacctgttaaatctatacatacctataagcacgtatttatttcgtagaaacgatatgagaacttcactatgcaaatatttacatgtcatgcctatcatgcacttgtatcacctcagtatatattttgctaagttcaataaaagtttccgttatcttaaaaaaatacaaaacttgcaaaccacaaaatggatggatcgggaatttttagttttccccctctgattatatctgtggcgagttctacccttttcattcataactggattattttttatatatctccaagggtcagaacctctctcaaattattgggttcatcaattacacaaaggaagaagacactaactagaacgaaatttacagggatataacaaaaaagtataattagtactgaactatgaccgggacagccgaaatcaaacgaagagaatagaaacacttgtatgtatcatgacaaattagacttgcaaaatttctccacctcttgacggtgcctcttaatagacatacaggacaaaataattcaaaacgaaataattttatcagatattgactggagcgttgtatagctggtttgggaactgcgtggtatagatgggaattttgtgctctgcttgcagtatagttgagcgtagaggtatggaagaaggaagatgaagtatgttcagaaaatcgagccgtctgtgttcggatatgggaagttgggaactaaactcctcgcacggaaaacggagtgatccattagcacgtgattaattaaatatttgctaattttttttcaaaaatagatcaatatgattttttaaacaactttcgtataaaaactttttgtaaaaaatgcaccgtttagtagtttgaaaaacgtgcgcgcggaaaacgagggagaggggttggaaaaatgggattgcaaacacagccggcttgtggtatacttaccaatagccgaacaattgaacacgccggccggccaaacagatcagaatacacagaggaattgaacagtgtatttgaaccatgaaacaaagctgatattgggtaggcacatatcaaaccagaagaatacagacaatatgtgaatatttttccttacttatactaaaaaatcacttggttggggttcgctccaaatagcaaaaaaatggcatgtattgtgctagttcctgtcgcctctcaagcctatagtgtaagagtggcaaatgatggctgttcttcccatggttgtatctgagagagacatatataatacattgacctattaatagttcctgtcatgtgtactgtttgctggcatgggatattccaacattcccaccaagagagtttatattggtggcattatgatgtgtttttgtagatattgtattatatgatgtgcacaaaatggataccaaggagaggtttcttggacaccattaaagaaggcaagcagactcaagctacaaaggttcaggtgataggtgctagcagatataacaaagacaaaaaatacaagagtatgtgttaaatcaacctagacggccaaaatgaaagaaaagacagagagaaatagtgaaataccctccggtgagcggcggcggcctcctcttctcctttttttttttgactggaaatactgccaggacattgcctcgcagtgtgattttataaaagggataaaaaagttatttacaaattacaagagaccgagaaggaaacaaaatgattatactgtttgtaaccagtcaaaaactgtacgtttaaggggatcctttattctgcacatatgcagaagaacatcggccttgaataaagccctccaagaactgaatgagggaagctcatttcgaaagattttctcatttctttgcttccaaatgtgccaagcagcaataaagaaaatatccaaaaaaaacccttctggttgaactgaatgtgggccaaaaccaccatctgaaagaaattgagaccagagttccacacaattcccaaatactgccagcactgctgactgaaggggaagaagaacaaaagatgctctcttgtctctctgatattattcagccataactcacaagtgagatcatcattctcctttgcacagtgccgtcgatcaagcatatcacttgtgttgagtctatctctaaacaagagccaagcaaaaacttttatcttcattacacatcttgttttccagatccaaacaaaaggtcttggcacttgcacatttgagaaagtgagcttataaaacctcttggttgtgtacttgtcagagttccagatgaaagaccaatcatcacccttgtcattctgcaaagagagagaggacaattcctcctctagaatgatgaattctccataggcttgggtgttcagaggcagcaaaaagcaatcctcaagaggaatagagcacatttgattaacagagagggatctatccaaagcaaccatacacaaagctgggaatgcagtgcacctaatcttgtcattccaaaaatcatcccagaaaagagctgaggatcctgtcctgatgaagcgttttgaaattcccctgaagatatcagacagagccactatatctctccaccaaaaagagactttattccaaactaaatggggcactttggagtcataataagaattccagatcagttgaacccatggcagatcctgccctttgtaaaatttgaccaggtgtttaagcagaagtgttgtgttttgaattcttaagactcctaggccacctttttcctttggtctacacaccaaatcccaagaagcaagagatcttctagttgagtttgggttgtttcccctccagagacagtttttccttgcagtatcaatagctttaaccactgaaacaggcaactacaaagaacacatataatatgttgggattgaggaaatcacagagttgatcaaagtgagtttgcctccatgtggcaaaaattgtgggctagctgtcaatcttctctcaaccctgtctaccaatggtgcaaagtccactacccatggtctagttgtccccataggcaaacccaggtaagtaaaaggcattgtacctatgatacactcaagtataccagcaaaaagctcagcattctcatgagacagattgattgggtagaaataggacttatggtaattaattttgaggccagtagaatgtgcaaaagagttcaacaaagccttaaaacaaaaaacctctctctgtgatgctttgaggagaataaagtgtcatctgcatactagattacttggaaacccctttcatcaagttcattaattggcttgaacaacaaacctagggagcaagctttgttaactattctctgtagtaattcagcacaagaacaaagagcaagggtgaaagtgtatctccttgcctaacccctctcatgcatttaaaagaatttctaggtaccccattgagcagaactgaagaatgtgccgaagaaaaaatcatctgtacccactgcagccacttatcatgaaaacccatacttttcataatggatatcaaggcagagtgctctatagaatcaaaagccttttcaaagtcaagctttaacaagattatttctctctttgactgttgacattgatgcatatactcaaaagaccatgctaaacaatcttgaattggtttgcccttaatgaagccatattgattctcatgaaccagcttaggcattacactctgcaacctatctgccatcaatttggttaatacctttaaactgatacctatcagtgagattggcctataatcattaactgtttctggagaggacttttttggcactaaggttatgaaggatttgtttatcagctatagatcagtataacaagcatggaagtgtgctgctaacctgtaaaagtcatgtgatatgatgggctaaccttagtgtgcctcctcttctccttgatggccagatctagcaggtgtggctggagggtgacgacagtggagaggacgatcgagaatgttgttgatgttgagcctggtttgtttgtgctggtcataccttgaaagtgcaataaatggctgaaggattgtgatctttgatgtggttctggtgttgttgatgagttgttgaataagtgtaaatagcctattcttgatttgtgatgtagttgttctcatctttgacatattgatatgaatattattgtgttcttgttcctggtctataaatgtggatggggaattggggcgggagcaaatatggatgaggaatttggtgccgtgggtgtgaatattgcgggcagcttgacgcatttgttcgatgaaattgagctggcctttttttatttttggttcgtaggaacactttttttttttatgattggggattaatcaagaggacctatattgagcacactaaaaggctggtggcacattagcatcctcgcatgaaccggtatataagcattatgaattgtaattcgaagattaggcatcaattaaacaaaagtttttttttcaggcgtgttcagaatctcgttgctggatggtgaggagccctcttccatatgcttgagggcagcggcgattgcatctgccatcccctaagcaaccatccctttttcccacttgctgctgaagcaccaccaacacctggctggtgacaatgtacatagaggaaattatctgttacgtgatttttttttaacgattcacaccaaacagcgcgaagatttattgaatagagaaggagaaaaattacaaggttagagccttgggaggcaatagctaggaaagaagaaaaaaatatccatcacccacgcactgacagcacctaaacacagccttagagaaggctagcaccggaccaaccgccgctagtctaacaaaggaactacaaccgagatgacccaaaaaccaaccctaacattggaaaccctaggggtgaaaacggatcggataatatcccatccgatccgatctactctgaatccttccgaaacaaggatatggtatgggcttatccgatacggatacggatgcggatgcggattatctgacagttttgtcggattatccgataagaagtttgtcggataatccgaaattatcaacatatataaccactctatctattgcatataacataagttggtacatccaatgccctaattcatcaactatcatagaatttttagtctaaggcttttattgtctcatgtcacactcaagtagctatattttttatattatgggcatcaatcatgtattcatattctttagcacttaatcatataattattacgattggtcatttattgagtattgtattattgttccatggattgttaactcgatgtcgcattgattgcatatacatgtaacatccgataaatttaatccatttctaaaccgattccgcaccgactccgaaccatttccgacatccgaaacaatccgctccgcatccgtacactatcctcacctgctctgaattcgcttaaaaaatattgtttaggatatgttatgaccactatccgtccgaatccgttccattttcactcctaggaaacccgaacacctctagccacatctttgggattgagggagagagggtaagagaaaagatggaaccactctccccctaggccctctgacatggcccacttgcacaagctagaacgccgacacgagaggacatgacatctcgagtgagcttgcactatatgcttgggaggttttgacaagaggattgccaagacgacatctccagggagaggagcaacgaaggactggccgccgctatccgtcaaggtctcaaagagaaccaagagtgggttttcacccggcagtcccactagaggaaaaggggatgacatgacaatgtcctcgagagggaaaatgatgctcgaaaacgccgccattgccggcccagccaagaccatattaggttttcacccgtttcctgctacctgctaatccacagttgatgctccaatgctccaccaccatctaaccttcgttgacgcgtgggcactactgcaccggcgtcccctaccagcacgccgagctggcctctatcactgccggtcacgcctccgctgctcgtagcaccgccagactcacaccgcctcaactccaccactgccaagtccagggactcccacacctaggctagccgcattggcctccgctaccgccggccgcacctcctcatgccacgccgccaccgctccgccccaatgtagccgccgtcagttcgctgcaccggctgtgcttcggtcagatacggccgaaggtggcccgtggggccagctccggtaatggctgtcgcctcctcgccaagagggcttgctgccaccactccctgtcacgggtgctgcctcccagcaagatcagcatccgccacagcaagatgaccaccatcgccaatcctgtcgttgtcatggccaacccctgctgccgtcgtcacttcgccctccacaacacctcaccggtgccactcacgggccaccggatctggccatgggcgccaaatccagcagccgccatagtcaaactgatgtcgcccgagctccataccaccacccaccacagcagccgggtcgcgccgctgcccaccggcctctcgccggagggacagctctagtgcaccggtgtccccgctgttgcatccttcgggtgagagagagcctcgccgccgccgtccttgcagacgcatggcttgccggtgggtcgctcaggcggcagcgaggtggagggtggagggagagcgtggtgacggcggtgggttttggggcgccgtccgtgtcgcccagggacgggagcgcacagaagggagcggagtcaaaccatctaagttattccctgttgcgtgattgactgctcctgattttgcttcacggtgtcctagtgataacttttggtacacatcatagcagataactttctgatgctcctctcaaacatatagtgcacacactaatatttggttacaacttttgctccttctccatgattctactagcaaacaatctttgttcttcgtcatgattctaccagcaaactggcttgtttcttcttgacatactacttcctttcattgtgtgatttttgacaccacagtcaccataattaacaggccgaccaccctatcagtatctcactggtcctttaattttcaatttttagtgaccacatgactagcttttgtggttgttgcactcggtccaatgcatggctgttagttcacatccattctatttgcatgtcttccataggccgtgtttagttacatgtaaaacaaaattgatgtatacagacacacatttaaagtattaaatgtagactaataacaaaaagattctgcctgtaaaaagcgaaacgaatctattaagcctaattaatctgtcattagtaaatgtttactgtagtaacacattgtcaaatcatggtgtaattaggctcaaaagattcgttttgtaatttacatgcaaactatgcaattgtttttttcatccacatttaatactccatgtatgtgtacaaacatttgatgtgatggaatttttggaagtttgaagggaactaaacacggccatagtttcaaattttctttcagacctgtgggatcaggatggcatcgatcataggagatctaaatgatcgttttcttttttcaaaacaagagaacaaacacgcagaaaaaatgaaaacaaatgacattgaaaatcgttctaatatgcacatcaaggatgcaagcaggctgctacactaccgcaatagtctgtgctatagtatagtatcatgaacagtaaagtcagcaaaccatttcaaacaacaatcattagaacttctgttagcgcactcaacaagacacaagaacacacacaagaattggcaatctcctctccaatatattctcaaatccaacaggattgagccaccgccaccatcgccaccaattgccaagatcgactctgttcttgagtttcttcagttatatacagttaagtctctctctcacccactcctctcttgccagctgtgacagcaacacaacagctacacgcaactattacatggcccaatctggcccagtatacaatgggttcttctttcttgcgcgtcttggatatatccggcccactcttgtatcagcatctccttcttcttcagtgaactgttcaccgtcatcgacaatgcttggcttcgtcatcccttcaggttcactgacaatcccctttccttgacaattggcttgtccccaagccaatgcagcagggaaccttgtttataaatcctccaagtcctcccaggttgcttcatctggcaccgaatgagaccattgaaccaaaacttgatggactggagaattacctttcatgtaagtacaggaatccaggagacgagctgggaattgcaggtcttggttagggccaggcaggtcggacaacactggtggttggaaatccttagcacccttgagctgagaaacatggaatacaggatgtatagtactggatttaggaagctgcaacctgtaagccactgaacccaacttctcgaaaacatgaaaggtccaaaatacttaaatgacagtttatgattcgccctgggagctactaaagattggacatatggttgtaacttgaggtagacccaatcacccactgcaaaagaccgaaaacttctcttcttgtctgccatgtgtttcatcttttgctgtgctctattgagatgttgtttgataagagcttgcatgagatttctttccttgagccatacagccaggtcaggtatagcgcaatcagctgaactgatgccgaaatgtctaggaggatgaccatacaaaacatcaaaaggtgatgatgacagggaagaatgataactagttttataccagaattctgccaaatgaagccaagaaaaccacttagtaggagtagcatgaacaaaacttttgagatagatttccaaacattggttaactctttcagtttgcccatctgattgtgggtgataggctgtgctcatgtgcaattgtgttccagctcccttgaatagctgctcccataactggctagtgaaaactctatccctatctgaaataatggtctgaggcaagccatgtaacttgtagacattgaccatgaatagctttgctacatcaattgcagtatagggatgagatagaggaaggaaatgggcatacttggaaaatttgtccacaatgaccagaatacaatcatatctgaaggatcgaggaagtccttcaatgaagtccatggaaatgatttgccatgccccttctggcacaggtaaaggttgcaatagtcctgggtaccgatttctatcaggtttagcttgtagacagatttgacactgatgcacaaaatcttttgccatcttcttcattcctaaccaggcaaacaatcttttaagttttctgtatgtcactggaaaacctgaatgcccacccataggactagagtgcatctcttgcagcaacttgagttgtaactcaggattgtgtccaatccatattcttcccttatatttaattaaaccatcatgcaaggagtactgaggactagattcaggattaatagccagagctgttatcaattttgttgagtactcatctccttcatatccttttatgacatcttgtatccatagtggagtacaactggaaatcagggctaattcaccatcttcttgatatttcctggagagtgcatcagctgctgcattactagtcccctttctatagtagatcttataattgagacccaatagcttagtaaatgccttatgttgccagggtgtatgaagtcactgatctgataaatgcataagactatgatggtctgtcaatatgatgaattcccttaattgaaaataagatctccagtggtgcacagcaagaaggatagccatgcactctttctcatatgtggataaaccccttgttcttggacccaatgctttactgacataagccagaggatggctgttttgtgacaatactggcccaatacctgattcagatgcatctgtttcaactatgaatggttcattgaaatttggtagggctaggactggtgctgtcactagtgcctgtttgagtttctggaatgctgcatcagtgtcggcagtccactggtatggtacccctttccttagtaactgagttaatggtttgctaataatgccaaaaccttgcacaaatttcctgtaatacccagccaaacccaaaaatccccttagcttcttaggagtggatggtactgcctagtttaagacttcctgtaccttgtctggatcagttgataccccagcagcactgattacatgccccaaataagttaactgttgttgtgcaaagtagcactttgataatttcaccttccaattgtgttccctgagcagtgaaaggacttgatctatatgtgacagatgagtttctaggtctgggctatagatgagaatgtcatcaaaaaatacaagtgcaaattttcttagtactaatttcaatgtatcattcatagcaccttggaaagtagctagggctccagttaacccaaaggacatcaccttatactcataatgccctgtatgagtctgaaatgcagtcttgtattcttcaccagccttcattcttatttggtgatagcctgcccttaaatttagctttgtgaaccattttgcaccagctaactcatcaagagttcatctatcactggcattggataagatccctttactgtgatagcattaagctgtctgtagtcaatgaccaatctccaagtaccatccttcttcctaaccaaaagagctggtgatgaaaatgcactttggcttggttgaataactcctgtttgaagcatctcctggatttgagcttcaatctcatccttaagtgcaggattgaacctgtaaggtctcaaattaacaggtttagaaccaggaattaaaggaatactatgatcacagtatctctgtggtggcagtccttttggttcctcaaatacatccttaaacttttgcagcagtggtaaaatgagctcagaagtgggtactatctgttcttcttcattcatgaatagttgtaccatgtacatgagggctccttccttagccatgcctaagcattgatgtaatgaaactagttgacagtgattagtttgggagacaataccttggagcttgatagactgatcatttgattggaattccatccatttgtgaacccaatcaatgtgcattggactgaatttctccaaccagtccatacccaatattacatcataagtacccaggggcaacagtctgaagttacttttgaaagtataaccttgcatccacaggattagacaactgagttactcctgataactgtaatccaacttgggtgtccaggaaggagtgagtactgccagagtccactaacatgagtaattttgttccctgaattcttccccttaatctgagagagttagctgattcagtgcccaacaatgcctgttgtgatattgccattagagttcccttttcaggttcagttgcaacctgctaatcttcctgcacagttactagttcagagtcatcatggatagcttccaacaattcttgcacaaaatgtatctgaactgaagtggcacatttatgatcccttccccatctttcaccacaaacaaagcagagacccttagattttctataggccttaagagctgaaattctctcttcctttgccttgttggcatcactgttcctcctgtcttcaggtgaataagatgttccagttctaggggtattaggagcagagacaggattgttaattctagtaacatgtttatagcctgggttaacttccactctacggatgccacttggtttagtaccaacaagagcttcctcctgtaacaatgctattgcacaagcagagtccatatctgaaggtctctgaactaaaaccacacccctgatttcatccttgagtccctcaacaaaacttgtcacaaagtaaacaggtttcagagtgccatcataagcaataagctggtgcatcaaactgtcaaacttctctacatactcttctacagtaccagtttgctgcacatggaaccactggcgaattaggccttcctgtctgtctctagtgaatcgtgaacagactaaatcacacaaagtgagccaagagattcctgtgatttgtgatctaatggattgtaactagaaagctgcatttccttcaaaatttagagtggctaccttaacccagtgctgcgaaggaataccataaacatcaaaatactgctcacagtcacacttccacatttggggattttcaccatcaaattttgggcaggtcatcgggggcaaacagctactcagatcaaatgtgctggtgtgtggcattttggcggaattcaaatcgagatgagatggatgagtaaaagatggatccctcttaccaaccaaccaggaggtgtcttgacttggtgacccctggagcggaattcctgatggaatttcttcatacttcttcgtgatactgctctccaacagatcaaccttcttgttgagatcttggaacgtaccccccaattcatccaccttcttctccaccagtgggatgcgtacctctaggttcttcttgagttccatcagatctgcacgcgagcgctcctcggcttccaccctccgcttctcattctcctcaatcgtcttgagcaagaggtcgagcttgccgtcttgcgccatcagctgcgccgcttgtttggtgatgtagcgcggccgctccagatagcagggcgctccagattagcttactcctcacactccactctgatccgattaacccgaagaaggcaagttgctttttcgcggggtcgattccgaagaactaaccccaatccttctctggattttgcaatcagatcagagattccaggagcgagagcgctctgataccagaattgttagcgcactcaacaagaacacaagaacacacacaagaattggcaatctcctctcccatatattctcaaatccaacaggattgagccaccgccgccatcgccaccaattgccaagatcgactctgttcttgagtttcttcagttatatacagttaagtctctctctctctcacccactcctctcttgccagctgtgacagcaacacaacagctacacgcaactattacatggcccaatctggcccaatatacaatgggttcttctttcttgcgcgtcttgaatagacccggcccactcttgtatcagcatctcctccttcttcagtgaactatttaccgtcatcgacaatgcttggcttcgtcatcccttcaggttcactgacaacttcccaatttcaaatccctgtgatgtgcaccttgaaacagaggttctagatgtagccccgattttttttccaagaaacacgaaaagtaacggatgaaattgttggaatctaacgaaatttcaatgtgacatgcacttaatttttttaaaaaataaactaacctgtagaactgcaaaaaacttcaatctgatcgttggatcaaaatctaaagagtaaattttagaaaagcccaagttttatggtcagaattgcagaaaaccacatgcttaaagcttcacaaaaccccacccttatgcaatttgagcatgaaattacttaaattttgaaatattttaattgttaaatcactaagattgatagtgtaatccattactaccttaaaaattttgtttgagatatgctgaaatttatcaagatttcaattaaggtggggttttatgaaacactgagaccataaaatatgtggttatgtgccacacgttataatatcaattttttcctcaactttgaccaaaaacccggtgttttttgaaatttacttaaatctgaaagcaatataacatcattgaaaaaaatgccaaaactcatttggtatgaagacagaattgagaaatggaattgaggatgaatttgctaaacttcatgaatcaaatcatgttccaaaagtgcattgcatacaaatgcaccgtatctctcactggcttgttccccctcaaaccctaaaaagaacgatctttttgctcttttctttcccattgtttatatctcctatctctctgccttttatacaatagagtacatctctacacaatactcaagatatgatacgagagagatggacttggatgagttgcagtcgtagtactgtctgtaacttatgcaatcatagcagctaccatttgatctgaatcggacggcacagattagtcaaagcactgtaccaaaagtgctatagaataaaatattacaatggttgatactgtagatgtcaatctggaccgttaataatcaaaaggaacggctgaaaatacatgcagtcctaagtctgatctcaatccgagagggagctaatctcaatttgagagggatggtataaaattagtacattgaattattggtgtatgtattgaggaagttggttctagtaatattttgtggattccgtaagaccttgttggttaatctctctaagggagggattggaggggatttaccacacctattgtggtgtggaattattccccctcaataccctctaaaccgaacaatgtctaaaggattattggtgtatgtattgaggaag

SEQ ID NO: 28527 - DNA, 1966 bp, Oryza sativa
atatatgtctagattcattaacatcaatataaatgtgggaaatgctagaatgacttacattgtgaaacggagggagtacgtaactacgtacatctacctaacgtaacgtatggatggcagcggtggggtgtgggtctttctcttttttttctttaagtaaatccgagggtagaaaatatgggtgcaccggatattagtgaaaatcgatggctagatgttttttttttctataatttgctagagtgacacatggtgagatgtgagtgtttgtagaatgccatataacggtttgagaacattttaaggatgtttaatagccttttagtatataatagattatcaaaaactaactattatatatcagccccatgtgtcgtgatatatttaagaccacaatataacttataatttaattaaagaaaaacaacggaatcacaaattagatatataatttaaaaataatttagaagatggttcaaggaacattgattggatattttatattattattatagatcttagtttaactatatatatttatatttgtgatgtaatatattttagaaaattatattttatttaaagatcatcgatttttatgatgtatttttttgtcgtcttttttatgtatatgcgtatggttttttcttttctttccagcgaatagtacgtaaactattgttttgtttttgtgcacataagtacgtacaggagaagacatcgtataaacctgtacatacatgacaacagtagtagctcttaaatcatatacagagaaagttgaaattttttaataatagatataatccaatggtataaaataacgggtccaccaatttaagtgaaaatcgacggtgagatttgataatgccaagtggcagcctatgagcgtttgtagcatgccatgtgacggtttaggagcgtttgtaggaagtttaattgacttttagtatataatagataatagataatagatagatagatagatttaaaatatggttttgagaacattgattggatatttatatagatcattatttaactaaatatatttatatttgtgaagtaatatattttatctaaaatcatatttttaaaaccatcgatttttatggaagtatgttttttctgtctttttttttcatgtgtacgtttttttttgggttcgagcaagattaggaaagataatgtacattacgtttgtacgtatggaaagatcagcagtagtatcgtacaaacacatacgtacagatcatgaggaggttattattttttaataatagatctaatctaatggtgtagactaacgggaccaccaatttaagtgaaaatcaacggtgagattagatagtgccatgtggcgacttaggagcgtttgtagagcgccacgtggcggtttaggagcgttcgtaggaagtttaatggacttttagtatataatagatagatagatagaagatttgtactatttatttaattagtttatttgtaccctcgaataattatcacaagtcattcagttattcattcattcagcactgaccctactatcttaggcaatcaacaagaattgattggactccaccaacattaaaatagttgttgatggaaccagcagaaacttgcatcaacaaagcttacaaaccataaaaaaaattggatgaattcagagttttgcccacagcttttggcatcaatgtaacttccaatcctttggcaagatttttattggataataacgctggtgaaattagtccattagtgtcatcagcatgcttaacaagaacttgcccactatgtccaaaactgctcgagaggcagccaccaagatggttccgtgacggatattccaagatgacaaatggaatttcatcacgatttgcaataaaatggagtgaaatccactcatgaattcagaaggatttaggctttttttactagcagaatgatgacagcttctctgcat

SEQ ID NO: 28528 - DNA, 1785 bp, Oryza sativa
ctttggagaagaagtcctaggtggagtcctggcttataccccagttgagcgcctgtgaagatggagccataggcccgctaatccgctactgtttatttttgattgttaggcctgaagtgcctttgtaataatgtaaatattatcgatataataaagatgtgtcttttgtatcatgtttgtgtggtgtaccccggcttttcctgggacggggaataatacactagcgttctggaaaaagacaatttttccgggtgcgacaagtaaacatttgctaatgacggattaattaggcttaaaacatttgctaatgatttgacaatgtggtgctaaagcctcgtacctagaaactaggacaagaacttccactgctctgaggatttaatacacagttaacaagttgctgtaaccccaagttacttttcttttttctcaaaatggcagtcaaattcgtgaaaaatgttcttatttcaggaagagaggaagaccactcctgtttctgttacctggaaggttaggagtaaacgttcttacagccagccaaataacataaaatcgcaattttcactccctttctgtgacaccatcccatcacatggagttaaatagacctctaagcagtttgagagaacaaaatgcaaaccagaataactgtttaactaatgacagcttcaacatattcggactcaaaatgagacagctccaggtgataaaaaaaaataaaactaatttggttactctcaaaaacttcaggcatgacatccccttccactttttttttcctacattgaatccttctttccatggttcatcttccacatgttttggctgctgcaccggctactgatgtctttgtgaaatatggtaaactaacagaaacatgctaataaaaactagcatgatctgttcaaagggttgtatgggagtctatgctctgctaacatacaagccgatgcagcatacgttattatatcctgtctcctcccaagcctaacccttctctgcaagaaatcaaccactataagccagcaaagacacactagctagacaaactatattaaaacttttttttttcattctgtgctgaagcataggtgtaaccttgtagttcgcttgcaccaattcaggggatgcaacaatggccgccaacattatttaaagaagagtctgttgggccctcttcctgcaacagtttatttggtacagtacaaattgttgtgtggcagaagtgtctcgtttgttaggatgaattggtgctcctctgttttcttaatgattattttcatgtacttcacaaatcctgagtattgtctgtatgttcaaattaatgacatcgtcactattacttccattatttacatatgttatcgagtttgtgccgcatgcaatctcggttgaattctatgtagtttgcgctattttgatacaaggtgtcggagaagtgggaaccagggttaccgttcctctactgcctggggcatgatggaggttaatgcggccatctgttggcccatctatcctgagatggttgttagctgcccacaatggcgtaactaatcaaggccacccctgctcctgtttggtgccctgaggtcaacaccagcacatgacttatttttcatttagccaaacaggacgagactccgagcaagagtcccaaatcttatacctatcaaagcagttaccctgtgtaagtgtgggctggtgtacgacgggacgatgtcgcccttttttcttggaccgccatcatgagtcttggaaaggcgggcgacatggctggttgactgg

SEQ ID NO: 28529 - DNA, 2482 bp, Oryza sativa
taacagtgggacctgcatataagtagctgacatttgtaatatctctttgtagctataaaaagaggaccaagaccacatggaaaaggggttggattctttgaaggcggactacaacatcaagaagcaccgttgctgactaaaacattcagaagcacccttattgacaacaacatcgagaaagagtccatattgttagtctctcctggaaatcatgagagtagtaaccagaaccaagagagaacacatccacaccttgtaatcctcgataatctcagatatagtcaagaacaaaacagcagggtgttatgcttcctcatggcccgaacgtatttacatcatttggctttttgcatttatcgtattttctgaaaacggacctcgaacacccgcaccctagccaaatctctaggggaaggggctccttatttccccgcttaaggacctcgggctctgacacatggtgagagagaagattttcttgacttcaattccaccacatctcacatatccaagcataaactttggtttgtttggatgaggattcattttttttaacgaaagataagaatttgtgtgttcgtcaaaagaaatgtaggatgtaataaggaaatgatttgtcacttgccaaacaaaatgttgtactcctgattttctccttaaaatcaattggttgcacgataaaagccatgttgagctggacgctaaacatttaacgttactaagatctccactaacgctcgcacattcagcaaattaatttagcattgactactattacaagtttataacgaggcgttagctagacactaatagggcgggctcacactattagtatttttagtaagatggctagtacttgcttaaatccacacacatgtgatatcacgggagagaacaacttttcattgttcttttaatctcttttagaagaaatcttctctcaaatatttatttttttcttcttgaaatgaggaatatatgtcgttattcaatacatcagtctcgacttaaaaagttaatcccttctattctgaccaaacgtacagaactaattcttgcacatgcactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttaccaaccaggactaaagatcatctttagtcccggttcgaatgctgtcaggacctgtcaggcccccccgggaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaattggaggtgcctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtgtgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaagaaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttatt

SEQ ID NO: 28530 - DNA, 3710 bp, Oryza sativa
atcctatatcgcggtgaggagtatgagaacctagaagcatgccctgtttgcaaagcactacgatacaagattagacgggacgatccaggagaagttgacgggcagctaataaagaagagaattctgctaaggtgatgtggtatttccctataataccacggctaaggcgtttgttcaggaacaaggggaatgctagaatgttgcgatggcacgccgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgagacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacaatgtttgctatggttaaagatcttaaagtagtgttcggaaaggggcctggaagccagcatatagagagcgaagatggtcacgtggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagtatatgaaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgagcagcacttggctctagttcgcgctaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacaagagcccaagacatgaagagcacgaaccaaaatagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtgacaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattagaatttttattaattatatttgcttattacgatttatccacttaatttattacagccaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttgttgagaacaaccggaagtgatatagtcccggttgttgagaacaaccgggagtaaagatccaggggtatatatattcccggtgcgccctcgtcttcttcaccaacacttaaac

SEQ ID NO: 28531 - DNA, 1487 bp, Oryza sativa
tgccgcgacaacgtgaacgagaacgagaacgatcgaacgaacgagagtgagaacgagaacgatcgaacgaagacaagcgagaacgagggaacgaacgtgaatgagaacaagcgaacgaacgtgaatgagaatgagcgaacgaacgtgaacgagctagggaacgtgaacgagcgaacgaacgaggatgatcgttaacgtgaaatgcaatatatatatatatatgtatatatatatatatatgtatatatatatatatatatatatatgttacttcgcatttatcctaatacatttttttgtatcttgcagaaaagacgtgttgtcggagtcgtccgtcaagcctgagtggaagagctagccctagaacgaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtaccccggccgaagccgccaagaactatgtacgtcacagcggttgggttgtgcgggataacgtgcctgtcagtacggtgtactggcgaagaacaagggcacgcggag

SEQ ID NO: 28532 - DNA, 4032 bp, Oryza sativa
gagcttcaagggagatctgtaccagaagtatatactgaaggggcagacaccgaacttcgacacattcccaaagctaagggatcactgggacagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagtcctggtactatgctcacggtggaacgctcaacccagctgatggctcactggtcttcggctatcagatacaagaggctgcgcgacgactaacagatgcagtggaagcctcctctcagggcacgttccaaccagacagagatagggacgagctgacactcgccctgcagactccagagcatccaggatgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggctgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctgcaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccaccgcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtcccttagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggtttttgatactggattcatcgaccctcggaaagtaaacgtcgcaatgctcgaccaatatccacaagaaacagaggacaatctcgtccatctcctaaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaagtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctatgagtacacatgctctacatttatatttctccgattcaaatacatacaagtgtatattaattagatctctcgttgtttgtcatttatttgtagtgcgcaaagcaaaagcagggaactaacttatgcggctattacgtgtgcgagtattgccactgccttgcagaccaaatcatcaccacaagagagctcgatgtatgtacaaataaattcaaaatttcattacgtagcgatttcttgtttaattactaatcaattttatacattcatattgtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataatatatatatgtataaatacatatatattatgcatgtatatacatataatataatataatatatatatatacatatatatatgtatgcatatatatgtattgaaacatatatatgcatggtttatatatatatatatatatataaaccatgcagcaacaggggcatgaaaaaaaaaaaggtcagctcgatctttagtcccggttggtgttaccaaccgggactaaagatcgatctttactcccggttatttcacccgggactaaagatagcgatctttagtcccgaattggtactcccggtttagaaaccgggactaaaggggggttacgaaccgggactacaaagggtttctccaccagtgatgcatggtagccgtgtatcctatcttcatgtccattaattatctagaaccataatagcttctttgcatggacagtcgaacacaatgacatatattaagaaaatgaaagcatccggcttctgtgtaactagtagttcctctaccggcgtacgtgctttgtctgtagttcttgaataaatggaaattaaagaagaccacttgtgcttgatagtactactgttggtgtgtaaggggctgggataagcacgatgaaccctaaaaaaaaaaaagagagaaattacagaataaaatgcaaacctcatatcagcacggtaaaaaaaaaggaaaaacatgttaaacactgacgagtatgaacacacgaaaaagaatatgatgtgaataatacctg

SEQ ID NO: 28533 - DNA, 23167 bp, Oryza sativa
  unsure (1)..(23167): unsure at all n locations
atggttattattttagctaatgaaattaacttctagccttttcttctaattagagatgcatacatccattacacaaaaaatgttaaaaacgaaagtggcaaaaagaaaaatacatgaaaagttggcctagaaataaaaccaccttctgttgccgaatcataaccacttacgagaacctattgagtacgacatacagacaacaatgagttggtgaagcaatagtcgtagcaacaccctctagaaaggatgcaactcgcatcaccgtcaccaaatccaaccaatcaatgatatatcaaaagggtttcaagttggattgcaagcaaagtttctccatgacaacgctttcgggaagaaaatatttcctaggtcattaccattcctagtttcctacattgaaccggttaaggtcagatgtactcgctttccaggagtacgcattagcataaatccattatcgttagcgcattgattgatctatctggatatctatatcaggtatagttggctgctacaaagtagtccatgcatgcctcactacttttttttttgaggggggcactactatagaaatgcacaaagatgacggcactataggtgccgcaagtgttaaaattggcatctatcgatcttttcccacctccacaggctgaaaatatatttaaccggcacctttatgcaactataggtgtcggttctaaataaaaccgatacagatactatatatgccttttttttaaaaaaaataaactttaatatattatagttatcggttaaaacatatcataggtaccggttttttaaaaaattgacacccataaaaattgagccggatctcccctttttaatgcaaagggagatggagcttatccactcgcccctctctctctagccctacttccctcctcctatcctctccacggcttcctcctcctcatctctccactggccaagagatggtgacaacaggcgaagctgcgtcaggcgcaacgttgactcccacagcagatccagtgtcggcggcatcggtggcgggcgggttggcgccagcgatggatcttgcggcggatccggtggctacggtggctggtggggtggcgtcagctacagatcctacgacggatcaggaggcaacggtgtcagcattgggcagggcaggttcggaggcgactctgacggtgggctgtttgggttacatgaattggggatttttttttggatcaatttgtgctatgtggaattgtgttttgtgatttgtgttatttgtgcagtcttggtagatggatccatgatggtttgtgctgttttggggatgtttttggatctatggtggtgtgggtgtaatgaggagcggctcgatgtatcggcttagactgtattattgcagaactttgaccacgagaaaatggtgttagaaaaataacgtccgcttgatctactattgacatccccatctcttattgttgagaaattctagatctgtgtgaaaaaaaatgttctgtgcttaattgatgaaactatttcatgtagttggcctgttactaatcctttgtattactaaacgttcatcaattttatatcactactacaaaaacgtaaataggtgtcgccaccataggtgccggcacaccaaaaaccggcacctataatgcctttcccgcctatgcacccacccccacgcaccatatattcaaaaactggcacctttatgtctaaatatgtgccggtttttaaataaaaccgacacctaaaacctgtgttagagaaaggtgccggttctaaacctaaaactggcacctttaatcttctccctcccacactagtcgttggcgggccccacacataggtgccggttttaaggcaaaggtgccagttctcaacccaaaaccggcacctttatttcaatagtatttttcatgtccgatggtgggagtgccggtttttgtatgaagtgtcggtttcttttatagaaccggcacctatttacttaaaactgttatccattcactctctcccccttatccgttcactctccctctctctctctctcggcgcggcggcagcggcgcgtccccctcgcagcctgcccccctctcctcctcctcctcctcgtggcgccctccaagtcgtcgtcggctgtggcggcggcggcggccaaggtgcgggaggagggagaggtctcctcctgcgccgacgacgacgatgtgaggagggctcccgacggcgacgacggtgacgaggtgaggagggagaggtctcatccggcagcagcagcagtgaggagggctcgatggcgtccagcggcgaggaggtgtgcagcggtggtgtggtgcggcggcgctaggcagtgctaggcggcgaggaggaggcgagcggcggcggcagatccatcccacggtacccccattctcttatttctaatcgattgaattagtgcaaatagaagcacgtcctcaagaacaacacccattcatcagtaattagggagtactaatcctagttctagggacagttaactacaagtactccattcagcacatgaggcctctcctccattcagcacgtcctcactcgctgcctgcctgcctcctcaatctgtcatagttgcagcggactcctccgcatcccagacgtgtatctactactgaatttgtttttttttgtttttactttccgattgaaatcagttctatgaatgctctgaagttttcaatttcacaacatggtcgatgcacttcattatatctgaaatgagttaggaacttgctatcaaccccttgtttatggctgtaaaatttgcaaaagataatacttttggctggtaagtacaagtatttggtgatgtatatccttgctcattttcttaatctgcaaacgaaccaagtagatttgtttgatgtatatacttgataactttcttaagttacaaaaggagccaaactagctatgtcgttttatggctgtaaatgccatttttggttttgcttccatgatgagcaggtctagtcagtagaatttgtctgtgtatatctctaaccactttagttgtttgtgaatctatctatagtttggtggatgtgaattatctgcttggctgtgaatgccaagttgttcgttaaaatagcattctgaactcagaacaactctgaactagttgtgcactcccttgatttttagtttgtcgtacagaggtttttgttagtgcatgtgatatgtagagctattcctgaactaagatgtttagagattaattgtacataacacaaatctttgataattctgttctgttgcgtttctttggtttagaaactgtggatttcttgctctgtcctgcaaaaggaccacatttattttctccttcaatctggagcatcaccttatcctttccaggatgaccttcatagtatgatagggacgccgagttttgcaatcaacagtactatgcattttactgacaaatactcaaaagtactttacttcatttctaacaatgtactcaattagtgggagtatgtgatttttggcacgctggttttgcgcagagagcgggcgcgtgttcgccgcgggcctcaacgactttgggcagctcgggataggctcctccgtgactcatccgctggtactgcttcttgtgcatcatgcctccatgtgaaattttcatctacattgtgagtcagcctacttttgcacaggaggcaaaagctggctggacatatatcagaattgcaattttcactcctgtaaagtttcttttgtgtgcaaatcattttccagtgcaactgcaggttccaatttttgtaggtgtcatgtagatgattctcatatatgttcttctcaatatgaattttcttgttcctgttcgatgtctgctctaatttttgatgaacaacgatgtctgaatctgaatatttaaactaggcatattttgagttaggatatatatgcaaatgtttaggatttaaagataggaatttttgaacttacgaatttttagacttaccgaattttaacttaggcttgtatgtttttatttgttgagaatgtgaatgtgaatgaatgtcttgtatggatgtggggctgtagggatgaaatggggtttgtagagaattggggttgtatggatgaatttactgcattttttattttttttgtcccaacaaataggtgccggattttaggttagaaccggcacctattaggaccatatagggccggttttaacctaaaaaccggcacctatttgacagccacagggctctttggcttagaaccggcacctccgcatcttattaccagtatcatcagtgcagcctcctttgtgctggttcggaaaaccggcacctattagcgtttctgaaccgacacctattaccctttctgtagtagtgtataaatccagttggattgagaagccaagtccaatcaaaatgaatagctcatcaattaaaatcaaggttgtgatgaaatccttattttgcaacaacggagatcatagtaatgctaaaccagacatggcttttatcttgcaaaagaaaggtaactggattttgtagccctttaggaggccttcaagaagcagcactcatatcatcccaattggaactttggctgctccatcttgaagatggtttttgacgaaatatgctaactgaagttgatggaaacatggtgtacatagatggcagttttggctttcgcattgtgcaattatggtatatagaatagcagagctaggaaatttgtagttttaataccaaaaaacacttgtatacatatcaattctctctcgtgaagtcgggcccaacagattctgctttacggtctggtactgataacttcgtcgtacagattaaacagagaccaaaccaaaggtttgggaaaaatatcgaaagcatcgagtgagaaataaaacgtggtttgtgtcttgcacttgaacgaaccctcctgatgcctctcaaacatatggcacactgcacatattttttttacatatactgatatttggttacaacttctgttcatctcaatatcgctactaaaagaattaggttatgtgatgaggacatcgcaggtacacaggtacatcaacactacgtaaacaagaatgatggtttacgccatatatcacattaagaaaataaagatgacgtaaaccaagctgatagattacatctaaacaagaatgatcaagtataccatggttcaatcacgcgcaatcatgttaggataatacaataagaggtgaactaactatttgctcaacttaacccaaatattttaagttcggttcgaattggctgtggcagtgggcaattgcttacgttttatacccaaagacatcatcactacaccatgaaagatgggttacatcgagtatgacaagggtaaggcagaggcagacttagcccatacactacttgcggtgtctacgccaacaaggagacaatttacgctgcaggaggttaatttctatggcttgggcgatcctgccagtcaagagatgtggtgcatggcatagatcattgaaaatattgctaagtctagttttgaatgtaataatctccttctcaacatcattttctaatgagtagtttgagcctcttttactgaaggttgtactggagctgaagggctatgcacgaaccctagaaaactctttgcattctcatttgttttagccttggtcactggaacggattttttttattttttaaactttttattttttttattttaaaaatatatcaagccaaaacttatttcttgaatctaaaccttttgaccatgctagaccgcctagcatgacaatactgacacgctccacgcaatgggtgtgtcgagggaaaaccctcaatagcagggagtcgtgagacccccctttcgtgagttcggccgggggcggaggctcgtctctcaaaattcgcttgttcgtccctaagactaccagcgagcttacacatagtcggattatacaggttcaggccgcaatagagcgtaacaccctactcctgtgcttgggattatggatgaagttacaagggtttcttcacttcagagagcgcacttgcttcctctcttctgaagttcaggttttctgggaatcgaccccttgctctgtgggtagggtcctccatttatagctttaagggcataccacacgtgccgactctacctactctccacggggggaggggggaccccacttcacttctttgggcttcaaaacgtgccttctcccgaaagctaagcaataaccgattcttgagcggaacccggcgccgtcccccgtctgacacgggggacggcccggtcattccctcataaatgatcgatgacatgcaacagcccttcctcgagtgatgccctgatgtgacgggtcacacctacccccacttcgccggggacaagggcggcgtgatgatatgactgccctatccatcagatgtgatgaaaacgggccggtcacagaccggtcacatccgacggacaggggttagctaggcgcgccgcacgtctgccctgactgcattaaatgcagcgagggacagttggggcgctgcgcatttatggctgttcagcttgccgggcgagggcctcggggcgaaggcgcggtagagcccgaggcggtgacgtcataccccgaggctcccccctcccgctgcttctacgactcgcgtggcgcgtgagtggggccaaccggccaagccacgtggccggaggaaaagtaattctcctctacttcacatacccccgggcccatatctccgacagtagcccccggcgccatatcaggtattgatttcctaggatcgtcttgacatggcgcctcacgactcgtcaaactggggttgtgggcccgacagggaatctaaaaggatatcatcgcgtggctaggttggcgcacttatcacggcagtggtttgaccgcctttgactgcgctcatgatgaagatgcttggggcgcgataaccgggggggtcacttagaccgcgcctcgattctctcgcccgctacacttgcgacggaagcggtgacggtttgcccaacttgcgcttatggccgttgcacactccacctcgagtgtgccactgacaggcgcacaaaaggtggaagcggacacaacgggcgacgcaatgattgggcgcgggatgcggagagacaaacgcgggcgcgaagatcgtgaaggcagttatgggggcgcgaaacgaggaggcgaacgcggatgaggcgaggataaaagggggcggagaaggagactttgccttcttcctttcgccaatcgctcactcatcctttcgcttctcgagccctaacactctcgcctcctcacactatctcaaactcctcattctccaccatctctccgccggttgccatggcccaagacgccggggacgcagtgctcccttcctcccgcatcacggcagacaggcaccttagccttcctcgcaagatcatgccggaaggtgtcgtcgtgcgggcgggagagtcgcggccacggccgcgatatccggagcggttcgtacacctcttatccttcgccatggcgggcttgatcccgccgctctccagattcttccatgaagttctggatttctacgagattcacgccttgcatctcgcacctaatgccgtgatgacgctggccatcttcgcgcatttgtgcgagatgttcattggggtgcgaccgacgatgcggcttttccaggccttcttcatcccgcagctgctgcaaggcgtagtggtgggggaatgctacttccagccccgaccgggcacagcgggccagtacatcgagagccacctccacaagaaatgggaggattggaagaaggactagttctacaccgctttgccggaccatccgtgacttcaagttcccgctggccctcctgaaaggtctgccgcatggctggcgacgtgggagctgggcgaggaatatgacgcggtgtgggatcgcctcaagggcctgcggagcctgggcctcactggggcgatggtctttggcgattacttccgccgctgcatcgcacctcttcaggaacgatcccgtggagcgtgggaatacaccggtcccaatgaccccatgcggactcatgtgggcgagcgctgggactggggtgaggaagacgcgaagagggtgattcggcgggtgctgggcctggactctgccgagccaacactaatccccgacgggattcttcccctctgctgcgatcgcgaccgggagagcaagggcccgggagcaactccgggaggcggccgacatgattgtttcgagcttcgaggggtcggccccccggttcacctccggacatacctcggatgaggagagcggaagcggggacgatgacggcggcgacgactgggacgacattgttagcggcgccggtcatgggggcccgggcactccgtgatcgctcacgcttcttatttccttttgcgtgtgcctgtaacaaacacttcttgtatttaggccatcgtgccatcctgtcttgttctgcaattgaaaactctttaattcctttcactttttcgccttttctatcgatgcctgttacatagtgaaaagaaaaaaccaaggcagaaagggataattagacagcctgcgattgatatatcgtttgaccccgtccccccccctcgggcttgttccatcaagaaggtaaacccgcgttcggtccacgaaacctaagtaccgataagcaagaccattgccccgagggagccgcccagcgggactggccggaccgaggctgcgacgaccgggggtcggggacgaccatgtgtaggcccttccaatctcccggggttcggcacagcccggggcacggcccgcgttcgtgctccctttcggtggttctccggtcactttatagcatttaggttttagaacaaacgcggattatttcttgagttgggacaagccagactaaaaggggaaaaaagggtctttgcgaagaagtagaaagaaggttattgcttttaaaaggaaaacaggatacatagtggtagcccccggccagtcccatacataccgagggattgtgtgggtgctggcttgagctccaggaaaacaaaaaatctcgatttcatggatagaaacgacggaggtgctcgatattccaggggttgggcagctctgtgccgtcctccgtggttaaccgaacggaacctggtcagggcacgccgatcactttgtatggtccttcccacattggcgagagcttgctcagccctaggcgcgactgaacgcggcgtaggacgaggacgctaacttgtagtgatggggcccggacatggcgctgatggtagcgtcgcaggctttgttggtagcgggcggcgtgcaaggccgctcgccttctccgttcttcaagataatcgagatcgtcgcggcgaaggtcatcttggttggcctcgttgtacagagcgacacgaggcgaacccagggaaagctcggagggtaggaccgcttcggcgccgtacaccaggaaaaatggtgtttcccctgtggcacggcttggagtggttcgatttgcccacagcacggcgggcaactcctcaaaccatgaatccccgtgtttcttgaggacgttgtacgtcttggtcttgagtcctttgaggatttcggcgttggctcgctcgacttggccattgctcttggggtgggcgggtgaggcaaagcacaatttgatggccatgtcgtcacagtaatcgccaaacagctcactggtgaactgggtgccgttgtttgtaatgatacggttgggcactccgaatcgagacgtgatgcccctgatgaacttaagagcagaatgcttgtcgattttgacgactgggtaggcttcgggccacttagtgaatttgttgatggcgacgtacaagtgctgatacccgcctcgagctgcctttaacggtccaaggatatctagcccccagactgcgaaaggccaagataatggaatgacctgtaaggcctgggctggctggtgggtctgcttggcatggaacaggcatgccttgcaccgctggaccaattcttgggcgtcttgtaatgcagtcggccaataaaaaccttgccggaaggcttttccgaccaaagttcgtgaggccgagtgggctccgcactcaccctgatgggcgtcggctatgagctcaatgccctgctctcgaggaatgcacttcaggagtatctcgttggcgacacgccggtagagggccccctctacgaggacgtaccgcttggagatacgcgcgagcttttcagctttcgcgcagtcctcgggaagagtattgccatcgagatacgcccggatgtcggtcatccacacgacctgacgaggggggtcagggttgaccccctcgggccccgaggggcgcgggtcgccagaggttgggtcggagggcgcatcgttggggtccctcaaagggctgggtcgcgccgatggctgcgcgagcctttcttcaaaagtccctggggggagtggggctcgtgccgacgcaacacgcgacaactcgtcagcaactgtgttgtcgcgtcggggcacgtgccggagctctagtccgtcgaagtggcgttccatgcgccgtacctcccggacgtatgcttccatttgcgggtcggtgcactgatattctttagatacttgatttacgaccagctgggagtcgcctaagaccagaccaggagaaggcggatgcccattctggtcgccgccctcaatcctgcgaggagcccttcatgttctgccatgttgttcgtggctcggaagtcgagacgcacgacgtatttgaggacatccccgtttggcgaggttagcgtgactccgacacctgcaccttgaaggttgagggaaccgtcgaaatgcatcatccagtgcccgccacgaatatcggcgtttggatcctcttcttctccgggggagaagggggcattggatggaatcgattcgtccaccggggtccattccgcgatgaagtcagcaaggatttgactcttgattgcatgccgaggctcgaagtgcagatcgaactcagctagctcgatagcccatttcaccacccgtccagtaccctctctgttatgcaaaatttggccaagagggtacgatgtcactacggaaacccgatgcgcttgaaagtaatgccgcagcttcctcgaggccatcaagacggcataaagcattttctgggcctgcggataccgggttttcgcatctcaaagtgcctcgctgacgaagtagacgggccgctgcacctttcggcggggccggttcgtgctgttaggggctggtgactcggggcgcacctgttcggaggtcccgaggggatcccggactgcctcgggatcatcgagcctagggccacctgtcaaagtctgcactcctcccttgggggcctcggggccctcccggaggcaggaagctttggtcgctagactctcgggggacgaggggccatcgcaagtcggagggccctcccgttcgccttcctcatgctcaaccactagggcggcactcaccacatggggggtcgctgccaagtagagtagcaagggttcctccggccccggggctaccaagatgggaggggaagtgaggtaagctttcagctgattgagagcttgctcagtttcctccgtccatacaaacggcccggagcgcttgagtagtttgaacaggggcagcgccctctcacccagtctcgatataaaccgactcagggcggccatgcatccagtgacgcagtgcacatccctaagcttgctggggggggcgcatcctctctatcgcacgtattttctcaggatttgcttctatgcctcgggaagagactagaaaaccgagaagtttgcccgccggcacaccgaacacacacttatcggggttcagctttacgcgcgtggacctaagactatcaaaagtttcagccaggtcctgtagcaacgtgtcctggtggcgcgtctttactaccaggtcatcaacatacgcctctacattgcgccctatctgattacttaaagtaatacgagtcatgcgctgaaaagtagggcatgcattcttcaacccaaaaggcatggttgtataacaaaaagtgcccacaggagtaataaaagcaattttttcctcatcttccctagccatacaaatctgatggtacccagaatatgcatctagaaaacacaaaagttcgcaccccgcagcggtgtcgactatttggtctatgcgtggcagagggaagggatctttgggccatgccttgttgaggtcggtgtagtcgatgcacatccatagcttgccattggccttcgggacgaccaccgggttcgccagccattccgggtagatcacctcacgaatgaagtcagcctccaggagccgcgccacctcctccctgatgaaggcctgccgctccggggcttgacgccgtaccttctgccggacaggtcgcacatccggccgcacggcaaggaggtgctcgatcacctccctggggaccccgtgcatatctgacggtttccacgcgaaaacgtcagaatttgcccgcaggaaggagacgagcgtgccttcctatttggcgtgcaaagtcccgccaatcttggcggtcttggacgggtcgtcaccaagggggatttccttgacgggcacctcgtcaaccgaggtgaggtgcttcttggaagtgtgagacgcagatgcctcatgggcctgtggttccgtggccaccgccaggttgtctgcacgctgctctgcgtaggcgagggcaaccttgacatcaccaaagatggtgatgggaccagcaggacctggcattttcatctggaggtaggcgtaatgggtggcggccatgaactccaccaacgcaggtctgcccagaaccgcgttgtagggcagattgagatccgccacatcgaaatcgatccgctcggtgcggaagttggcggagtcaccgaaagtcaccggaagctctatgtggccaagcggccacgtgtgccccggagtaacgccaatgatcgggagcgatggctggagcttcatccccggggctttgagcgcgtcaaaggcagccggggagatgatgctcagactggccccgccatccaccagcacacttttcatcttgacgttgtggatggttgggtagaccaccagggccaacttcccccccgagcgagcaccgtgggatggtcattctggtcgaatgtgagcttcacctccgaccagcgcgccttccggactgcctcatgcgtggggacagcggccagaagctctcgcctcatggccttgaagcttcggcgagaggtgtgagcgcaagctcccccgtcaagcgtggcgacggtcccttgaggtatctggaaatccaaatcctcactatctccgccatcatcggcagggcccttgttcttggcctcctctcgatgttcaccggttaaggtcgtgggggctttgccctcccgtcgaccctgccgcttctcctcatcaggctttcagaatcgctcggccaaattcttgaccaagcggcagtcggcgagactgtggcggtaggtgttgtgcaccgagcaccacttgtccgccgaccggccatcaccggagggaacagtagggctcggcttgtcgccggcagcctttcctttgcgtggggcccgtgtgggcccgtccgctgcaaggacatgaccctcgtcatcggagcggactgatttccttttgcctctcctatctcgccgcttagagcggggggcagactcgggggtagccgcggccgccgcaccggtgccaggagagttccaggcccacgcctcctccttccaggccaccttgtccgcctgctcgaagagctcagcagtggtcttgggctccttggaggcgatcttctctagcatgcaattgtgtcgcacgccgttccggaacgcatatacaaccgcgtgggctggaatgcacggaatggtgttacggacctgacagaagcgctgtatgtacgaacggagggactcatcatccttccgccgtacagcgtgtaggtccgcctcttcccccgggcggggatatgtgccctggaagttcgtgatgaactgctggcacaggtcctcccaggagtgaatggagtcggggggcgggtcattaaccagccacgcgcctcacccttgagggccatgggaaagtaattcgccatgacccggtcgtcaccccctgcagccacgataaccgtggtatagatctggaggaacttggagggattgatgctaccatcatacttctccgtaaggttagggcgaaacttcgggggccatcggacattccggagactcgccacgaaggccctacaacctgtccccccaggggtgagtgtgggaggagggccgcctcgtgaggaagaatgtggcgctccagatgaggaggcaccttcccccatacgggcagctcggcgctcatcccagcgttgctcgatgttgattcgagcgtcctgcgtaccgtagaggctgtcatgacgcctccggcttccagaggcccccgacgatgttgggaccgtagaccgcctcaagatcgtggccgattgacgagcccttctcctcgctgacgaggagagggtgaccaaggtatgtgatgtaccggcggcagcggatcgaccacccgtggccaactaccgttgggcagcagtgaccaagttggccaagtcgtccagccagcgctgaacaggagtctccggctccgggtttactgggggatgccgtagaagtgcgcctgctgcttgaagcgcgccttggggcgaaccgccgtctccataatcgagacggcggcgtaccccgacgcgtcgcagcctccctccgccacagggaggagagagtcccgaaccacctgaacgagcggaattatccctccgcgaaggttcgcggcggggaggagttggagatccatggcgacggtgatgaggacctcggctctcgccggaatcctcactccctgatggggtggaggtgaacgccaccgcctcctcctccacttgtaggacctcgaccatggtcggcagagtcctgaaaaaacttgggacaaaagaaagcgaattcctcccgggacgcgcaaccgccccctacctggcgcgccagctgtcgagggaaaaccctcaatagcagggagtcgtgagacccccctttcgtgagttcggccgggggcggaggctcgtctctcaaaattcgcttgttcgtccctaagactaccagcgagcttacacgcagttggattatacaggttcaggccgcaacaagcataacaccctactcctgtgcttgggattatggatgaagttacaagggtttcttcacttcagagagcgcacttgcttcctctcttctgaagttcaggttttctgggaatcgaccccttgctctgtgggcagggtcctccttttatagctttaaggggataccacacgtgccgactctacatactctccacggggggagggtaggggaccccacttcacttctttgggctttataacgtgccttctcccagaagctaagcaataaccgattcttgagcgaaacccggcgccgtcccccgcatgacacgggggacgacccggtcattccctcataaatgatcgatgacatgcaaccgcccttcctcgagtgacacccagatgtgacgggtcacactaacccccactctgccggggacaagggcgacgtgatgatatgactgccctatccatcggatgtgatggaaacgggccggtcacagaccggtcacatccgacagacaggggttagctaggcgcgccgcacgtctgccctgactgcattaaatgcagcgagggacagttggggcgctgcgcatttatggctgttcagcctgcgctcccctctgccgcgtggcggccgggcgagggcctcggggcgaaggcgcggtagagcccgagggggtgacgtcataccccgaggcccccccctccccccgttgcttctacgactcgcgtggcgcgtgagtggggccaaccggccaagccacgtggccggaggaaaagtaattctcctctacttcacataccctcgggcccatatctctgacagggtgtggcatccttcagcgatggtagcgagggtgatgtggccaaatatcgttgtcacgccatctaaaccggtgtgaccaactaacgttgccacgccactcagaccaacgtgacagtgttgatttgttacgccagtggtttagattctaaaaataattttgggaagggtctattttttaaattataataaaaaaggctcaaaaaataaacaaaaattactaggttaacgtgattgagtcactgaagctaaatcacgttaactacaatttcaatgcctaacgtttattatgaacaaaaattataagctgatggtactttaatctatctatctatctattatctatcttctatctattatatactaaaagtccattaaactccctacaaacgctcttaagccgccacgtgtacccctacaaacgctcctaagtcgccacatggcactatataatcttaccgttgattttcacttaaattggtggacccgttattttacaccattagattagatctattatttaaaaaataattttctcatgtttataacatacaagtgctacatgatgcaaacgctacttcttgtctttccgtatgtacaaacgcacgtgactgaaaacaaaactataaaaccttcctattcttcgctagaagaaaaaaatgcacatgtatagaaaaagacagaaaaagacatacatccataaaaatcaatggtctttaaaatatgatttctacaatataaaaataaaatatataacttcacaaatataaataaatttagttaaatctatctattgttatatactaaaagtccattaaacttcctacaaacgctactaaaccgccacgtggcgttttaatagacgggaaacatctagccctcaattttcatttaaactagtggatccattattttgcaccattagattagattaaaacctcccttcctctcctctccttgcacgttttgtggacgaaattgcagaaaaccgcgcacactttaacaattggcacttaagtacatatattttggtagtgtagtttgacaaaaccacactatcaatgaatggattcacctgtgagatgacgtggttgttccacctaagatgaggacgtggcatcctgttaacttggactataaaagcatatgtttgattatttatcttactaataaaaatacgtaattaaaatacattgcggcaaatgacattggcatgtattaattaactccataacaatttgtcaaaaaaaaccgcatcaaactatatactttatggtatcaaatattacttaacaaatatagaacggtaatttgaactatgtaaaaatgcaaaccatataatttagttgtgttttttaagtagatccaatttaaattttaatttgtgtgaaattaacattctcaaaccattttggaatttttcgaaactgtttggtaggtatttcaatagtgtcgacgggtgatacccgcagaccggatatagagggtattggggtacgttggtacaaggatctacgtagtgtgacatcgagcaatcaaaagacaagaattatactggttcaggccccttgattggtaatagccctaatccagctgatatgggattatatggtggaaaacacaggttacaaagggaacgatggaacttgtcggatccggcgagattgtggttgagttgattcgactagctctcgaagacttggctcctcgtagactccggcttcgtaggctgtgtgggttgtgttggctctgagattcgatgtcctatgccctccccgggggtcccttttatatcgcagatctggaggtctccaagtaggactcggagatataagacccaatacgatacgtcgacgacccagttctgtccgagaaggattcttcccatctgtagatttcgtgaaaggtttccttagaatatgtaggaaatatccgcatgcgcgtgggtatgccacatcgatatgtaacgtatatcgaagggtaaagggtatgccgaacccgtaaccctgacaaatagtaataaatcctacattatacatagatgtaaagaaaattcaccaataatattttcaacaggtgaagtatatatcattggtttttttatattttctaataattatttaaatgatatgaaaatagtcagaatgtaacaaaaaataacatatttatttaagaatttcaaatatagttaataatggtccaacgacataagtcgataaaaaataactatttattttaaaagattataataaattagggttcctgactaatatatgatgaaaacatgagagacagtacattgggagaagggatgaatgaggcggagggggtggatgttgggcgctggtatacgtatgtacatacatacaatgcccctcgggctctatattggcacaatcgatgtttactgtatgttttcactccaatacatatccaaaatgacatatttggttaaggttggcttttgactctagctaccacaacaattataattttatatctttatttgtgattgatcaaaaaaggcagttctgccagttagaggaaacaatccaatccaagagtgccaaacgatcttctactacgtaagtgctctagaatatattctatggtactatttaaatgactttattagacagtatttaatgatcttttagtatatgggtacatagatatacttgccggtagctntgtacttttattccataccttccgggtataaaataaagtatgttttttataaatatttatagttttatttataaataaataaataaataaatcaagatcacattaactatattttactacatagaagttaacatggcaactaaataacaatggaaaattaattgtacatatgtattatgttatactaaatcattcattgcacgtaacaaaaatcaattaaacacgctctatagagctcataaatcaccgtataatatgttgtaaaattgtaataaatagtaattaaattgacgtatctattatttttaactattagatctattttttaaaaaaatcttaagttgccatgtgtcaccttctataaaaaaacaggaaaaaccatagaaattcttagaaaaaataaaacaccccgtcatcggctttcacttaaatcatttagaaaaatagaaaaataaaatcttcaccacctcctcaccctcccatgtacacaatactgtcgtccactccctattgttttatctcttaaattaaaagagaaacaataaataatgtttgatattttttagaaactaagtacaaacgcaaaaaactcacagcacgcacacactcaccccctattaatgcatacatgcatatacccctataagtacttctgagagattaggctgacctattttgacattgatgaagtcgccacacacctcgctgtcgactggtacgtcgcctaccattgaaagaattttttaagtctaagacttgtacccgagtgggcaagttccaccacacacatgcatatacccctatgagtacttctgagagattagactgacgtattttgacattgacgaagtctccacacacctcattgtcgacgggtacgtcacctaccattgaaagaatttgtcaagtctaggacttgcacccgagtgggcaagttccaccacaaagaacctaaccagttgagctacatttacttcgtattaatgttggatattaaaacaaccataatatttaagctacatttctggaatactcttatgaattttaaaccagtggaactattatttctaaccgttatatctatcttatataataaaaaaaagcgtgtattcatggtacatcacatttcaaaagtatttttgcgcaattatattttgtcgttattgtatgcacgttagcttgtgtggaagctctgacccactctacatgaaatgttcatagatggactggctgtcaaactacatctatcatattaggctacataaacctatacatttagtggaggttcatgttccacccaattaatcctcgaataaaccatgataatatatatgcaattaaaaaaatatcttacttttactttacacttactttttgttgacatgttttctaaagaaaataagtctaccttcttttcaaatgatgaaaaagattataaataattgtttatagatagtattacttaaatatgatataatataaagctaataggttaaaaaattataaaagcaattaatgccgactaaagcaatttatggagaaatcgtgatagatgttcttcggttaatatttcgcttttacaggtctcaaacttagtgtacgacgcatgcccgcgtattcacacgggctaccttcctagttactcctaatgttaataatcagcaattgcaatttctgacaatggcaacacactctgatcaattcgcagcttcaagtcacgattaattcagggaactgctgttgcaaatgttctaccttttcttaaatattatgcagattttaccatcaaaactcctgccacattgttcagaaattgcaggttatctttgtacttctctcacgaaaaaagcaccgtagcgcactacaattttcattcgtccgatcctctgcttgtatgcgtgccagcatactgtaacaaacccaatcggtcttatgacgctcggatatgagaaattcccaattcgtagtaagttggttctcaatgcctcctaagcctaccttgtatatatagagtgggtaatgtgttaaccacatctatgttctggtagactggcacttgccatatgcttcgcaatatcatggtgaacttcttctctggcaatataaaggcaatatatatgtgaatcgtgcaatagttcaccacagaatcataaataactgcagttcagatagcacatgcatctgtcttgcactcttgatacaaacacattgtatcttttcgcttgcctattgacgtcctccttgtaggacatatccacatgctctgatataaccattgattgttcagtacttcagtacaagtgaatggaacaggtgcattagctatatatggtcttaataaagagcctcggtactctctagtactatatatatatagtagaaagcaatttaaattgttgatctcatttcaacaaagagtttagacctatttgtactaactaccccagttagcagtagtagaaacgtaaagaagcattattatcaattaaataggtgtggatgggtataattatcatttagctatgattaaacctgtttttttctttttttttggcattttcgatggaatttgatcgatgctagcgcaatggatgaccacagatcgatctagctaggaaaaaataaatgataaagttacccctaatcactttattagtaaattacgtatgtacccttaataactaatggttcagattatttttacgggtagtataatactatcagtagagaataccggagcatcgcttcttaattaatagaggattaaaaataatatctaaatgggactagaatatttggggctgtaaagaatgcatgaaacatgagtttgggctagatcagtttttgtcgacaccaaacgaagtaatttggtcggtgccatgaactttgctcaatctttatttttctccactgtgcaggcaatctttttttttctcgaatatgcaggagatatgtgtatcgttatgttaagaataagaaagagagggtacaaccctaagtacgaaaccaaacacgcacacactaagtatctagtaacctatgctgcaaacccagccacaacagtgaaccaaaccatgatgtgagactaaccagagtaataaaaaggatagcccccgaaccccagccaatctattcatgatattatatgttcaattaaggtattgctcatgtgaagtactaattccaccaactcattataaaaaataattcattatcttgagcttgtgaaaaacaaagggaaagttctatagatgagattcgtaggattgaatcattatcatgtggcgcgaataacaatgtcgccaaagttgccaatgatttaataaagcatacgtggcgaatatatatcgagtgagcggtaaaagacgagtgaatgacaaatctattggcccacatttacatatatcaatatatatatatatatatattttaagtaaatttcgtaaaactacgtatactttgcatggtctatcacaaaactatatatctaaaaacttgtttcacaaaactacagattcagtgccttcgtttatcacaaaactacatggactttgtacaatatttcacaaaattacatatttaagaatttgtttcacaaaactatagatttaatatcttcatttatcccaaaactacaagtttagtgtcttcattatcacaaaactacaggttttagcattgacctgtagtttcgtgataatagaggcactaaatccgtagtcttgtgataaatgaagacactaaatgtgtagttctatgataaacgaatacactaaatttatagttttgtgaaacaagttcttaaatatttagttttgtgatagattaaacaaagtacctatagttttgtcataaacggagacactaaatctgtagttttgtgaacaagctattaatataaaatcaaaggtgtttttgattattattctgtgatgaacaattggcattggagattattggttttgttatttggaatttattcatgaagtggttttggagatgattggatttacaggtgaattacaggtgttgttattttatgtgaccggtcagaccgggcgtgtgctgacggtcagaccggcgcagcccgcggtctgaccggccgactctgtgtcggtttcagtttcgggttgtttgtttggatatccgtgattgtttcatgattatggattctagatggatactatacgtatgtaatactgttgtttgctactaataagtcaagttggagatagcttggtctcggaatatggttctttgtttatttcatgtgtaggtgactcgatgcctcgggagtgtatttgcggtgatggaccgggagtcggcttggggataaggcgacgtccgtgatggtcagagatcatgcaggatacttaggctagagttgatgcacgtggttggtgaaggggctgcaggaat

SEQ ID NO: 28534 - DNA, 11336 bp, Oryza sativa
cttcgatttgtgtttcaccgggtttcggtggtctaactggcgacacactagcggtcagactggcggcatcacagcggtcagaccggcgggtgaccttcggtcagacaagcgtcggcaacaagcaacaggagctgacctcggcggtcagaccggagatctaatcttggtcagaccgacggcaacctggcggtcagaccggcaggacaacttcggtcagaccgcgatccgtcgaattcgagggtaacttttatttccgctaaaagtttccggtttttgggtataccaactattcatccctctctggttggcttagttgttgtgtttcgatcctacaattaaatctgtagttttatgataacttgtgcaaaatacttgtagttttatgaaatttactcatattttttcaataatggaattgggttaagtattgcaatctgtaaggaattacaaaacgtccgcgacagagtcaagttcaaaattcaaatcattagataaacacaaaaagtttccctgtaaactaaattcaacgccctctaaagaactctattactgaagtgatccaatgttactgttttgctcgaaaatacagggggggatccgtgaatagggagctatcattgttcatatggtaaacaaacagcagtgtctgcatgagtgactatgtggcatgatctgcagataggttattctgagtttatgcacagcttgtacacaagctgaacaattgtgaagatcatagcgtgttaggtttaatcccacattaataattgatgatggagaagtacgacttaataggtgagggcagtcctcacccattagactgtattttgggttgtgtagtctcaggaactaaagtcgtggctctagttgggtttgtggtggagcaggtccaatgtgacctaggtgactcacggttgatgagccgggctgcgcattgtaatatagtgttgcatttcctgtcacctcccaaaccttaccatgtctatgaaactttctagacacgtacaccctaattgttttctttactcatgaccattatccaaaaaaatgaagaccttgcagtctattgaaacgctcgctcgaaccttaagattaattcagggagtcaagaatgctcatttgcacgcatgatttaaagaagagtctgcttggtggccttcctgcaacaattccttgggttattatatgtgttgtcatcatagatgtagacgtgtggttattttttaagttcatgaaattcctctgtttttatgggtatcttcttgtacttcatgaaccctgagtattatctatatgtaaaaattgtcctagtacaaattcactaaataaggttgtgtttagatccagaggtgaaaagttttggcgtgtcacattggatatatggacacacatttgaagtattaaacgtatactaataacaaaacaaattacagattccgtctgtaagctgcgagataaatttattaagcctgattaatccgtcattagcaaatatttactgtagcactacagtgtcagattatggagcaattaggcttaaaagatttatctcgtaatttacacgcaatctgtgtaatagttttctttctatatttaatactccatatatgtgtccaaacatttgttgtgatatggtgaaaaattttgacaggggatctaaacagaccctaagtaatattgtagcttcaaattaatgacaatggcaatgcactttcaacgttcacgtaatcaaattgatgcggtgcgccccaattgattattggccactcttaccatagaaaacttatttttcagcgtacttgcgatagcttgtgcagttttgatggatgggcagaagttttgatggatgggcagagggacaatttgctcacctctttttcatcgaaaaaacatgtagtaactggtatgtctggataatagttgatatccaaaataccaacagggatggactccccccatctcaaaatgtaactataatgtttgatttagcattgctgactatgattacaatgatgcccgagatcactattagtactttttggaaactttagcaggtgtagcattcggccgcttgcaaaactgtgttttgatcacctataaaaactgtttttctagtagtgtgtgatacaaattggtgagcacgtatcaaacggtgctcttttttcaatttttttcccaccagcatttcttcgaattcatttttttaatatctagtttacttatttatgtccttaagtaaataattatcatagcattcaaaataatccgtaatccattaatatctatcctcacttcaacaaggacactactgacagacatcatcaggaaaataggataatagccaatagttattttttcttcctataggctcacggccaatgtttgttgcctgatcaagcgtttgggctgtttgcgtgctgctgtcacgatgctgccgctggttcaagatagcctgcacaacgctgtcacaggaggaatgctgttgcagcctgaaaaatcacccgccaaggcttgattacggggattgatattgtgtcgaggtagatgtatggctacggttagtgagtcaatgagacgcacgactaacattctcccgatacatcccagtcctactgcagacggtttgcgaaagggcaatcgcaatgagaaagcgtgcatccttgtcggctcagtcgaacatttttatgctccctccgtttcaaaatatttgaccgttcgtcttattaaaaaaaattgaagtaattattaattcttttcatatcatttgattcattgttaaatatatttttatgtaggcatataattttacatatttcacaaaagtttttgaataagacgaacgtcaaacatgtgctaaaaagtcaatggtgtcaaatatttcgaaacggagggagtatataggaagttgtcaagttgttgaccacctttccagactgcactaattaatgtcaagttcattactggatgactattttcagtggaaaattcctttaacctttcgagcgggtctctagtagtttggggttcaatcgtgtattacatatcatctaaattgtgaggaaaacaaattaaaaattaaaataaattaataaaatatattaatttatgatatatcactctctaaacatgcaagttcaaaacttcacgcgtttcgaattatcaaaacatatgtatatattaatatgcttaatcattcatacgtatgtttggagggtttgtatcgtataaatatcatggtgctattctttggttatcattctaagtgtttaagttggccccctcatctctaaatcttccctctgccattgctggtccagtagttggattttactaaggacagtaggtatcaactagacatctatatcaactaggtacataaggcttccgcatatttttttcgttcgtctttttttcctgtccttttctccgtcctttttttcgccctttttcctcttttttttccatccaccttttttcttgccagttcttccttttttcatccactttttttcgctatttcgcatgtcttttttcatcgttttctcggtttttttcatcttttcttcgtcgctattttttacatcacattttttggcatgcggtaagaattcggttttttccgtcatcgtgatttaatctccaaccgccactcaggtcaaatcctagcgccaccgccacattgatctgcctccccttgcgttttctcctccaattagttacgaaaattcattctccactactctctcattattttccccttgatttcctcttacaattcggctttacttcaccggatttaatctctatttaacaggcgccctttttatctcaagttttgccaattgctccgattttaatatgaaaggaaagagaagatcaagtgaatcaaagaccctcaatcaattatagtgatgggatgatcaagaaagattcgactagattttgatgggaggatcggctcctgcatcgtacgggcacttccgtaggttgaagacgacagttagctgtgcgagctgggctacagctctacctgtgagctgagctgatgataacagactaggctaggctgaaaaggaagaaagtaatgggtttttagtgcaaaccaagtataatgtatagcaattaaaaacggttttatgcgttgcatcgcagaggcattttttatagtttaattacaatatctgattgtccaatattatatcgacagtaaaacactttaacgatttctaaagttcatgccaattttagaataatcagtggttgcgtgcaaatatagtgtcctttcagatgaaaatttgtatgttacagcctacaggaaatattttgcacatgcaaattaaacaatctaaattgttagtcttcaggtgcacccaacgataaaacacggtgacaattgagccgctaattgagcatatgatatatatcctaacgaaaatcgaccagcgaattgcggagttcttattattattacatttatcatacacagtgatgtccgtttgggactagggaatggctataggtacaataagactttgaacatgagaattctcctttttcctgaggaatacaatattgtgtcatatgcaagaaaagccaaccaccaacaatatgaatatgtgggataaagttcaaactaactagatcaaaactaataattaagatgtaactaggaaggtagcccgcgcatatgcgcgggcatgtgcgtaaattttttttacgaatgtccatgtgtggatggttttttatcaaaaatattctttcactttatcataaactaaaattaaactaattcgacgtgctttgaacgttggttacttgaaacatataaattgaactaaaattactttaaactgtgttgtttctaatacatgagaaaattttgtgtcgaaacaatagatgtgttccctatgaatgtccaattatttttgttagattctgtttgaaattttaaatatattcattttattagtcttgctaaaatgtttgaatatttctatttagaatgggtaataaacccaacaaaaacaaattttatactagataaatttcattttattttcatttctttttatctccatttttttggataaatccactttatgaagcatcttttgaaatgctttgatctctgtaagtcagaatgaaaatatatgtgggttgatcctacaacctgccatagggtaaaggcatcaattctaaattatctcgctccaattaagtaagaaaaaataaaatagatgtcatagtattttcttagcaaattaccactaaactggagtatcatgtaataattgcatatttctagattgttctattctatatgtcacaaattcacgatgtactataggaagttttacccaaaaaaatagatatggtcttttaattcctatatgtaattggcttatgtatagctgaggccacatcatggttgtttcattcttaagattccttggtgcaaccaatgtgcccagtacaatcggtttgttgttcaactggccacgtgacttcatagatcatatatataatttagaagctatgatcattttatgattatttatttatctcctgaagtgatcatttattgataaaagcatcaatatgaaaatgtatgggtaaatatttacctcctatatataagctgagaaaaagttgatagaaagtcgttagatgtctaacaggatataagtaatgggtcaaccagttttataaaaaattgagctgtgatattttgatttttagtgagcaattttagtattttcttttctttagggtaaaatttgctacaggatattaaaaaacatgtaattggccgagagacaccgtaagaacgcgtatctgttgtggcacaccgaaaaaattggtaattagctactggacgcccacgatattattttataatatccaaaggaaatgcagagagagacaataacaaaagtataacttttcccatacctactaagtctggcttgcaaacaccttcgatgcagcaacagcacccgccagcggtgaggtggctctctagagaggagggagggtgtcaaggagggcccatgcacctgggcttgtggctccatgtcatttccacacttgttgccgctacagtgtgagggctatgctggcgctgatgctccgccacacaccatgcttggggtgagcacaacgtggaccacctcttaattcatgtcgagtagggtgtcgcagagcgcaggctattgttgtcgatctcggagtcgtggcacgccacgctgccataccctccactgcccatgtcgtgactaccacggtgttagagcgatatgcgagccgcacatggcaggaaggggcaaaatcatactttcgtgattgtttctcttcccttttcctttggatataacaaaataatgccacgggtatctagcagctaattaccagttttttgcggtgtcccatagcagatatacgttcttgcagtgtcacttagctaattatactttttttgggatgtcctgttgtaaattttacctttattgagaagaggcttcaatatggatgtgggttcataatgtaatttttgttagcagttaaatatagtcaatatgggcattaagttattgttttcacttagaaaaataatagctggctagacctaataggtggagattcgtttgtggtcttttctttgctcataaaaataattttaattttaattatcatagagatataaaagctgtgaaaagtaatgttgcacactgcatgtgaacgggaatggaggaagggttgagatgtttcttttttttagaaaaatattgattgatttgatgatctaaaataatgtgttgatgtttaagtaaaaaaccgatggttggatgttatttttttcttagatttattaggtttttttttccaatttaagtgagacaagtagcagcttagcaaaatacccatagggaaggaaaggaaggagaggatgggaagatggtttgggatgttttttattaaaaaaaatagatacaataatgatgtaaaataatgtgtgtatcgatttaagtggaaaacaatggatggatgtttctctaatttaacattgtcataccacgatttagaaatatttataagatgtttaatgggctttaacacctatttttgagattattttcaataaagttaattttagttttaagtgtgacagggataaaaaacataaaggaacagggagcctactaattgatcactctagcgtggtggactgtataggggacgtgggtggttttggttttctaagatagatctaacaataataggttcaccgatttaaataaaaatcgacggagatttatctattttattagggtgccacgtggcgatttgagagtatttatagggtgccatgtcacggtttgggagtgtttgtaggatatttaatggatttttaagtgtaagatagatagatagtactacatacatatggtttttctctttatcttatatggtagaaaattatattttatatttttctcccgattatactatgtactttattttactttatcacacatattttttcttccgacgaacggaacgtaagctttattgtttttttttctgaatcatcgtattttaccttttatacagggaatgtattatatacacacctaatgattcgtaataggtccaccaatttaaaagaaaatcaactatagatatagatataatctaatggtctaaaatgatgggtccaccaattaaatgaaaatcaatagtgccacgtggcgtcataggagtgtttatagagtaccacgtggtggtttgagagcgtttttaggaagtttaatggacttttagtatataatagatagatgcccgacatattagaattcctcagcaataggaaaatataaattataaaatatatcatgagtagtttgatgcatatgttatattaatgttgtttttaatgctatagtaatttgttattaaacctatttgccaaagaaaaaaatgtatatgataattgattaaggaataattgccaaggaataccaatcaaatagtaagagggcttgtagatgcgtcgtgactatatttgaattttattatttgaattttattgttatagtatagaaaatcctaatttaaaaaggccatctattttgttttcgatggttttagcaccgtacttatacttactttttagggttttatagttcttttttatcgtgcttacagcatacatgtgcatgttccttttttttttcaagtgaacggtatatctcaatgtttttttttcttgatagctttttttcatcgtatacgtacgttagttgttttttttcaaacgttatcggtatatctttgtacgttcgtacttaatttctggtaatccgattctctggtatatataggaagcacaaaccaatagatataatctaatggtctaaaataatgggtccaccaatttaagtgaaaatcgacggtgggattgtagaatgacacatggcgatctaggagtatttgtaggagtgccacatggcagcgtaggagcgtttgtagaatgttttatgaacttttagtatataatagatagatagatatgaacaagagcgcaatgtctggaaactataggtaccaacttcaacgtcttaatttggagaacctgggcccctgcaaaatgtaagttcaacgcgtgacttgtcatccaaaatatagtttggatctctcatcgacttgctactagaggctggccgaacaatggggcttgcctccgccgtatgcaaacgagacaacaatccatctcttagccccactgtagatatatcaaaaggatatggagcctattcgccacctaggttacccacaactggacccgaaccattaggacatatgtcaaagcatccaaaattggacccgagcctatctgctgctgctagtcctacaccttgtgcggttgcactagcaccacataatgagaaatcaagagtacagatctatataacatcgtggcgcttttttgttctcggattccaaaccatcggatctaaatgtacaggccggtcgaagaccatgacaatgtacagtcattatattgtgcagttgctactgcgacaatgcttgatctcagaccctcctatgctaatgaaccattcaggagattgaaggtgtagctggcagcagtatgtgctggagatccctgtctggttcaaaatgatttaggttcctgcctgcttagttcctagttgcctcccatcccaacaatagtcgggcgatgctagtgaagagatctcaagaaaacttttatttgcatttctcttctgtgcttctggaaatcctatatattgcctttcatgtcagatgcatctcctatatgtcgtcccttgggctaccaaagcatgcacatttagggcccgctcagatcgatgatattttcaaccataccattatttggtaaaattaacaattgtatagctatatttagtttgttattaaatattgacaatgtatatgaaattttggtaatatattatgggctattcagattgatgctattttcaatcatagcacttttttttttggcaaagtccaaaaaaaagtatctacatttatttcattaccaaactttggtaaatacataaaaatcttagcaaaattttgacaatattgttaacttgccaaaagtttattttggctacaatctaaatagcccatattaaatcaatcctatcaaaattttgacaacgtagttaccaatttgcaaaaatttagtaaggtttattttggcaccaatctgaatagactcttatttcttcattattacactgtaaaaatagtacataatgaaagtggtaattaattagagagtgcatcatatgcgactaatatcctttggttatcatatagtaccatttgaattttgaaagccccagcagtagtagctgcaagctagataaaatagattatttctgtccatataaacgcattcttcatacttcgcactgataaaataactgcggatacttcgcaccgggctaacccaacccctagtgacaactcataagtatattatacacataacagaagaggcagctgagctcaacacaaatcacaagcaatatataatactacttctgaagctagaaactagaaatgccgcaagagccatgaagctaagcagctagctaatagttttatgaacatatgcaacgctttctcattcgcacgacaaattgagtttgggcttgggtagcaccgggagacgcgaattaagcaaaatgtgggatgaaagtatttttggacaatgtaggtggctgcgccctcatgtgccctcaggtttcaggatccagcatggcaaagttctgtacgagactgaagtattttgtcctacaatttattgagcttcacgagcaaatgagcactctgaaggctagcttgttcggatcattgggatttaatccccaacgggaacctatcagggagggattgagtggatccctctcccaaatcacccaaaccttctgggggatgaatcccttccgaccctctaaaccccactctgatacatgtgtttggtttggtccgatcctcttcaaaatgatggtaaagagttaagctagcactataatctttcgacataagaacagtgtgaaacacgcaagcaattccctgatttttttttctgacagaactaatgcgtaataactaagcatcatatctcatatacttcatagaattcattcttgaacctaaataaaagatgaatgtatcaacacattcatatatgaactgaacaacagaaagtacatgaagtttggccatactgtttatgtgtgctggtaagggtagaaagaccattctagtcttttcacgtctattgtgcacatttatatgcctctttaagcctatctcaatgcatagtgttttatccctaaatttccattcttctcagcaccttgacaaggtcccaaggcaaggtttgttccggtggtcatcggcgtgccagcggtgccctaccgctggcacggaaatcccatccaactcacgccaccacttaggtagcagcagcaagccctcctcatcgttcggtacgtcctcgagcagcagacttttggtttctcatcttcaaacaagaagcaagcagcaaggagcccgtgatcgccagttcatctcctcaagcagcaagcaaacaaacaaacgcaacttttttgtcactatacatatcgccgatgcttataatcatactctggtgttttggtaaatcgttaatatcaaacttgagccaccccactaatacagtgtaatgcacgggcattttgctagtgtgtgtatatatatacatatatacatatatatatatatatatatat

SEQ ID NO: 28535 - DNA, 4607 bp, Oryza sativa
attcctgcagccctgatgtccgtttggtactaaggaatggcaatcgatacatatataagactttggacattagaattttccttctcttgaacaaaattgtgtgatatgcaaaaaaaaaaaaagagccaagtaactaccaacaatatgaaatatgtgggataaaattcgaacaaactagaacagaactaataattaagatgcaatataagcaagaaatagacaggcatcaagatttcttgggaccacgatcttatatggaaggtggcgctggcagcagtatatatatgtgctggagatcccattctggttaaaaatgatttgagttcctccctgctgttcctagttgcctccctgccctacaatcatcgggctatgctagtgaagatctcaaggaaacttttatttgtatctcttctctgcttctggaaatcctatatattgcctttcatgtcactactggggaaaaggcccttcactcccggtttgtaaccctttttactcctgagttgcaaaccgggatactcaatccgggtataaagatgcatatctttagtcctgattaaagtaaccaggagtaaaaatgggtcttcccacaggccctccgcctggccgctcctcgatctgctctagggatgaggagaaggagaggttaaggatcagagagaggagggataggaagatgaggaggagaagataaggataagagagaataagaagatgataagtttgggaggataaatcctcgggattatatactatatatggatttttagttctggttggtgttatcaaccgggactaaagatttgaacaatctttactccaggttggtattaccaaccgggactaatactccaggttggtattaccaaccaggactaaagatgttcggcccaccgacaggccactaacataggatgatctttagtcccggttggtaataaagattacatagcttttaatcgggactaaaaattatttttttgtcccggtttttattggaaccggaactattgtagttttcggccaaccctgcaaagatcagttttctagtagtttgacagatgcatctcctatatatatgtcatctgttgggctaccaaattaagcatgcatgtttagggcgatattttcaaccataccattatttggtaaaattgataattatatggctatatttaatttattaccaaagattgacatcattaaactaatcctaccaaaattttggcaatattactaatttgccaaaatttagtaaggttcattttgacaccaatataaaatactcttatttcttcagtacactgtaaaaacgtacataattgaagtggtaattaattaccgagtgcatcatatgtacttaatatcctttggttatcaaatagtaccatttgaatttgaaagccccagcagtagtagttgtaagctagataaatagatattttctgtccatataaacgcatccctcatagtttgcactgacaaaataactgtggatacttcacactgggttaacctgggtcctggcgacagctatctattacactataatatctattacactataagtccattaaactttctacaaacgctcttaaaccgtcacatgtcattcctacaaacgctcctatattaccacgtggcgctttaataaatcctagaaattataaaaaaaaagcaaaacatccaaccgttggttttcgtttaatcttgtggacccattatttttaatcatcagatcattataaaaaaactatcaaattaatctatctcaaaaaaatcccacatcacctcgtcgtgtccccatttatctgtagttttgtacgtccgtccgtacatacgtacatatcccctatatgtcttttttctttttttcttcttatatacttagattagatgaaaaaaaacaaaaaagttcatgttaactatatgttttaagttgtaaaaatacatattatttcatgttttattctatatatcacatctcatcaaaacgtccataaaaatattaataaattaaaaatgtagattacatgattgtatatcacttactaacatagttaaattgaacttgtatttttgaaaagtaaaaacaatttaaattgtgagtagcattctaaaaaattactcactccctattgggtaatactgacatgtccaaatgacattattaaatatatcatgaacgtattttcatataatatatatgtctttattcatatatttttggaaaattaacgatcatatttttttacactatgtggatgtccttttatctcttaggcttcattcggtttacctaatcggatgagcttctctaggacacgtgaaacaaataatgtcttcaacgtaagattaattaagtactaaatattacaaacttgaatatggatttgtttgatcttttagaaaactttgcatataaagtatttgtaaaacacacatcattttaatagttcaggaaacatgctcaccataaatgtgggaatagcattttatactatatatttttactaaatatatagtataaaatatattttgtcaattaggaatagccaaatatatcaatcatatatccctactaatccctatataaataagtttcatatataaaccactatccaccaatcatcaagattgcttatgaggtgtctgtgcactgtgcacctataattagatggcatctaataagcatggctgttatcaagtaccgataaaggacaatactaagggaaaccatcaacaaataataggtgaatattgacaccaccaagacacaacaaacaataattgactacaaatagattgtaactattgagtaatataacgttcctacacacctacatacactcctaagatgccacgtgatgctctaagaaattagggtaaatctaacaaaagttttaagaaaaaagtaaaacatctaaccattgatttacacttaaactggtggatcaattattttcagccattagattagatctcttcgagtaatccattgtggctatgactaatagcggggctgtttggttcccagccacactttaccattacttgccaacaaaagttgtcacaccttgcctaaggtgaggtgatcaaattgttagccacaacttactaagcctaagggaatcttgccacacttttttgagccattgacacgtgggacccaatttattggaggggaatcttgccacaactgtggctacaaccaaacacctgtcaaatttgcctaaccttaggcgtggcaaactgtggcaaagtgtggcttgcaaccaaacacacccagcattcctgcactcctaattaatatgtcatgtgacgctctaataatatattagagaaaatctaagaaaaattataagaaaaaaaagcaaaatctagctattgatttacacacataaccatgtagatatattattttcaaccattatattatatctattcaaataatccctcactatgtacgtacacaagcgatgtcataaaagaaaaaaagaagaagagagtgtatatgatcagcccaatcgagtagttttctctttctttcttcgcagctctaagatttttctcaaattgtccatatgagtagcgaccactcctggcgaggttgtcgaagaagccatgccaccgcaacactgcttcatgtcatcttgccaattttcttgaaagtatatttttttactaatgatgtaaaagtcaatcacgagcacatatataaacgtttgcacacccctcataaatacacatatgcacacctacccccaagagaaaaaatatttgtcccaaaaaaggaaaaagtgcagcttagtatttccagaaaaaaaacatatatacataccatcgaaaatatcacatggaagcacattatatctttgtgattatgtcattctcatatatatatataatgttaataattagtacaaataattttgacaataatatatattattccatcgtatattacccatgaacatgcataggtgaatcaaatgtataataaaagaaaaaacaacacaaaaatatatcaactcatatgtttgcgaatgatggtgataaacgtgtttagatataaccacgtcatttcgtactatccttatagtttatgggtgtaatttagtccatttcctttaaaaaagtcacttccatataaggatttaccacttaagaattttttgggattccctttaaaattaatcaacactaaataagtaagttgcccgcgcatgtgcacgggccaccttcctagtttcataaatacacataatacaagaggcagctcaacacaaatcacaagcaatatatataatatgacttctgaagctagaaactagaaatgcaagagccatgaggctagctaataattttatcatcatatgcaaagcattctcattcacacgacaaattgagtttgggcttgggaagcaccgggagacacgaattatgcaaaatttgggataaaagtatttttggacaatgtaggtggttgcgccctcgtgtgccctcaggttttagaatcctccttggcatggttctgtgcgagactgaagtattttgtcctacaatttcttgacctacaatttcttgaccttcatgagcaaatg

SEQ ID NO: 28536 - DNA, 755 bp, Oryza sativa
gaagttgtacgggagccacacttggtgcgggtaatgttcgtcatactcctcttcaccatggtacaagtccttgtacgacggcgtcagagcaagaaaagaagggaggcacaggatggaagctggcacggcagtgacgacgacgacgacggcgagctcatcatggagattgagatggggatgggaccaaggcggttcccgtaccacaagctcgtcgacgctacgaagagctttgcgccggaggagaagcttgggcaaggcggtttcggtgcagtgtatcggggctacctcagagagcttggcctcgccgtcgccataaagaggtttgccaaaaattcctctaagcaagggaggaaggagtacaagtcagagataaaggtaataagccggctacgccaccgcaatctggtgcagctcattggctggtgccatggccgcaccgagctgctcctcgtctacgagctattccccaaccgtagcctcgacgtccatctccacggcaatggcaccttccttacatggccaatgaggtttattaattaactcattgatttagtaattttcgttatgtgcaatcgacacctttgaaattcaattcatctgctaacttggatgttgccacaggatcaacattgttcatggactcggatctgcactactctacctacatgaggagtgggatcaatgtgtagttcaccgtgacatcaagccgagcaacgtcatgctagatgaatccttcaatgcgaagctaggcgatt

SEQ ID NO: 28537 - DNA, 604 bp, Oryza sativa
tgccgccgctgttgggcgtctacgacttcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggacgtctacatcttcaccgccggcttgcctccgtcgccgccgagtggtgcctccgc

SEQ ID NO: 28538 - DNA, 364 bp, Oryza sativa
gaaatgcacccatgcttatatgaatctatggataatctgaaaggtcagttatatgctcatatggttttgtttcaggtgattcattgtacaaaagaaatgacaaagcaaacgttgtgggatgccatgcacattgagcaccctagtatagaagctgtcaaggtctgaatcattcattctcattattttcacgtttcttttcagtcttaatctgctaacagctgacacatcactattgtgctgatgttacagataccaaatgccaatcaattaatctctgaccttagatcaccccattgagcacttgttaacggttaacactcattttcaattgacagattgcaaagtcaatgccaagaatttgtat

SEQ ID NO: 28539 - DNA, 2202 bp, Oryza sativa
gtctgttttagattgctgccgtctagtctttagaggtttagggggtgtttgggtgaaagggtccctctcacaaaaaaaataagtccggactaaagtttagtccttctctcacctaaacacccccttaatataccccttgtctgttggtacttaatcatctccgagtgctttctgtgctccattttgtaaagctggtaaccgcagcaaaaactctgctcgtggttggctttcaatataggccgggtccttgcgacctttccactaaaataaaatctatacagatagataaatacaaatctaactgggaattcaatcatattttttagggtcggctttttttgtgtgtacatgaatttgactatagatgtataaatgaaacctaatatgcgattccagattcatagcattcccaaaaaataaagagcgatgctcggtactctctactcgtagtattatacaactagtagaattgatttgaaccgttgattcataaggacattttagtactttactaacttagtgattagaggtaaggttggtatttaggatattatccactcttcattaaaaaaagtttttgtacatttagatctatcgcttggctactcgacggcacatcgccttccgttgctggtcggcaaatcgtcctgccgggcgctggcggctccggtggccgcgttcacaaggccgttctgttcccttttcttttcaattcattgcccggtttcaaatataaacagagaagtactccctccgtttcacaatgtaagtcattttagcatttcccacattcatattgatgttaatgaatatagacatatatatctatctagattcattaacatcaaatccgattacaccattgtgttcgttgcaattaaatctttataacaatatcttacatgactatattttgataaaagaaatatctatgttgtaaattacttttattatatatgtaagttacttttatcatatatataaattacttttcgatttgattaaattacttattatacaaccataatgttgtgagttgtttattttattatcttttttagtcaatcccataattcgtgctgattaaatttaatttttagatagactcacgtttttacctccataacggatctactttaatgtcatgacaaagttacttcctttttgtcttaagttacttctataataaattatttttaagctttactgaaattacttttatatgtctaagaagtaatttagtgaaatctaaaagtaatttagatatactataaaagtaatttgtaatttttcatcaaaatataatcatgtgagatcttgttgtaaagatttaattcttacgaacacaaccgtgtaattggatcataaatcggatgagtagtttaagagaaaatttcatttgaaacataggtgataggaatatattttctacttaattgatggggactagtcctacagttaaggcatctagataggatctctcgttagcactaaaacgagaggcctcttgatctagattttgccgagaattatcatgtcgccaatagtcggattcttgtagcattcagttaaggaaattaatctatttaaggaaacttatccagaagagaccaagttcgaggaggatgcggcatggcaatttatctagtaattaggaagagtttattagttttcttttatctttaagaaagtgtgtttagtgtccaataagaactttatgtttttcttttatctttaggaaagtttctttcttgtccgacaaggactagtgtctacccatgggtataaatatgtacacccgaggtcattgtaaattatctccacgatcagtacaattcggcgcatcgccaccttttaccttttctacctttttatttatcacggcggaacttggcacctgatacggggctgcattggttctcgatctccggcgaagaggtaagtccaatgttccgccggcttaggcaattgtatcatctacgttggcgttgttcaaggctgcatcagtacattcgacctcttggattgctttggtttggatgatatatttgggttaatgaccaaatttggtaagccatgaactacgttcaacattggaatcaaagcggatttggcagggaatcatattccaagaacagtgcgcattagctaagggtgtcggctaaagactgcatcggatgagatggatcggatagaagatag

SEQ ID NO: 28540 - DNA, 1829 bp, Oryza sativa
ataattgcaatatctagcttgttttatgacccccaatagaggtagtatcggggtttcagccgatcttacctgatttagctattttatactttgtatgcttacttgatatgctaaatctgccctttatattaagatattgttgcattaaagtatattaggcttgttatttgatatattttgtctgatttaatatcttaatatggagtggtatcggagtattagccgatatatgttagatctatttgatcggctatgctataaacatatatataatcgttatcttaaagtatctttaaacataagtgatttatactgtcttgacttgctgttcgatctatcccaatcactcggtttaaatatattttgagaaaatgattatatatcgttgatgtctacagccgatcgagtagatttaactctatattgccttattcttcattgccgatctaataccaataacatcggctcaatgttcgacgatatgtcatcggcccctagccgatcggctatcgtttatggatttaaccttggttttcttgtttttctttcttattgattgtaggatcaaatcaactggcatgcctttgaacccaagagcaagatttacgacctacactggagttaagcagatctcccaggccagtgtgtgtttttcgcatcaacaatttgtttgccaatttatcatatgttttagttaatctagtcttagtatctcaatttagctctatcggttgcctctcgctttagtgtttctgcctgtatcggctaagttgttttactagattagattagctaaggcatttatcaccctgaaaatcagtcaagggcttgatcgtctagatattatgtttcttttcatacttagtgtatgcatcagttaagtttaatctattaagtcgtgcttagaaccataatctctagcctgcttattgactaccaataagggttttatcggggtttcaatcgatgagttatctagacgttgcatcaacttataaggtttgcatatataaattggatttagctgatgacaacaaaggtttcattgtttaatctactcttgtggattttatagcatcagacctccagccgatgtatgctttaaccatcggatcagtatttatcctatcatattattattagcccattggtttttgttggtttatattataactatattttattatcatcagccgattatctttgcattattatctacattgaacatatagccgattgctcaaaaccctattgacatcggctggaatcggcatcggttagtatcggctatcggctggaattactccatcggcttgtcaggcgatcggctatctgatatattgtttacatatcttgtcagttgcaggatcaaactgactgacacacccgcatctcatcaacatcttggacctgcactagagctaaacagatctcctaggccagtgtgtattttctttttacatcaacatgactccaagtgctctatgaaccggattgcatggcctgattattgtcgggtaataggaaaaaaaggggcaattgcaaatttactactaatttgaatcgttattgtaagactgctactagaaaattacaaaaatgccactagatctgtcagtcgagggggcatccttgcaatattgaaaaaaccagtggcaaatttgcaaatgccccaaaaaaatcatgtccaacttacgtatacggccatatgcaaggaaaggactaggaaacaaacagaccgaatgctcctaatttttggtagccatgcacgtacatagatgagaaaagataataactaaaattatctcattaaatattgatcaagtttt

SEQ ID NO: 28541 - DNA, 6842 bp, Oryza sativa
aatttccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgcctagaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattagagatataatcctcacgcttgagttgatgagctcctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtagtgacaaaagcaaaccgacgatgaagacgtagacacgcatcaacggtgatggcgaaatccaccaatcatgaagatgaagaaaataatcggcggcgacaaacgcatccgacggtaatgatgattagcggcaatagagatagccgactatgatgatgaagtttcccatcaacggcagcagagtaggctatgttgatgaggcttgacaagatgttgatgaagatggcgatgtcggtgatccagtcaatagcgatgtagcagccgatgataacgatgagatcctctatcggcggttgcgtagtaggccaaccgtgaagacaaataattggaggagagttgatgttgttgcccaactcgtctaaaccgaaatatttgaagttgttgaagtagaatgtctgctctgaatcaaagatgaagataatgactcctgaagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcaagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaagcaccagtcggcggcggcataatcagtcggcgacggaagatgatgatgtccatcagtagtggtagctgtataaaccagacgtagaggtaagggcactagtcagcaacagacgagacgaccggcgattaagatgtagatgcccaacaacggcggcataataggccagccgtgcaggcggaaacatcagtcggtgacggacgaggcggccggccgatgaagacgtagacgcccaacaacggcggcataataggccagccgtgcagacggaaacaccagtcggcggcgatggaggcaggccggtggtggagtcgtagacgcccaacaacgacagcataataggccagccgtgcagacggagacaccagtcggcggcggcgaaggcaagccggtcggtgaagacgtagacgcccatcaacgatggcataataggccagcgtgcaggcggaaacaccagtcggcgacgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggcggaagcaccagtcggcagcggcgaaggcaagccggtcggtgaagacgtagacgcccaacaacggcggcataaaggccagccgtgcaggcggaagcaccagtcggcagcggcgaaggcaagccggtcggtgaagacgtagacgcccaacaacggcggcataaaggccagccgtgcaggcggaagcaccagtcggcggcggcgaaggcaagccggtcggtgaagacgtagacgcccaacaacggcggcataataggctagccgtgcaggcggaagcaccagtcggcggcggacgaggcggccggtcggtgaagacgtagacgcccaacaacggcggcataaaggccagccgtgcaggcggaaacaccagtcggcggcgtcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataatagaccagccgtgtaggcggaggctccactcggcggcgacggaggcaggccggcggtgaagtcgtagacgcccaacagcggcggcataataggccagccgtgtaggcggaggcaccactcggcggcgacggaggcaagccggcggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggagcaggccggcggtgaagtcgtagacgcccaacagcggcggcataataggccagccgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgggggcaccactcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcggacgagacctaaagtggatggatgcagagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggatggggggcaggattacaagatagaaaccttaaccaatacggtatcggtttcctaaatctattttacaatattatcgaatcaggactttaggccgctccataatataaaaggaaacgtaatacccaagtcatgatcggttacatattccatagatatatgttatcccctattactagtcggataaccatgccgtgtgggtatggggtacccataatctccacactacctatctactgtatcttaactaatataaatattcgtatttttcctttcgtcacctcgtgcatgcggtgatttttcgtcccgtcagcccccccccccaaatcccagtcgaaattccgtatcacacaaatagacccacattgagcacaccttctctctaaaatctcaaaccatcccaatccaaataaaaacttttcaaaattccaatccaaatctaaatcggaatcataaaaaaaaatccaaaataagatgacgacgtcacaacgatttttcgtccataccgcgatttttcttccgtcgcgcacctcctcttcaaatcccacatcatcacaatcctacccaaaaacaaaatctcaatttcaatccaaatccaaatcgtaatcaatgagaggtctcctctcataaaaaccccaaaatcaatcacggcaacgacatcatcatcacataaaaaaaaatagaaacaacccatacacaaccaacaacaccggcagatccggccgcgaggggacggcggcgatgtcgggcagatcctctcagttagatccgtccgcgggtgccgccgacgtcgccaccgccggatccaagggagaagcttggggcggagggggagggggtaggggatcgctagatgtcacaccctgaaaattcaaaatatataaattgttgtttaattggaatttttagaaataattttaaaagtcttgaaaagaaaatctaagtttaattaataaattccaatataaaattgggccagataaaatttcattaaatactttgcttaattctataattcctagatttttctgggatttatttgagctaagaaagtatttgtaataaatggaattgcatttaagaaataatttaaattgaaaaggttttaaaaagtcttcttttggctttgggccgaaagtcggcccaaaacctctcttctctctctcctcggcccagccggcccagtcagccgcgcgcgcgcggcctcgctgtcgctgacaggtgggtcccgcctgtcggagtcgtcgtctaccttcggccgtccccgccgaaaccctagttcgcgccgccgccgtttcctttccaaatccggccgcctctttccttctccgg

SEQ ID NO: 28542 - DNA, 6964 bp, Oryza sativa
aagcgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggattgttgcaacctttgaagattcctgaatggaaatgggaagaaattggtatggattttattactggtttacccagaacgtcatcaggccatgactctatttgggtaatagttgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccttatgcagaattttcatacaacaacagttatcaagctagtcttcagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctttacgaggagttcatcgttttcataccaagggaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatattgagcggatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattgaagtcagctcatccgcacctgtttgccagttcttccgaatctcgaggacgagattctgtttaaggggggtaggtttgtcacaccctgaaaattcaaaatatataaattgttgtttaattggaatttttagaaataattttaaaagtcttgaaaagaaaatctaagtttaattaataaattccaatataaaattgggccagataaaatttcattaaatactttgcttaattctataattcctagatttttctgggatttatttgagctaagaaagtatttgtaataaatggaattgcatttaagaaataatttaaattgaaaaggttttaaaaagtcttcttttggctttgggccgaaagtcggcccaaaacctctcttctctctctcctcggcccagccggcccagtcagccgcgcgcgcgcggcctcgctgtcgctgacaggtgggtcccgcctgtcggagtcgtcgtctaccttcggccgtcgccgccgaaaccctagttcgcgccgccgccgtttcctttccaaatccggccgcctctttccttctccggccgaatcaatagaggggaaatgatctccgggatctcctctacattttctcctttggaatctttggttaaatcgctttggaaagctttggaatcgagttcgattcggatcggttttccctctctccaagccgaaggtttccttcgccgttgccgtcgccgtgggccttcgccgtcgcctccgagcccctttaaaaggacccccggtgtctcctctacccgtcgcagccctcgccttcgcctctcgtcgccggaagagccttagcgccgtgtgccctagcttcgccgtcgccgccgccgcttcagccatgctccgccgtcgctccagctgtcgccgccgctcgggaagaccgccgtcgtcatcgccaagtcgccgccgtcctcgtccgccccttcgcagccgttggaacccgccggagcttcgtcgccgtcgacaacccgaaggtagccgccgcttccttctcgtcgccgtcgccgtccgttgcttctccgccgtcgttttggtcgtcggtgtgttcgccgtgtcgtccgcttcccgtcggtgtcctccgttcgtgccgtagcgccgccgttcgccggtgagcgtgcgccgcccgagccgtccgctccgccgagccgccgccgccgtcggtgacgtcatcgctgacgccatcggggtcgtccgccgtgaaccgccgtggactcgatcaatctcggccgtccatcttggatcggttagatctcggccgtccgttcgcgtgaaccgccgcccgtgcgccggtccaccgaaaccctagccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatttacacattaaaaatatccacatgtactgttcatgcttgtttatgtgctgttttggtgattttgcttctttttgcttagattccgtcgtttctggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacatttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatgggacattcctggtttggagatagaactgtgcagccggggtggttgttcagaatggttgggcctatacaacagggtatgttgtatagcgttgtattaatattgtttaattattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattgcgtgacactagatccgcccaccaaaaagaacgccgccgccacttctgctggatctgcccacgggagcaccgatgtcaccgccgctgccgcaggacaagcttgggcgtggagggtgaggaggaggtggtagagaatcgcccgccggatccgcctgccggaaacaccgccaccgccaccgtcaccggatccgccaatagtagccgccgactccaccgccactcccggatccggcccgcgggagcagctgaagccatcgctgccacctcctctgctaccggcaagggagagacgagagggagagagagggaccggtgggagaagagacgggggcggcggcgcggcgctctctctaactctcggctgttggcaaaggaggagagacggggattcgggagacggagaaagcgaccagagagaactgagaagcggaggtggaggatttcagagaaggagataaggttcgataggtgggcgggtccataccaattttttttctttaccgcgctccaacatgtatagggtgcaggggcggacacactaacgttacccatatttttaaaatgtagctacacaatgtagcacaatgtcgatgattctcaattggttagactgaaacatttgaccaatagttcatgagttcgattccatcgatctcttcgttttttccattttatccaattcctttcctaacctgatattttgctggttatcctctactgttcttttcccttttctctctaattttatccttttcctttaaaataaaaatgattattgcaagaacatacatgttatcctctactgttcttttcccttttctctccaattttatccttctcctttcctaacctgatattttgctggttatcctctactgttcttttcacttttctctccaattatatccttttcctttaaaataaaaatgattattgcaagaacatacatgtagaatagaatacgaggttaactaaaattcagaaaaaataaaataagctccaaaaaatagaaaaataaaaataagagttcacgtagaaataaaattttcaaataaaaaaggaatgaaaaaatacaaaattgtaaaacaatagtccattaaaaaaatacaataatagcaaatgataataaagagaagaggaacaacagacctataaagcaatagtgtggtgacggttaatgggacatctgatgaaaactattaacaaaaccgaaaagatgattaggttcgatttttagaatcccaacgatgattaagaagaggaactacgggcaagtcgttaagcaacactgtaatggcggttagtgggctagaaagtaaaaaataactaaaattcgaaattaaaatatgtaatattgaaagaaaagtccatgtaagaacatttttttcttttttcattgtcttttgctgtttgcatattggcctttttttcattgttattcacaggttgaatgaacgtcacaaattcacagatcgaatgaacatactcaaattcacatattgaacatcacatatcaaatggacaccgcaaattcacaaatacatctaaaaaatgttcatctaactatttttctattttcggaatttattttatttgttattcaaaattttaattgatctcgtcatgtgttttaaatggtctcttcttttaatagatttaattttttattatgaatttttaatttgtattcctaactaaactcttatttttctttttaaaatttcatattttattttatttttatttagaattttaattaatctcgttttgtgttctatatggattattcttttcatattccttatttatttttttcaattttagttgtttcaaaattatatcctacttgaactctcttttttatttttctaatttcagattttattttatttttagtacaaattttaattaatcacaatgtgtttttatatggacttttctttcaatattacttattttaaattcaaatttcagttatttttacattctagcccactaactgccattaccgtgttgcttaacgacttgcccgttgttcctccccttaatcgtcgttgggattctaaaaattgaacctaatcatcttttcggttttgttaatagttttcaccagatgtcccgttaaccgtcaccaccctattgctttataggtctgttgttcctcttctctttattgtcatttgctattattgtattttttaatggactgttcttttaaaattttgtatttttttcattccttttttttgttatttgaaaattttatttctatctgaactcttatttttatttttttattctttggaacttattttattttttctgaattttagttaattaacctcatattctattctacatctactgttctctcaataatcatttttattttaaatttctgttatttctaaattgtattcttactctaactctcatttctatttatctactttcagaatttattttaatttttattccaaatttcaattaatctcat

SEQ ID NO: 28543 - DNA, 27345 bp, Oryza sativa
  unsure (1)..(27345): unsure at all n locations
ctagcagacacatgaagaaataaaattaacaaattttattatttttatttttctagttgtagatcaaatagaaacttgcatgtttgtgtacagacttatatcatcacaattgatgttactaatttttttattttttttaataactatttaagtcgcacataaatgttgggtgtcatgacacctaggtacagagaatcctaatctctttattgtacccttcctttttttgctttgaaactacactttaagactttgttcttccacggggtaatgaagattggagaagatgaccagttcgaaactgcactaaaagttccagttcacctatctttgttacgctggttgcttgacgaaacgagagcatagcagcagtgtatccaaagtattctgcaaattgagatctattgttctgaattttagtatacttatatgattattgtgatcatgttatacacatttagatcttttagactgaactaagtaactaaccattctcaggggcggatccaacgtggggactcgagtcccccctacacccacaagacccatggatacccccagagcaccttctttaatttttttcaccataaataataaactaaaggtctttagatggctaaaggttagagaaacaacgtacttgaggccccccaattttctgttgctggatccgcccctgaccattctagatctcagccagagatggggatgaattaggacaaaacaatgtttcggtagtaatctatgcagtcattggacagcattagctgaatatcatatgagatctatcaacaatgaacacatgtcttgcaagaggtctcttctgttggtgccttcgatcattctgttttgttaatatttctgagtttcttacaactccaacatttccaggccctctgtaaggactaggatatcgactgaaaacaagaaaagtatgtaacaaatatcagttagagatatggactgtttgattggattgttggacagaggatgtaggaaaagttttctggacaaaataaataaatgcttggaaaactgaaagcgtcatgtaaactaaacacattgctcacattgccaattaggcagctctctaaagagcaaaccaattgcctcacgagctgtacatatcccattcaagcgtcaatttgtaaatgtagaacaagtaaaatgaactaaacatgactaatactcctgtatggagcaattaacgaagatgagtccttcaaaccaacttgtgggtatggataaaaatctatatatgacaataattgtctcgctatataaatcctatgagtgagaaaacttgcaaacctagcgaggtgtgatggatgttagtgtcaaacttgaggacgacattcgtgtcgatgatgagggctgcccctccgctgaggccatcggcggtgcatatgttggcacgggcatcttagctggtaacacgggtagtggtccattggattggagaactgccatgacagctctgatagacggacgtgcacatcggtctggatgtgcacaccaaagtccaacggccatgacacactccatgctagttgtgtcgtattcattgttgagccgctcgtcggctgcattgagaacggctccttggccgtacagatcccacacccattccaccagtcggaagaggcaattgttttgggtgtcctgtaagctaattggtctcctcccacatgccacttccaatagaacaatgccaaaactataaacatcggactcggcgcttgctttgcccgtgattacgcattcgggatcaagatagcctggtgtccctgaggggtgagtcattgtttgtatcccaacggcatggtcaataagccttgcaaggccgaaatcgcctagcttcgcattgaaggattcatccagcatgacgttgctcggcttgatgtcacggtgaactacacattgatcccactcctcatgtaggtagagtagtgcagatccgagtccatgaacaatgttgatcctgtggcaacatccaagttagcagatgaattgaatttcaaaggtgtcgattgcacataacgaaaattactaaatcaatgagttaattaataaacctcattggccatgtaaggaaggtgccattgccgtggagatggacgtcgaggctacggttggggaatagctcgtagacgaggagcagctcggtgcggccatggcaccagccaatgagctgcaccagattgcggtggcgtagccggcttattacctttatctctgacttgtactccttcctcccttgcttagaggaatttttggcgaacctctttatggcgacggcgaggccaagctctctgaggtagccccgatacactgcaccgaaaccgccttgcccaagcttctcctccggcgcaaagctcttcgtagcgtcgacgagctcgtggtacgggaaccgccttggtcccatccccatctcaatctccacgatgggctcgccgtcgtcgtcatcgtcacgccgtgccagcttccatcctctgcctccctccttttcttgctctgacgtcgtcgtacaaggacttgtaccatggtgaagaggagtatgacgaacattaccacgccaactgtggctcccgctacaactccgccacgtctggaagtcggtggtggtgacggtgacgacggcggcggtggagatgctacttctgctgccagcttctgctcgaacgacgaagtcgacttgaagtaccaagaagtcagctgatgctgctcataggctgagccaattgatgccgagaagccgatggtgacgttctccggcaaggctctcttgagatcaaccatggagctaagggtgtaaggcgtcgtcgtctcatttatccatagcttaattgacagtattctcgaattgttgttgtagtcgacggtggcggtcatgttcccgatgaggctgaagtttggtagggactcgttcgtcacagatacgacggagttgacgtcgatgccgatgtggtcgttggttgtgttggggtcgaaggggttgacgaaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgataatgttgaaggagaagcgcgtggtgaagctggccacctcgccggtggcggcgtcccagagctgcaccggcggcgcgtacaccacccgtccggcgctgttgcccatgcccgacacactgttcgcgcttatgtcgacatacccgacgctgacagaggcttggccttgaatgtcgatgttctgattgtctgaggaggcgaaggtggggtagttgaaggacaaggcggcgacaggagccggaggctgcatgtagcagacggagaagaaggtgacgaggccggcagcgcaagtgatcaacgaaaagccggccatcgccgccggccagagccagcgtcggcgcgcaagccgcaaggtgggttgatcggctggcttgacttggagcaacgagtcgatgcacaatgcgtacactgcttgtagtgcactggcagtgaatggtgccccttctccctggaaaaaaaacccttctttttgatggagctatgtgaatgtggaactatggaagctggactacaataattgtctttgtcgagctgaaaagaacaataccccaaaaatcaacgatgctgctacaatctccatgatccatcggagagacggagaaacatgcataattgtaagtaaatcgtaatgttcagacttgagagatattcagggttgcctcatgcagtcgtttgacgcagaacaagagcccagcggtcagtcaatggcccagcttatctgaaactatattgtgccaactccactgatcgatcgatggagagtgatgcggatcgcagaaagactttaaagactcccctttggccgtggagtttagtctccgcaaatttgagctttgttgtcatctagtacaaccgatcgaagaccgaattaagtgctgagttccagcttgcagcatacacgcacacgaccgtcaccgtgttgaaaaagacagtgaactctctactgacagtatgagctttcaattacttttcgagaccttttacggcaattgcgaggtatttaaaggtatctggaggtggaacaacgtgtacccttaatcaagagaggggcaaggtacgaaacaaaattattgtaacatgatggcaatggagtaattaactagtaaaacatgggcattatacatgaattgaatacctatatccatcgatcagtatatcattgtgcagattggtatgtcgtgaggaaaaaaaagtaaatcacggatacaccgttgatttagcagcgatcaattcgatctgtaccaaaataaacagaaagatcgcatctcctttcttctctcccttcgcttcgttcttgttctagggtttgaacggttcaacggaaggagacagaggaaaaagcgtctgcatggttgagggttgaagaggagatgaggtagcccggtcgatgactaggcgcaagctagcgcatctaaaagttatcctatgcttattcacacagttgtttagttatttatgtagtttataaactccttatataaggtactggaatttctgtgggatagtaaatgagatctccgcctatggtgttcttctagtgtttgaacaggtgcactcacgaggagacacggtcgaggaagaagatctggcatggtcgagcatttgacaggaggcaagacctgattgacatgtgcaggttataagaacccaacgtaaatctagagaaaaacacgtaaaagagaacatcaaagagcggtgtaactctagataaaatgatgcaacttaagaacctgtaatgctagtgccgactaaacgacttaactcaaacacaacgtaaatcaaatctagagaaacccacataaaagagaaaatacgcaaataataacatgtaaagctggtaccggggaaattaatgttaacttcgtacgggagtacctagcgggacccgattctaattttgaagacaattctaccctttttgctctaatagtaaaattatatttttatctttagtacttaagtacctataccaatagttaaataccttttacatgatacctatgattgaggagtgttggatcttataccttttttggaatgcaaacaccgtaaaaaagcctatcagattttgttgaggaaattgcagcagtaaagccactgctgaccctatcagaaccaactcttctctttcaaattttggcttgatcactctgtgaagtagcagagatgtcaatcttggacgatatgcttgctgcatgaatctcttatgtcttaaatctggcaattggctgctgttatttttgtgtgttaacaattttgcttcgatgttctcgattccgcgttcaatcaacaccggagtactgaacataaatatccacaatttgagacgattgcataagaactgcttcagtagaaaatgattggaggctctttgtgctcttgtttacagtagctagagcctatattctatttattttattaaatttagcttattaattatatctaggttcctgttgtttatcgacgaaaagcctgtgatggtagtgttacctatcttggttcctcttgttaacgccattgtgttgcatgttgtttttcctctttcttgtgcctttacttttcggattgagctttctcattttgtcttgaaagttgaaacaatactttagactttgttcttccacggtaatgaagatttggagaaagggaccagttcgaaactgcactgaaaattccaattcacctatttctattacgctggttgcttgacgaaatgagagccaacgatagaagcaacatgaatgaaacataatgtatcaaaagtattctgcaaattgagatatattgttctgaattttagtagtgtgatacctatatgatttttgtgatcatgttatatacatttagatcttctagactgaaaccattctaggtgttagccagagaagggaatgcattaggacaaaacaaaagtttaagtgataatcaatgcggtcgttggccagcattagctgaatatcatatgagatctatcaacaatgaacaaatgtcctgcaagaggtctcttctattggtgtcttcaatcattttttttttgtttatgtttctgaatttcatgcaactccaacaattccagaccctctaaggactaggatatccacttaaaacaagaaaagtatgtagtgaataacagtcagagatatggacggtttggttggattgttggagaggaaattgaaggaaaagttttctggacaaaataactaaatggttggaaaactgaaagcatgatgtaaactgaacacaattactcatgttgccaattaggcagctctctaaagagcaaaccaattgcctcatgagctgtacatcctattcaagcggcaacttgtaaatatagaacatgtaaaatgaactaaacatggctactgtacggagcaattaacgaagatgagcccttcaaaccggctaaagtatgcgaaaggaacttgaggtgtagggatgcaagtagttcgacttgttggtatggataaaaatctaggagtaaatttcacaaaactacaggtattttgaccaaattatcacaaaactacagatttaaagagctgtatcacaaaactacacatttaacaccaaatttatcacaaaactacagattttaggttaactatcacaaaaatgcatatttaatattgaacttatcacaaaactacaacttttagagtttaaatccctagcactattgttatggtggagctataaacattattactttgtgattaaattgattctaaacctgtagttttattataatttagttactaaacgtgtagttttgtgacacttcatcttaaatgtgtagttttgtgataaatttggagctaaatgtgtagttttatgatacaactccttaaatctgtagttttgtgatagtttggtcatagtatctgtagttttgtgaaatttactcaaaatctagatatgacaaaagttgtcttgctatacttatcctatgagtgcgaaaacttgccaccctagcgaggtgtgattgatgttagtgtcaaacttgaggatgacattcctgtcgatgatgaaagttgcccctccgacgaggccataggcggtgcatatgttggcacgggcatcttggatggtaacactggtagtggtccattggattggaggaccgtcatggcagctctgatagatggacgcgcgtatcggtccggatgcacacaccagagcccaacggccatgacacactccatgctggttgcgtcatagtcattgttgagccgctcgtctgcagccttgagaacgactccctggccatataggtcccagacccattccaccagtcggaagaggctattgttctggttgtccagtaggctcattggtctcctcccacatgccacttccaataaaacaacgccaaaactatagacatcagactcagcgcttgctttacctgtgatcacacattcaggatcaagatagcctggcgtccctgaggggtgggtcattgtttgtaccccaacggcatggtcaataagccttgcaagaccgaagtcgcctagctttgcattgaaggattcatccagcatgacgttgcttggcttgatgtcacggtgcacgacacattgatcccactcctcatggaggtagagtagtgcagaaccgagtccatgaacaatgttgatcctgtggcaacatccaagctagctgatcagttgaatttcaaaggtgttgattgcacataatggaaattatgacaaattaatgagagttaattaaaaacctcattggccatgtgaggaaggtgccattgccgtggagatggacgtcgaggctacggttggggactagctcgtagacgaggagcagctcggtacggccatggcaccagccgatgagctgcacaagattgcggtgacgcaaccggcttatcaccttgatctccgacttatactccttcctcccttgcttggaggaatctttggcaaacctctttatggcaaccgcgaggccaagctctctcaggtagccacggtacacagccccgaagccgccttgtccaagtttctcctccgtcgcaaagctcttcgtagcgtcgacgagctcgtggtacgggaaccgccttggtcccatccccatctcaatctccacgatgggctcgccgtcgtcgtcatcgtcactgccgtgccagcctccatcctctgcctccctccttttcttgctctgacgtcgtcgtacaaggactgctaccatggcgaagaggagaatgacaaacattaccgcaccaactgtggctcccgctacaactccgccacgtctggaatgcgacgttatcggggtcagggaaggcggtggtggtgacggtgacgacggcggcggcggagatgctacttttgctgccagcttctgctcgaacgacgaactcgacttgaagtaccaagaagtcagctgatgctgctcataggctgagccaattgatgccgagaagccgacggtgatgttctccggcaaggctctcttgagatcaaccatggagctaagggtgtaaggcgtcgtcgagccatttatccatagcttaactgacagtattctcgaattgttgttgtagtcgacggtggcggtcatgttcccgatgaggctgaagtttggtagggactcgttcgtcacagatacgacggagttgacgtcgatgccgatgtggtcgttggttgtgttagggtcgaaggggttgacgaaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgattatgttgaaggagaagcgcgtggtgaagctggccacctcgccggtggcggcgtcccagagctgcactggcggtttgtagaacacccgtccgacgttgttgcccacactgttcgcactgatgtcgatatacccgacgctgacagaggcattgccttcaatttcgatgtactggttgtgtgaggaggcgaaggtggggtagttgaaggacaaggcggcgacaggagccggaggctgcatgtagcagacggagaagaagatgacgaggtcggcagcacaagtgatcaacgaaaagatggccatcgccgccggcgagccagcgtcgatagatcgtgtgcaaggtgatactgatacagtactgtgatactagtactgtgtactgatcggcttctccagctggaggagcaacgacacaacttcctatactgccagtctgagtctgtatttgaggtatcctccattggacccgttctcggcctggcgcgtgacgacgaaacaagagtaagtcaaaccacatgccactaaagtggagtattcgtttcgtacttatggtacaatgtcactgaactcttcaaataattgatactagcatatattactgtctgtgtctcctctagcactaaaataaatatagactgtagccgttgtgctccccaccggccgtggcccgcggtcgaccccgtaccgtacacgctcaccctctagttactgattggactaactgtatttatggcgtcatatttttcattaaaaaatagtcgatatgtatttatattgtaagtctctaaattacatatgtaattttaatgtatttacaatttaagttctaaaattgcatatgtaagtcttaaaattacatatgtaaatcttaaaattacatattaaccatatgtaaatgatgcgtaagtggggtgtaactagtatgtaaatttgtataaatatataattacaacaataaagtcaattgactgctacaaacccatagcaactccggatcaacaaataaagtaaaaaaaatgcaaagggataaacaggtggagaaacggatgtgcatcgtgcacacgatgtccagcgcagcgcataccagccgttaaaatccgactgtactcagccacataatgtggcgtcactttttcagcaaatccgttttaaaattagttttttttctccactatccatctagaaactacaaaccacataatctttagctgccctttggcgcattttgtttggtgtttctgtagagatgtgctgaactgggatcatgttcctcttaaccttggtgacttctttatccttgctgacattagagctgaattaaacatatagctgtgaaaattgccctgcttgctgccatttgctggactctatatatggacaacgagaaacaacatcgtgttcagggataaacttgtttactcacccctaatactacctttccaaattgtctctttcttattgcagtggagtcctttgcatcggctggagatgaagagtgatctagagaagctggtaaagaggtttaaggagagaggagctgctctaagacaaaacagaatacgagttgattgatcttgctagccccatgcaatgttttggcgtttggtttgttttagattgctgccgctttttttttaacgagacggtgcgaagttctattgatagagcaggaaaaaattacaagattacaaccttggaaggtcgtaaccaggaaaaaggaaaaaaaatatactaccacccacacaccgacagcgccaacacacagatccgggagaaggctagcaccggaccggccaccgctaagcgtgaccgaccaccgctaggccaacaacgggacatagacgagatcgcccaaaaacgcccttacaaccaacacaaagcccgactctattcacgtcttccggatttaaggagagggggtgagagaaaagaaggaacacctctccccctagggcctccgacgtgaccaacttgtaggaactaggatgctgccgcaagaggatgagaatctagagcgtgcttgcaccaattgctcgagtgatttcggcaaggggatacctaaacgacgtctccaaggagagaagcgatggaaaaccaacgccaccatccgtcaaggtctcaaaagagccaatactgggcttttgcccggcaaccacccttgaggggtgagacggcacgacaacgccctcaggagggagaatgacactcgagcactgatgctgggttttcacccaccgctcaccacctgcgagtccacggctgacgcaccgatgctccaccgaccgcccaacctctccgacatgtgggaccactgcatcagcgccccctgcacagaaaaatcgattttcgtgtgcaggcctcttaactggaacgcatgcgaaaatttcaattttcgtgtgcggctctttaagaggaccgtacggaaaaatcgattttcgcatgcggtccacaaatcgattttcgcgtgcggtcatattaagtgaaccgcacgcgaaaatacctctccctcgcactcacttcaaatttttcacacctcctctcccttcctttactttttattttcactcctctctctctgtctctcactttccttctctatctctttctccatctctttctcttctccactccactcctctccgtggctggcgacgaggcgcgtcgaccgggtgggcgcgccggcgagcggcgaggggcgacggcaaccggctcctaccaggatccggccgcggcggccgtcccccgcccggatccggtagcggtggcagtcggcgcgacggtggcggcggcaggcgagctcgacggtgacgacggtttcgacggtggcaggctcgatagcgatgacggttgcggcagcggcggctgggtgcggcggcggcgcgacgacagcgacaacgccgggagtggcggcgggtgattccagggttagggttaggattttttatttttttattttttttttgtgcgtgcgggcggtataatttgaccgcacgggataatcgattatcccgtgcggtccacttaacccgaccgcacgggaaaatgattatcccgtgcggttgggccgcccgcacgtgaaaatattgattttccaagacccctgagtgcagatgggcaaaacctctgtacggaaaaaacccatttttaccgcacggaaaaatgcttttcatagtagtggctccgcgtgaccgcaaggacggcggcagcggggcttcgcgcaccacgcgcttgtggcggccgggggagcctccggaggtggcggcggcggtagctttcccatccagatccgggccggcactggccagatctagcggggcgccgggagctagcggttggcggtgggggaggggttggcgccggggctagtgacggcgcggagactggcggcaggcacgggtggcgtcgtggtgggtgggcagaggccactcgcgccgaagttgcagcgtcggcgtcggcgttcgtctgcgcgggtccacagaggtggcgctgcgcaggcaggggctacggcggcgtggtggttgcggcgacgatggacggctgtggcgcgcggacgtcgaagccggcttgctccaccctggatggatctgagcgttcgtggccgaatccgtcgcctccgcgcttgatctggccagggcagccagccagcggggcggttgcgtgtggtggcgttgcatggctcgggtgagctccgatgagctcgatggctgcactgcgtcgcctaggcaggttccagtggggttgctcgctggcgacgagcctcttgctcgcgatgtgcggatgtggagttggcgggacgttggcttgcgttggcatgaagcaggaatggggcttgacatccacggcggtgtcttcctcgttgccggccgagtgttctccctccttttggtttccaccttctttggccagaccctgttctggttgtggggaatgctagggggagggcggaggctccaacttgctgtaggaatttgcagcggattgatggcgtttcgagggtggccaagggcacatccttgccgttggttacggtcaaagtatgacttcttgtgagacgccatggacttttctgtggccgtcgatgtgggggtgcttgtgtgggtgatatgaagacactagtgaaagccttgtcgtgcctttggccagttcgacgatgacgacgcccgtgggtgccgtttcccttcttggaggcgtcgtcatggcgttctttcatatccctcacaaatcttcaggtgaaaaaattgttccggatttcggacgagcggcggcggaattacgcgtcgtgtcctccttggaggcatcgtttcggagaagttcctatgcatcgacgattgttgatggcctttttcggttcaaaagctttgatactttaatgttcggcgaggccttcgccttcttaggtccgcttcgttcttgtggtgggtgacactctcttcggttgtttctactgatgaagtcggagctgctcgctgatgaggtgcggtgacgcttggcaacggtgacatgttacagtctcttccaaggagttggtgctagtcgtgtgaaggaagtggctctttgatggcttggctgatgtccattgttggataacggagctgcttttcgatcgctttggcgactttcgtggtttcagtgtcgctgcggttgtgaagtcggcgctgctgggtcgcttgggcggctagctcggcaacgataacacctcttctgcaatgtcggagctgtggtatcgcttttgtgtttagcttggcagcgatgtcctgtgtttgggctctgccgtcattgttagttgtgtagctaggtctcttgcttttttctctacggtgggtttcagccgatttcccataattaaccatgtagttgtatggtttttgggcccggtttcccttataaattaggtcaattctcttcttctaaatatacaagctgggacaaagttccacctcagttttgaaaaaaaaaacaatgccgcgagctgatcgcgaccgtaatttgtccatgcatttgtaatgctcggactcgaactcgagagatattagggtgttaaactaatgaatgtccatttttcttcagggatgtaaaatggatatttctcttaaattaatgatgtctatgtagagagcagaccaagaaaacatagggttttgattacgccacaagtgaaaattaaactgattactgtatcaccaagacacgtactcgtaagaattagccatacaaacaacaatagtactagttgtatgcttgcaactccctacagttccacgaagataccacaaatcaagaataaaggggttctttggatgccactctgtttattctatcagcaaatttgacaatgccacacttgtggaaaattttgactaaaaaatgatcaatttaggtgtgggtgtcgatggattatatctaatacaagaggtatacctgatccgtaatattgacagtcctgattgtcaaaaaaatatatgacatattattaatgtagtagaaccaacaaacgctaggttaagttagttaaatgtgtataccacaagtgtaacaaattaaagttttgcactcaatcaaacaacgcctaaggacactattggatcaagagtgatgtgggaatgcgcccccctgggtgtgaagaaaatagtcttccgctaatttgcgcgttgtttgcaatctggaaactgaagaccgggagtgggtccagcttaagtcaagggtatttagataaatactcaagattttgtatttaaaaataataggtagatagatatactatgtgatgcatgtgtaccaaaacaaaggttgtattcaatccaagaggttatattaaactcataatacgtatgtgatatatatatatatatatatatataggacactcatatggggctccatggtgcccaggcaccatggtatgaaatacacaaattcgcccaaatttttcaaaattttcaaattgtgagtatatatctagttataagtattcgattcatacctatacctagcaataaaacaactcaaatttatctttatttcataatccaatattacatacctaactaattatatgtttggatgttatatacctagaatcaaaatctaacatattacatgtttaaattcagttcaaacttgtttgaactagttagtaaagtagttaatgttaatacctaaacatttaaaaaaaattcatgctcatttgaattgagtatatactcaatttgaatcatggagcccgggcaccatggagcaccaaacaaatttaatatatatatatatatatatatatatgtatatgtatacatgttatattttttttgcagggatatatacatgttatattaggcttctgcctacaagtttattttaattaccccctcatattttgaataaacaattaaccttagaatcctaacccggtcctgctaaagaccgaaacgcttagatctatactatagctttggagacttggacagcgttcgtttgggtgagtttgagggagaaaacgtatcgttttccgcacgatggtacgtttttttaaaaaaaaatctataggaatgttgctttaaaaaatcatattaatctatttttaaaatttaaaattgttaatactcaattaatcatgagctaatagcttacctcgttttgcgtatcttcccaatctcctcgatttccttctcctcgaacacacctttggaagagatgagtcaaaatacatgtatacagtaagtccgtccgtacgtgttgaaaaacaagaaatggcctgttgggccatatgcctgaacgaaatactccaaacgtggcctgttccgctttttgcgcctgtcactgcgggcgaaatgcaaatatgtaccttcaaactgctggccacttgaattttactttccagttttatcactgctggccatagctgcatgttgctatagtggaggagtataatatcgttcacttgttgtggcgattggatcagcaaatcaaggagtaccaaccatccaaattaatcacgcgctcactcggggtcgtagctgttgctgtttcgtgttgagcaagagaatatccagactttaatattctcttgtttgtgaattgtgatatcacctgccagctgggtcttgtcaggtcttgagcaagctcggcatcatgaaacgccttgttgtttaaatgatcgatcgaacactgtctttgctaatgtacaattgtgtgtataggaaactcggcgagttcacatgcgagtgccaggatcactgcatcgctataactgaacacctgaaaatgcatagatccattgcatccgttgcctctactctactgagcggatgaaagttaaattggcgcacgtaaaaaaaaaagctattagcacataattaattaaattttaattattacaaacttgataaatgtatttatttgatattttaaagcaactttttatatagaaagttttcgcacaaaacgtaccgtttagcagtttgaaaaacgtgctaacgaaaatcgaggtaaaatctgtatgtgtgaaaaatgctagtggttgattggttagaattaatggtactgcttttgtttgcatatttttttcttgtctaatgatgaaatcgtttgctttgttcgtgagagaatttatatgtgctacatacccaatttggtgccgaatgctcattaacttgcctctacggctctacctgtgatgttccggtggccaaattatattttttaacgaatcgatatttagatggtgccaatttcatttaatagagtagaaaaaatatataagaaaaggaaaagaaagcccgaaaccaggtagcaatgctgcgaggtgttttgctaccccggacccaagtcttagcgaaccatattttgtcgcgtttgaacttaattacgtgtacacaatcttccacggcatttctctcaactttttcaccaggccgaccaaaagttgacagccagcgttttgcgccgatcatcgtatgagatctatcaacgcgatgaatatgtagtcctgcgagaggcttcttctcttgataccttcaatcatttttgttcttttgtttttgagtttcagttattgcaacttaaacaataaatgagttaacccacaaaattgctaatttgccatgtagatctctgcctgagggcgaggaagagaagaatatattcttaccttatcattgactctagacaaacgatgaaggactctaggtacaatatatgcaatgaattttttttaagcgaacgattgcaggagctctgctggaatttttagtaagtgagaaagttcaggttaaaaaaaggttacagggatccggagtaaaaaacaccccttttagaacaactggagaataccgcaaggtaagctaagaaaaactatcgacgaactaggcggttcaaaaatgaaatgttgctctgccacgatgaaggactctagatacaatatacgatgaaaaaatatatatgatgaaaagatggtacaccgaagtaaatttggaaatgatggctatatttgtggaatggttccttgtgtaatgtggatgacttaggaatcgagtcaagctcaatatagttgaacatgccctaaggaataggacatccactaaaaacaaaaaaagtatgttgagaatgacagcatccactgaaagaatgaataaagcgtagagagaaaatgacaggaaactaaatggttggaaaattgaaaagcatgacgtaaatgcatgtacgtacattactcacgtcagcactaggcagctctaaagaacagattaacggggtcacgtgctgtacataccattcaacgatcaactctaaaataagagcaaatcaaatgaactaaaaaaacatttagcaccatcttttcacttatgattatgtatgtaaaccaaaatttaaattttaaaacttagtttttttaaaaaacaagtgtgttttggttttatttgtgatggaaaattggtgagaaaattggaaaccatgtaatggtttttggttgaaaatttggtttggaatattggcgattatcggcgtgagtgctgcaatttaaatctctaagggtttgtttagattggtggattatcacgggatttttggaggaatactattcataggattgtttttcccttttaataccattcggatcacaaaaaccaatcataagaaggtcgcaggaaaaatttcctttacttttgcttccatgggagaaacatttgaaaatatccatccactctaatctcttttttcattttcttcgtgttggaacgaggcaatcaagcattaacaaatgcaaagaacagagaaagaagaatcagcgaagaacagagaaagaaaaggcagatctcacatgattggaaacatatcctatgcacacaagcttccgtatacactccatgcacaccaactagcagatgtcacagaaaattttagaaaaaattggacacatactcataatagtattacacatatctgcaaagtctcatattcaaattcattatattttagtcgtaacaataaagtgaaaaatctgacagtttttagggtaaaaatctgtcagaattttgtttttttgttacggctaaaatataataaatttgaagataagatttcacacgttggtgtaatactattggaagtatgcgtccaattttatctagaattttatgtgacatttgctagttggtttgcacggagtgtgcacggaaagcttttgtgcataggatatgtttcccatatgatttctttaaataagttccgtacaggaagcaaagcccatacgacaaagaatcccaagagcaaacaagagcaaagaggtcacgcgcagaggtcaccggcaacggtatcgaggtcagcttccagtgtggagctaatgcggcgcgtggcgtgcggaggtccccggtgacggattgaggttggcttcggtcatggataccgcgcgtgaaagttgccggcgacggatcgaggctggcttctggtgtgtagtggatgccgtgcgcggaggttgacagcgacagatcgaggccggcttctagcatggagactggagtggatgccacgtgcggaggtcgatgatgacggggatcgagagcagcaggccaacatccagcgtggagcagcaggctagcatgaggtaccggtatctcgaggtactttttgttggactggagcaaaatctttttctcctatcttacgtttttcctatgctataatccgaacaagccctaaactagatttcaccacgatagcaagatctcaggccctcctgagaaaggatccctgcccatagctaggtatccacaattttctatctaatctgaaataagaacacgaagtagaaaaaaagtgcacttataattaaatgatgtggatcaatgtgtaccatgagtgggcaagcgtacatccctaacgaggtgtgattgatgtttgtgtcaaacttgaggatgatattcctgtcgacgacgagtgctggccctctgatgaggccaccggcggcccatatgttggcacgggcatcttggttggtagcatcggtagtggtccattggattggagaactgccatggcaactctaatagatggacgagcgcatcggtctgggtgagcacaccagagcccaacaaccaagacacactccatgtctgtcgcgtcgtagtcaccgttgaggcgctcgtcggccgctttgagaacggctccctggccgtaaaggtcccatacccattcgactagtcggaagaggccattattctggtcatccagtaggttcattggtctccttccacatgccacttccagaagaacaatgccaaaactgtacacatcagattcagcacttgctttgcctgtgatcacacattcagggtcgacatagcccggtgtacctgaggggtgggtcatcgtttgtgctccaatagcatggtcaatgagccttgcgaggccaaagtcacctagctttgtattgaaggattcatccaacatgacgttgcttggcttgatgtcacggtgcacaacgcattgctcccactcctcatggaggtagagcagtgcattcccaagcccaagaacaatgttgatcctatgacaatatccaaggtagttgatcagttgaatttcaattgacatttgttgattgcacattgcaagaaataaaaaaaataaaatctgaaatattaatgagagttaattaattacctcattggccatgtgaggaaggtaccattgccatggagatggacatcaaggctgcggttgggaacgagctcgtacacgaggaggagctcattgcgaccgtggcaccaaccgatgagctgcacgagattgcggtggcgcagccgacttatcaccttgatctccgacttgtactccttcctcccttgcttggaggagtctttggcgaacctttttatggcaacgtctatgccgagctctctcagattgccacggtacaccgcgccaaaaccgccttgcccaagcttctcctccgccgcaaagctctttgtcgcgttgacaagtatgtggtatgggaaccgcctcggccccgtccccatctcgatctccacgatgggatcgccttccgagtcgtcctcctcttcctccctcatcttctttctctgacgtcgtcgtacgaggattgctaccatggtgaagaggagcacgatgaacagaattgcaccgacggtggctcccgctacaactccgccacgcgaatgttgtcctgtcggctgcttctgctccaacgtcaagttgaagtaccaagaacgcagctgatgctgctcaaaggatgaacccgtcgccgccgagaagccaacggcgaccttctccggcaaggcgctcttgagatcaatcttggagctgaggttgtaaggcgtcgttgagccatttgcccatagcttcaccgacatgatgctcgaattgctgttgtagtcgacgatggcggtcatgttgccgatgaggatgaagctaggcagggattcggtcttcactgaccggagggcgttgacgtcgatgccgatgtggtcgtaggtggcgtcggggtctaggaaggagttgttgtaggtgtcgaactcgacggcgacgaaccggtcgccggcggtggcgttgtcgaaggtctggctagtgaggccgagggcgccgccgtagcccatgtacggcatcctcgacgggtagctgacgaggaagaaggtctgttgcagttattcctggtgtggcccgagctgatccggacgacgcgggaatgcaacggtgtgtaacggtgtggcgagatgcccgggcaaaggagatcggtggcgactagttcgtgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaagtggtatcagagcactcaggttgagggctgatctgacaccatggcgttggttccggcgggagccgcagcggatccggcgagggggagctcagggagtgcgttctcctacccacaactcacggcgacgaattacaccagctggtgcattcgcgttcaggcaatgatggaggaccagggcgtgtgggacgccatcgagccggcggccggggtggccgtcgacccaagaagggacaagaagtcgaagtcccatctgctgcagtccctcccggaggacttgctgatgcaggtggcaaagaagagatcggcaaaggaagtgtgggattgcttgaagacaaggttcgtgggcgcggaccgcgttcgcgaagcgcgcctgcagacgttgaagggtgaatttggtgccatggtgatggagccgggggaaactctggatcagtacgcgggccgcatcaccgcgatgagcgtgcgtcactcggtgttgggctcgacactgagtgattccgcgatagtgaagaagctgttcgacacggtgccagagaaattcatcagcctcgtcgcaggtattgagcagttttatgagattgataatatgccatttgaggaggcggtgggtcgtctcaaggcctacgaagaacgagttcgcaagaagaaggcggccgctggtggtgtcaccgccgacggtcaagtacttctcactcaggcggagtgggaggcgcgtttcaggaaggacggcagcgagtcgtcttcgccgcagaaaaacaaacctcccagcgacaggggaaaccgtgcccagggcggacgcggtcgcggcagagggcacggtggaggtggtggacgcggcagcgcgccgcggaacagtggcgctggtggctctggcggcggtggccgtgacaagagccacatcaagtgctacaactgcgaagaattcggccactactccacccagtgccctcatcccaagaagaagaaggtggaggcccatctcgcgcaaaccgacgacgcaaaccctgcattgttactggcggtgaccgaagacgagccggcgagcgggctggtcgtacacgaggagcgtgtgtggccgcagctgctgttggctgacagcggagcagccaccggggacatctggttcctggacaatggggcaagcaaccacatgacgggtgatcgtgctaagttcagagatctagacgtatcaatcaccgggagcgtcaagttcggggacgcctcaactgtgaaaattcaggggaaagggtctatcctgttctcctgcaagaatggggatcaatggctgctgcaggatgttttttatatccctagtctgtgttgcaacatggtgagcttgggccagctcacagaaacggggcacagagtggtgatggatgaagatgtgctcgaggtgttcgacaaaagtcccctgcggctggttatgcgggtgaggcgcacccctaatcggctgtaccggatcgagctgaagctagccactccggtgtgcctgctgacaaggatggatgagccagcatggctctggcatgcacggcttgggcatgtcaatttccaggcgatgaagctgttggctgacaagggcatggctggtggcatcccggcgatcacacatccaaaccagctctgtcaggcatgtctggttgcaaagcagataaggcagccgtttcccgcaacggcgaacttcagggcggaggagccgctcgagttgctccacattgatttatgtggaccgatcaccccgacaactatggccggtaatcgttactttatgctaattgttgatgatttctcacggtggatgtggatgttcgtgatcaaaacgaaggaccaggcactagaggctttcaccaagttcaagccgctggccgagaacacggccgggcggcgcatcaagacgctgagatcggatcgcggtggcgaattcctgtcgggcgaattcgcgcagttgtgcgagcaggcgggcatccagcggcatctgacggcgccatactcaccccagcaaaacggggtggtggaacgccgaaatcgttcggtaatggcgatggcacgatctctgatgaaagggatgtcagtgccgggcaggttttggggggaggcggtgcgccatgcggtgtatctcctcaaccggctaccgacgaaggcgatgggcgatcggaccccgttcgaggcatggacggggcgcaagccgcagctgggacacctgcgggtgtttgggtgcatagcacacgccaagatcacgacgcccaaccagaagaaacttgatgaccggagcgcgccgtatgtgtatctcggcgtggaagaaggcagcaaggcgcaccgcctgttcgacccgcgttgtgggcgtatccatgtaagtcgtgatgtcatttttgaagaaaatgtaccttggcaatggagtgtagtcgcaggggagcaaaactctaccgagttcacggtggaggaggatggagttgatgcaccgccggcaggagcgccggcctacccagtaccgcggtaccgggcgccatccccggcagtcccgcaatcgcctccggcaagcccggtaggggcgtcatcgtcattgccgacttcgccccagtcatcaccgagctctacaccgccttcaacacctgctaccggctctgccgggccggtggcgtcaccaggttccggcggcgaccttagaagcgatgagggtcccgtccggttcaggagtcttgaagatatcatgcgggaggcaccccgcgtggacctggtggaggatgaacacgatggggacgcgctgcttgcagagatggaggagccatcgagctaccgcgaggcagctggccagccggcatgggagaacgccatggcacaggagctgcaggcgattgagaagaattcaacatgggctctcactgcattgccggcaggacacaaacccattggcctcaagtgggtgtacaagctgaaaaagaacactgccggcgaagtaatcaagcacaaggctcgtttggttgcaaagggctatgttcagcgtcaaggggtggattttgaagaggtgttcgcgccagtggcgcggcttgacacagttcgtgtcatcctggctatcgcagctgatcggcggtgggaagtgcaccacctcgacgtcaaatcggcgttcttgaatggcgatcttgaagaagaagtgtacgtagcccagccagagggttttgtgaaacgaggagaagaacacttggtgctcaggctgagcaaggcgctctatggattgcgccaggccccgcgggcgtggaacacgcgtctcgacaagtgcttgaaagaactcggttttgcacggtgcacgcaggagcaggccgtgtatactagaggaaaggggcaagctggtgtaatcgttggtgtgtatgttgatgacttgattgtcacaggagaaaatccacatgagatagccatgttcaagcagcagatgatgggggaatttgagatgagtgatctcggtcttctctcttactatctggggatagaagtaattcagggggagaatgggattgctatcaagcaagctgcgtatgcgaagaagattctgtctcagtttggtatgcagggatgtaatcccacctcaatccccatggagccacggtcgctgctgcacaaggatgctgatggaaatccaattgatgcgaccgagtaccggcgtgtcatcgggtgcctgcgatacttgttacacaccaggccggatctgtcctacgccgttggcgtggcgagcaggttcatggagcggccgacaacgatgcatctcaaggcggtcaagatgatactcagatatctaaaggggacgctggactctggtctggtgtttgcaagcggcagtggctcgttggacatcacgggtttcactgacagtgacttggcaggtgacatggatgaccgtcggagcaccggcggcatggcgttctatgtgaacagcagcttggtgtcttggtgttctcaaaagcagaagacagtggcgctctcgtcttgcgaggcagagttcatggcggccactgcagcagcatgtcacgcgctctggcttagggcgttgctgagcgagatgatgggtactgaagcaaagcgggtgaaactttttgttgacaacaagtcggcgatcgccttgatgaagaatcctgtgttccacgggaggagcaagcatattgatacccgctaccatttcattcgtgaatgtgttgagagtgggcagattctgattgagttcgttcgttctgaggagcagcgagcagatgcaatgacaaagggactgccggcggcgaagctggcgactgcacggcacctgttgggtgtgcgtgatctcaggccacgccaagactaagggggagtatgttgcagttattcctggtgtggcccgagctgatccggacgacgcgggaatgcaacggtgtgtaacggtgtggcgagatgcccgggcaaaggagatcggtggcgactagttcttgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaaggtcatcccgtcgcccttgttgctcttgtttttcggggtgatgttgaaggagaagcgcgtggtgaagctggcaacctcgccggtggcggcgtcccagagctgcaccggcggcgtgtacaccatccggcccatggtgccgccgctcgacaggttgttccctttgcctttggtgagctcgatccattcggcggcggcgccggcgagcgccgcgctgccctggagggtgatgttcttgctcgcgttgctgaagctggagtagttgaaagatacagtagtggtagcgacgacgctaggcatgacgagcaagcaggctagagcagccatgaacggttttgtcatgaggacgccggcggccatggccggtctttgagcggaatcagcggccggacaatactgccaatgccaaaaacggaaaactactagtagtactcaaatcagcaggtggccagtcgccagtcgccactcagagagaccagtcgagatcttaaggactctgctaatttaacaagttggtggttggcaaatcaacactaggctccatgagaccatgaccctgacagctctggctcctcggaaggtgctgaaatgtatcatattttgtctattttgctaatagatgacgaagttaagcgtaagttccgtttcttgttggtatcttccctttttcttcaaatacattttcaagaatgataaaatcctttttatatatatacatcaagctggtttatatatatatatatatataaaaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28544 - DNA, 446 bp, Oryza sativa
ccttttatgcatggatcaatgtgtggatttcatagttttccccctaaaattagtactcctattcctcgaaaagatgcttttaattttgtagtttactactgttgaggtattggagcgtggaaagtggtagcacctggtacgtctactccatgtactacagtctttgcttgcttccgcggatggtgcgcagctatctgggctttaaatgttggctcgcagacaaaaagagcgcaagagtttgacgtgcagcaaagctgttcagttcctctccccgaaccactcaaacggctgcctgcgcgcgtgatgcgccagccaaggatgcatgcattgcatgcagctagctgcctcggcgtacttcactgctggaagtagcccgggaataaaggcgaataattgtagtacattaattaactattattactactctgctactggagttaagttgt

SEQ ID NO: 28545 - DNA, 20817 bp, Oryza sativa
ttttttaatatttcttattttttatttctaattttagttgttttaaaattatattcttacttgaactctcttttttatttttctaatttcgaaatttattttatgttttattccaaattttaattaatatcgtattgtgttcttgtacgaactcctttcaatatttctatattgcttatttttaattccgaattttagatatctctaaattgtattcctacatggactctctttttctttttttcgattaatgtgggaatttctagcacccacagcgaacttggtgcctcttttcaagactgttttaataatataactagttaggcggcccgcgcaattgcgtggctagcatcaatttaaaattatctattttttacacatgattttatttaaagttatcattcccgtgattctaataattttatagtttttaaaagccacaccagtctttatccattacttccttgtcacctttttatttgcttacttgatctaccactacctttactcatcttctttagaacttttaaaattagtccttatagtttttagagttcattgttttgttgggtttcgttttcataatttttagaagtatcttccaacatcgccagtttactactctacggcccgtccgctaccacctctctttattgttattgggattttaaaaatcgaacataattattgtttgtgttctttttttacattttataagtctcgccaaatcattagtgacttcgccactatactcctctacagctcacctgctccctcccatccttattgtcattgagatcttaaaaatcggatatgattattattggggtatattttcactctccttaagtcctgtcaaccgtcgtgaccatgctgcttaacggcatgcccatcgtcactcctcttaatcatcattgtgattctgtttgggattttgtttatagtttttagatatcccatcaaccgctagtactctacctattgcttctcccctttttattgtcatttgtcatcgttgtgttctagatggactttttttttaaattgcatatttttcattctgataatttttattcataaattatattcctacttgaactcttataattatttttctacttttgaaatttattttatttgttattttgaactttaattaatctcgtcatgtattctagattgtgtcttatttcaatagtatttatttttattacaaattttagtatttataaattgtattatagttgagatcttatttttctttttctatttttctgaatttattttattttttatttcgaattttaattattcttgtattgtgttatatatagactatctttttaatagttttattttccaatttcaattgtttcaaaattatattcctacttgaactctcttttttattttgatttttaattaatatcgtattggtttattatatggactcttctttcaatattgcttatttttaatttcgaatttcagttaattttaaattttattcctacgtgaactcttcttttatttttttttctaatttcggattttattttatttttattctgaattttaattaatctcgtatggagttcttatatgtactctttttccaatattccttatttttaattccgaatttcagttatttttaaattgtattactacttggactcttctctttttttttctaattccggattttattttatttttattcccaattttgattaatcttgtattgggtgcttatatggattcttctttcaatattgcttatttttattccaaattgtatttctacttagactcttcttttatttttttcgattaatgtgggaatttatagccccccacagcgaacgtggcgtcgccttttaaagttgttttaataatataatcgatagatagatagatttgagatcgtcaatggtaatctatagaactggctccttgtcaatgataaaaaggtaagagtttctctaaaatcattggattgttacctattttctcctttttactttacgacagttcttgaccatctatctatctcaaaacaaagtacttgacgaattatttttgaatctcacaacggtgctttctaatggtagtaaaaataaatctagctaaaccgtagattcttttctattcaagggatcagacctattcgtactaccaccatatttaatggtagtagaaacgtgcatgggaggataattttgtaaatttgcatgttagttggaaacgctcggatttttgggtcttgctgggctgagcatgcggggtagcgttacagagcgaggagtggaggtggctggtgtgctgccggcagctgatcagcagcgatagatgcgagtagtttatttctttggttggccgtctcctgcctgcggaaagaattaggactaaacattataaaatttactacaagagataaagataaaagtctgaacttgacgtgctaaactgctactgttttttaatcagcatatcagagcgaagcttctgttctcttgctcatctgcttcaattgaatcccactctaaactatgggacctctaatagagtctacactgttataattcagagaatgtgctttatgatttacatgttaatcagcgactatactacagtctgcagtgcaacagtttttatcttctacttctctgttcatatttgaaaccggacaatgaattgaaaagaaaagggaacataacggccttgtgaacgcggccaccggagccgccggcgcccggcaggacgatttgccgaccggcaacggaaggatgtgccgtcgagtagccaagcgatagatctaaatgtacaaaaactttttttttaatgaagagtggataatatcctaaataccaaccttacctttaatcactaagttagtaaagtactaaaatgtctttatgaatcaacggtttaaatcaattttactagttgtataatactacgatatagagtaccggagcatcgctctttattttttgggaatgctatggatctggaatcgcagattatgtttcatttagagcaagtttaatagtggagccaactgctgactctaaatcatctatagtcaacttaatagtcaattatacaatagttacctataaacatatactacacaattaatatctagtcccacctgtcatacacacatgcattttggagtccgtgctgcagctggctacaaatctgtagcccgctactcttctctcttatcttttatctcctcgaaatgtgtttatagttagcttataggctgctattgtacctgctcttatacatctatagccaaattcatctacacacacaaaaaaaccgaccgtaaaaattatgattgaattcccagttagatttgctatatactcctacctatccatatagattttttttagagaaaaggtcacaaggacccggcctatattgaaagccaacctcgagcagagtttttgctggggttaccagctttacaaaaaggagcacagaaagcactcggagatgattacctaccaacagacaagtgatatattaaacctttgaaacagaccgaacgccaaaaacattggattgggctggcaagatcaaccaactcctattttattttgtcttaaagcaggtcctccctccttcaacctctttaccggccagcttttctagatcactcttattcatctccagccgatgcaaagtgttgaatagtctttatattgattgtggaaggacaaatgacataagatataagtggaagagcccctcacctcaaggctagcttttgtgatgggaaagactatttacgatcctacgcaaagaactccacggcaataagaaagagacaatttggaaaggtagatacgatgttgtttctcgttgttcatatatagagtccagcaaatggttaaattcagctctaatgtcagcaaggataaagaagtcatcaaaagctctaatgtcagcacggataaagaagtcatcaaagttaagaggaacataatcccagttgagcacatctctacataaacaccaaacaaccagttcagcacatctctacataaacaccgaacaaaatacgccaaagggcagctaaagattatgtacatctctacagaaacaccaaacaaaatgcgccaaagggcagctaaaaattatgtacatctccacagaaacaccaaacaaaatgcgccaaaggacagctaaagaatatgtggtttgtagtttctagatggacagtggagaaaaaaattctaattttaaaatcagtaacaccaaacaaaatgcgcctaaggtcagctaaagattatgttgtttgtagtttctagatggacagtggagaaaaaaaatctaattttaaaatcagtaactagagggtgagcgtgtacggtacggtgttaacacgggccacggccggcggggagcacaaaagttacagtctctatatttattttagtgctagagaagacacatatagtaaggccctgtttagattctaacttttttacttcaaacttttaacttttttgtcacattcaactttcctacacacataaactttcaacttttccgtcacatcgttctaatttctttaaacttctaattttaacgtggaactaaatacagcctaatatatgctactccctccgtcccaaaatataaatatttttaaacttcgacacggtcttcgagatactactttgacaaataatatctatgttttaactaaaaagagttgtatattatgataatttgtttaatgatcagtctagtaacatcaaattgacatgatcaatcttttttcttttgctattaatagtcaaaatttaaaaggtttgacatcacattactctaaaaatatttatattttgggagggagggagtatcaatcatttgaagagttcagtgacattgtaccctaaggacgaaacgaatactggtttgacttactcttgtttcgtcgtcacgcgccaggccgagaacgggtccaatggaggatacctcaaatacagactcagactggcagtataggaagttgtgtcgttgctcctccagctggagaagccgatcagtacacagtactagtatcacagtactgtatcagtatcaccttgcacacgatcgatcgacgctggctcgccggcgggatggccgtcttttcgttgatcacttgtgctgccgacctcgtcatcttcttctccgtctgctacattcagcctccggctcatttcgccgccttgtccttcaactaccccaccttcgcctcctcacacaaccagtacatcgaaattgaaggcaatgcctctgtcagcgtcgggtatatcgacatcagtgcgaacagtgtgggcaacaacgtcggacgggtgttccacaaaccgccagtgcagctctgggacgccgccaccggcgaggtggccagcttcaccacgcgcttctccttcaacatcatcccgggaaatagaagcaaaaagggcgatgggatgaccttcttcctcaccagctacccatcgaggttaccagagggcgacgccggtggccaaaacctcggcctaacgaaccagacggtcggcgtctcgaccggcgagaaccggttcgttgccgtcgagttcgacaccttcgtcaaccccttcgaccccaacgcaaccaacgaccacatcggcatcgacgtcaactccgtcgtatctgtgacgaacgagtccctaccagacttcagcctcaacgggagcatgaccgccaccgtcgactacaacagcagttcgagcatcctgtcagtaaagctgtggataaatgacacaacgaagccgccttacaacctaagcgacaaggttgatctcaagagcgccttgccagagaaggtcaccatcggcttctcggcggcaacgggcgcatcagttgagctacaccagctgacttcttggtacttcaactcgagcccgtcgttcgagcataagcatggacgggccggagttaaagcgggagcaaccgtcggggcgacgttgttcgttgtgctgctcttcactgttgcagctatcctcatacggcgacgtcgaatcaaaaacaggaaagaggcagaggatgagcaggacataagctcggacagcttagacgacgacggcgagcccatcgtggagatcgagatggggactgggccaagacggttcccatactatgagctcgttgaggccaccaagagcttcgcggcggaagagaagctcgggcaaggcggctttggcgcggtgtaccgaggctacctgagagaacagggcctcgccgtcgccattaaacgcttcgccaaagattcctccaagcaagggaggaaggagtataagtcggagatcaaggtgataagccgactacgccaccgcaatctcgtgcagctcataggctggtgccatggccgcgatgaactcctgcttatttacgagcttgtccccaaccgtagtcttgacatccatctccacggcaatggcaccttcctcacatggccaatgaggttatcaaccctcgctagttctatctcaatctttgtgaccgtattaattaacatatattgttaaattaaacttaatagattagctaacttattttttacagggtcaagattgttcttgggattggatcagccctcttctaccttcatgaggagtgggggcaatgtgttgtgcaccgtgatatcaagccgagcaatgtcatgcttgacgagttcttcaatgccaagctaggcgactttgggctcgcaaggttcattgaccacactgtggggatgcggacaatgactgcagtgtccgggacaccaggctatgttgaccctgaatgcttgatcaccggcagagcaagcgtaaagtctgacgtttatagctttggcatcgtcctgctagaggtggcatgcgggaggaaaccgatgagcctactagacagccaaacgaatggcgtctttcggctggtcgagtgggcttgggatctgtatggcaagggagatgttctcaaggttgtcgacgtgcgtctcaacgatgactacgatgttacagagatggagcgtgtcatcgttctcgggctctggtgcgcgcaccctgatccgagcgcgcgaccttctattagagacgccatggccatactccaatcgagtggaggctagctgccggtgctaccggccaagatgcccgtgccgacgtacgcgccgccggtgatctcattggatgggctctttgcgtcatctacagggttgtcgtcgtcctcaggtgtgacgcagtcctcgtccacatcgacgacgagtggccatgctactcacacctcgtgttcgtcggttccgtccgattcaaccggtttgaaggactcgtcttcattgctcaagcatcagtcctagcgtttagtttttgttttttttaatttgtttgttcttagtttagagtttacggttgaatggtccgttgatttggtctttagtgttgcctaattgccgatgtgagtaatgtatgtgtatttacgcgatggtttgaacttcctttttcaaaaaaactagctggtggcccgcgcaattgcgcggctagcacccatataaaattatctattttttacgtatggttttacttaaatttgttaaataactatctcgttatgttagaactttgaaagactgactttatcatgccggtgtttttaatagtcacgccaatcactacgccttatttctttgtcatcgctttatttgcttgctcaatctaccactgttttcattcattctttttggaacctttacaaatttgaccttgtggttttagagttcattgtatcgttgggtttcgtttttataatttttagaagtctcgccaaacgccgccactgtactcctctatggttcgcccgctgcttcccatttttattatcgttgagatttaaaaatcgaacatgattatgattgaagttttttttactttctagaaatcccgccaatcgtcgagacagtgctgcttaacgacctgctcatcgtccctcctcttaattatcattgaaattctatgtgaggttttgtttatagtttttagatatcccatctacctacaccactctatttttttgtgggtctattaattctctcatctttattataatttgtcattgttgtgttctgtgtggactattttttcaaaaatcaatatttctcattgtgatatttctttcatttataaattgtattcctacttgaactcttataattattatttttatttactttaccaccctcggcatgccctcctatggcaattgcctcctatctcatttatttgcgtacgctcgcctgcccattgcttctcttctttgtcatctctcactacaccggtaagactaaaaaatcaatccatattattgatatgatttcattttttataatttttttagaattcctgtaagccgtcgttgcatgccgccttatttgccgtcccttggcaatatgtttgttttcttttgattaaatgtggcatttttagtcctgcaaatgtgaattaattcttagatagaatatggtcaagaattgatgatcgaacattggcaggctgccaaatactgaccttgatcttgatgtcttgataatttctatacctcattatgtaatatttgaaatttatagtattctttaaccacaaaattatctcaaaaaaagaaaaattgggaatatatttttgtctttcaatctacgaccaacaaaacaattaaacttcttacttaacaaaattttgatcatactaaacttgcctttaaatgacatcgtgtgcgtgcgcgtggctgactaaatcacccgctgctgctgtgcaaggaaagggtgcattggttggcagagtgagtttgattgttagctgacacgtctatgcggtaagtgccaaggaaacatattgattttcctttttttttataagtttctggaaacaaaagaaacgttgactcagccctctgtccggttgggccattacagtccgaatagaatttttgttttgctgtatagtattttttttttacatagtttgagtaggatttgtcatgtatcctttcttacttatactattctgatcaatctcaacggttaaaatataaatctatcatgatctagcggtgtagattttttctttttcttcgattaatgtgataatttctagcctccacagcgaacgtggtgtcttttttttgagctgtcttaataatataatagatagataatgaaggcaagaagattgccttatatatactgattgatacggcagggatttgaactttactgccgttataatttgtctacaaagaattgtccagccattttctgttccagcagcagcggaagtcgagtgagggagacgggcagagatagtggctgcagcagcattaagggtgcgtttggttgctcgtattctcttagtctggctcatctcttctatccaggctgagtttggtctggctaaaaggatacatatgcagctgtttgattacccgcatccgatgaacctggatatgctgagatgatgtttggttggttgcagcaaaggattggtggaatggttgcatgcaggagatgttgtttggttggatggatacatcttaggtgtaaataccctctcttgtgagtggtgaggttaccctcataaagtttacatctgtgtagtgaggttactccgtgaggttgtgttaaaattttatttggtctttggctactattatttgtgagctaaattacttagaatattggcatacacgtctattttcttcggttggtaatttttgtaagaatcggtaagcagcattgaggaaacaaacgtgcatacaggaagttgttcacaaggaacagatcaaacattttggtatttgagtatataaaattacatcgatgttatacaaaactgaaccaattgttatacaagtacatacttattacaatccttttacagacatctttaaactcaacagccttatatatctgcaatctggtaaaatgacaagtgtatataagtatgttcttatgcatcacagctcagtactactagaatggtattgcctagaaaattaaatatcaaacaacacaggaggtcaaacaaaaggaataagcctaatttctgatattgcaatgctctgctttctgaaatttgtcctatgaacccaaaaaaaaaaagatatacatgctctaaacagaaatgctatgatgggaaaattgatcatgcttagtattttctgctgcttcctgctagcctccttttttgctggttgtttcttccagatggaactgggaaatcaaatggcagccacaacgactgagtatggagctgtcatctccaagtggccattttcagttccatgtacttacctttgttcttccaagcttgactaaattagtcagtggatgtcaacatctgattatattacaaagactgaaatgtaacttatgcagagatttagaagtatatgcttaacagcatagccaatccatggaccttgtactccgtaattcatataaaagataattggaccaagaaacataaacacaacatcctaaggagcacaacctgagtatgtatgtatacatccagtggcataccatcatcgaccatggatatttactcagacaaaacacaatcggcaaaataaggtgcacagccaaaagtgtaacacaacagcacaccataaaaaacaaataagcacccaaagtttgctctgacattgaactaatattaatctgtatgaaactgaaaaaacagtagatctgaaagaaaatgaacagctaaaaaggataccaacaatacacgttgacattgaactaatattcatctagccattgacacggtttcaatatttaaatctaccaaagtcaactaggaaaatgtataagcttttactagatctagcagatttatgaaggccccatactctcatccactcaaataacagcaaatcaaccaaatagagaagaaaaaactggggaaggagggacagggaagaggatgcccaaccttgcaatgggcgatggatagccatcaatgcacttaccctgctgctcgacagagagtgacagtggaacaacaggcacgacggagagaactggcaaacgaggggaaggaccgacgcgggggcaggaagtgagacgacctcggaacagatgaaggagagccagaatcgggggagagggctgccgcttatggccggagtgacgagaagagcagcgccgcgccgctgccaaagcctaggttgaaccctagttttttttcacgagagggagaagtgaggcagggagggagcgattctggggaagcagtggtgaccccatcccgcgagttgcacgcgtgggtgcaggcgcgggtgaagcggtgcacatcggtcgagccaggccaagcagcgaagtgggaattgaccgtttctgccgtgcctggctgagggggtatttttgcatccgcatggacaggctgggaggcccgagcaggcaaccaaaacaccacgaatttgcatggaccggtgcgggccaaccttggtgcaggcaaccaaacagaccctgaacgttcggccaagaggattactggaagcgaattaaacgatcggcccattacaattgaagaggtggccgccatcctcttcatgggccatggcctacagaatgaagttgggctgggccacaaccgctaggaaaagcctgatctacatgcctacccccaatggaaataagtccacttgatgttctcatctttccaataaatatggacatccaacgtgcaaagccgggttaaattaggttttttggcagcatagatggctggtttaactgacaaatataaaatgttcaaagctaatctaaggctataaatagacacctccaagagaaaatatatgtaagtgagagtttttaaggattaataaatatatttactttctttgtgtacacttataaatgcactgttgtcttcttagacaacaccatgaaaacttaaaatctggaccccgatccatgtacaatattttatttttatcaatcctaaattcagaaatcctttatcaagaaaaatactaaaagtaagacaccataacaagtacaactcagtattattaatttaaagcttcatattatttaataaaaaacatttatattccgtaatttcgaagtgtgtattaacataaggaaatagaaagtaagggataaaaagtattatattttattctatatacctatgatattgtaattaccaatttcaaaaattcgaaactatcggtttcattattgagcacttaaaagcaaaatacacacacttatgcagaacatacatatcagaagcccagcgaaacttttttatctttattcccggtaggtaacaccaaccgggactaaagattatttttattcccggtttgtcttttgtcaggccgcccaggatctttaatcctggttagtaacacagcactttaatcctagttggtacaaccgagactaaaattgaaaaaagcgcacggggagggagagagccgcatcgcgtcttaattatctctgatgtctctctttctctccctcgtcccttatcttcttcttctcctaccccgtgtcgcgtcttatctccgtcgcatcctcctatcctctcctccacccccctcctcccctctcacctaggcgaggcgtggagatcggagcatggagtcggaggtggtgaagacggagatggctatgagcccgtgacgttgcgcggtggcctcatcgtcctccgtcacgcgcgggtgagcgacgacgacagcggtggccggcggcaggcggcgccctccgacctctgtgtctgcgaccctgtcgccagccgctgcttcttcctcccgcacctcgggatttcccaccgagcagcttcatccgcggacctcagctgctgcgtcttggctctctgcctcgactggtcatcgctgccggcgtagatcaagttccccctccttcccacctcatcgccaagccgagcgtggagattctcctcgtgtcgccgccgtcgccggccgacagtacgtgttggtatttcttaacgacattactagaaatataattcccagcaatggtgccagaaatagtcatggtatattatgattacagagtttatccgcaagcgcacggatataccattgtagcattttcacccgagagtattccaagggtatcgtatttgtttatcccgtgggaagattataatagagagaaccaaactaatatttatatgttacttgtattaatgatgtctaagcagggataaatataattgcagggtagaatgacacacaagcataagctactcatttttatattaaacctcctaagctaagtggaaagaatatagaaaagaatatattcctatacttctagtatacatcctaggtatatgattaactagctaatacctcctttccgatgccctcgtggtactttgagaagccacccttgactgccgagttccttacgacagctcgtcatgactatacaactggggctaaatacggaggagtaccctccccaaggaattaacttaggactatatacacgtgcggacgaatacccatactgagctgtcgccatcagcggcccacctctcatccgcagcatataaccccaaataatgatacccagtaatctagacaccacgcctaaacttccagatactactctaatatcatcgtcatgacatagaataattgcatatgcaaacattatacccgtaccaatgcatctcccagataagctagcagtataatcataatatctcggacatattgtaaagctggtagtcatataataggagagtattacaatactagagtcgtatacaaaagtatattctaaattaaatactagtcttacaaaagagaaagtaaagctgctagagccatacccgaactcttccgaagacttttggattccgactactattctattcctactccactagcttgagagcactaaactaacttgagagaatatgagatctttgttgcttgaagtgtgtgagagggtgaggagtttatatagccaaccaatgacggttgtgacggttggaatggtcggaaataccctccaaccgtcattgggggctaatctaagccgttccccaaaagccctgcatccaacgacgatgaggagggttcggccgaacctcgggctagcccaaccagcccactttttgcctggcggcttccctgacttcttctctctgcagatttgtgaattttgggctttttgggtcttctgaaattgatattttcagcccatcttcctttaagtctgattctcggcatcgtctgattgatcgatcgagtgttttgatgccgattcttctccatttattgcttattctctgcaagaggttagtaaaccaagtactagtggattttattttattctaacactatatgcattgcaagcatgactagctctccttttattccggtaatattgacgggcgaaactgatcgataacgaccatcaacaaaacaccccaagcttgaacctttgctcgtcccgagtaaaggacgaaaggaaacaaaacttggttattgatcaggagttgctactatgctgtatattctcaaatgtacaagtgcaaggtatatgtactctctctcaaatcaaataattttatcacgtggcttacccttacacctgattcccgcgagacattgctttaccttgccctgagcggttgaaagacagaacagcaatgatgagcactagtcacccaatctttattcaactttttattccgaaagttttcaaatgatttttcaaaagaaatctaagttcctcaaatgatcctctcgatcactcaaagtgtataaatatgaattcctcaccaaagtaaccttgttgattcctactctaaggtttagtatgtggagcttggtagggatcaaacatggcatacctgtattcacatttattattaagtcaaaaacttagactagagcatatgactagacatactcaagatcaagatcgtacataaagtgtgtgatatatggtggaaatggaatgtgaaaaaataaagaaaatacttctactttgtgctttctttcttctctaaaaaatccttcatttctttttaggagggggcatggctatattttttttatcatgctcaatattttgaggagcaagaatttattttcataaccatgtctttccctcttttctttctttttggaaaggatattattttgggaggagaaagcatataattagagagctttatttgggtggtaacatgatagatataaatggaatggatggatgctaacttctagtgcaaaagttcgcatgtgcatatatgtgggtgtatgatcttgatcatagagcatgaaaagtatctacacaagtctcaaaaatttgacaaagttcaatggaagtacaagtgccaaaaatatatatggtttgtcaatatgaatatttttggctctggtaggaatttatatcaaatgatgaacttctaagtttatcattttagaaaataaaacatccaaaatttaagtcaaacttagaacaggatcatagcagctcttatcactatctcatatctcacaacaacctagacttagttcagcaagtgcagcccacttacctcaggttcccggataatatgtggccacttttatttaatctttgagatattacttaaccgtgaatccatatataagagatataaaacagtgcaactattcatcatttcaatcaagagaactacttgtcttacctagcataataaaatctaacctatatttttggtattttctattttgcaaatttttatgtcattttttttggtttataggatgcaatgtggaaatgtaaatatgcaatggaaaaggaaaatatgcaatgtgatacaagttacctcagtggggggagatgtctccccccaagcttatctttcgctcagggtccctggtagggattgaacccttggaagcgaaggtacgcttgaagatcagcctgctgttgttgcatcagattgttgatgttaacgaactgagcattagcattttcctaccattcttgcgtctgaacgatgtgtccatcgaggtagtactggatctctcctgtctgcatatcaagggtgtctagcctcctcgtgatttcacccaagtcctgggaggaacttgagcgccaacagttggaggcgggaggcatcccgcttgatccaaaggaacaggtgtgcgcgttcccccagtgtacttcacgcggtgcttgccagcggttctcactggcactgtgctaggacgaacctcctgtgttgtgtcgtggtgcttgggtccaaccgggtgcatcccccgttggttcccagtccgcctcgtacatctgcatgggtgttgatgatgatgactcctcgtgtttttgccttggtttgttgcgtgtttccctgtaggatgtacctgcacgagattcttctatggtctgcaggggaatggttagttcctgacagttgtacaaatgataccccgcattgggtaacgggatttcatttgtacaggggaaaaagtatatcaaagagccatcggctccatgcttaagtatatgcccttgcattaaatatgtttcatccacatagggatggacagtgaagatatactcgatttgatcagtggtgataactccatgtccgttcgctatgcgggtgatcaaggaagtgcactcaacaggggcattatacttaatacttttaaccattgcctaatcatatatttaacaggagcaactttagtcttcctaaccttggcaaacatgataatcaactcatctccccgaatgggtctaagatcacctcaaggaaacaaagtcatagcaatccatttgtgcataagcctaagtgtaggattatggatgtcatttgtcctaggttttctgcaagttggagcaccagaaatgtcttcccaaaatctgtttttctcgaacccggaaattcctttccgaagatcgattttacagttatcgtgaaaaccaagaagtgtgcttaatcctttccatgaaagtgtatactccttatggaaaaaacaaaaggatatgctatcttctgtttctttcaaagtgcacagaaattgtatagtaagcaaacgagaacctggctcatctactactacaaatctctgctaacagcgtgaaaatcaacatccatacctgtttttcttagaagttctggatcatacgccctggtgtggccgaactcccggtccttcagcatgtggtaggcttgtagctcccgatcaccaacaatgtcgaggtcggtgtcggtgttaaggaccaaatttggtaaatcatggatcggagatagagattaaaaccgaagcggaatcgaaggaggttgatggtttcggaaacagagtgcgcatcggctggagatcgaatcggctaaggtatgcatcggcagagttcgagtcggacaaggtagccgatgaagtcgattccgacaagatggcattgcaatcattgtcggatcgggttgatatgcttcatgaggattgccacgtgcgtattgagtctgaaaaaagcaattgtatctattaattagatattttatgtaatttacttacagtttgagttggtaagagtctgccttagggacttgttcgtatcctaagttgtaatagagttaggagtcgtgtctgacaagggcatattatgtactttgggttgggtataaaagtagcccaacccgtgttgggctgcttcgccaacctttcactttcgtttactttcgacgagttcttgctttcgagttgggctgcatcggttcgatctccgatgataaggtaaaacttgttatggcggcttgtgttctcgggattagtgctttcatctcaatgatactttaatcttgtttatgtaagttgtcaatttatcatatttcctatataatctagatcaatattgctatctaacctagaattggcaaacatctcttgttggaaggcaaccgatagggttaaataccaacgttgacttagattatatagtatatccaccatcctaggaatcaatcaatgacttgattatctagatattgttcttcttttcatactcattgctgcattagttaagtttgagcttataagttgtgattagaatagtaatctctagcctgtttattgattgccgattagggtttcatcggagtttcaaccgatcttacctgatttggttattttgtctactttatgtttacttaatatgctaagtctgccctttatattaagatctcactctaattaaatatattaagcacgttattaatctgttaagtcatcttaatacttgattgatctctgtttaatatattttgtctatattgatatctcagtataaagtggtatcggagtattagccgatacatgtcagatctgcaacatcggctatgctataaacatatataatctttatattgaagtacttttagacataagtgatttatactgtctcgacaagttgtccgatctatcccagtcacatggtttcaacatattttgatatactgattatatgttgttaatatctacagccgatcgactagatctaaccgtccttttttctttacatatcattaccgatctaattcacgttacatggctagattacaaacgatacgtcatcggcacatggccgatcggctatcgtttatgaatttaactgggtttctttctttgtttcttgtgggttgcaggatcaaaccaactagcatgcctttgaactcgaaaccaagatttggacctgcactagagttaagcagatctctcaggccagtgtgtgtttttcgcatcaacatgcttttggcacgcccggtgggacacgagtgtgacaagcttccatcatggtggacatcaagtctaccgaggtggatccagacaatgtgattccaataaccatggacatgctaacatcagaacagaagcaagggtttgaagggatgataaatcaactgcaaaatcggtacttacattcatttgttctgactcgttcgggtacagtaattcaaagacacaaggtggatttgccaccggttgatgagaagcctgagtcaagctctgctaatgatgataaacttaaggaagtcaaagctgaaggactcaaacgggaggatgatggtgctccagagttcaacaatctacaagatcgatcagtgtggtcgtgacactgaaaattttgatttaaaatttgattccattttgctctgaaaaattcaatttgaataattgccgcaaaattcaaacctaaatgcaatttctttaaaaaaattcaaacatgctttgttgcagaaatcaaattgatgaaaacaaatatgaggatacataccaatttacctattggcgagggcggcgtcgcttcaagtccgacgtgcaagaccgtacctccgacgttcatttcacggatttttcacccgtctccggaggtgatggagtgggcgttttctgcttcgcacgccataccttctttgttcttggtatgggcggcggcttcttctgagccagcttttcttccttcttggccggtgtcttgggttttaccggcgttttccaataacgggacctcatcctggatggttgaatttctagagatttcttcataaacacgatgaggctatccattttgggtggctccacttcgaccgtctgaatgttctacggggctggcccgtactttattcggaacatggagcattgttccgtccttggctggaactcgaacttctcctccttcccgttgatgcggaaacggatacttcccgttccgacatcaatgtttgcttccgcagtgctcaggaacggacgccccaggatgagcggtgtctccttgccagtgtctatgtctagcaccacgaagtcgaccgggataaagcaatctcgtatcttgaccggtacgtcttccgctatcccagctaggtagtgaaccgatgagtcagccaattgaaggcgcatcggtgttggtgtcaacaccgtgaagttgagcttgtcaaagacatccttgggcatgacacttacacttgccccaagatcgcagagcgccaggtcgaatttctatgtcccaattgagcaagtaattgtgggacacctcggatccttcggatccttcttcttctccgggagtttgtggaggatcacgttgctgcattcctccgtcagcttgaccacctcggttgttggtagtggtcgcttgttgttgaggatgtccttgagataacgtgcgtacgttggcacttgcatagcatccaacaacggcatgttgatgtggattttctagatcacctcaacgaatcgagcgaactattcgtcaactgacggtttcctgatcctctatgggaatggcagcaacctcgcgttgcagtagtcttgcggcacggtcttctctggctgaatttcttcttcagccgttgtgttggatggtgcttcccgcgtgttgcttgtacctgcagtgttaggatatggcggatcgcgagtggacttacctcccctcgtcgtgatcaccttaacattttcaatggagggtttgggttgccccgggatccttccagtttcatttgcaagtactagagcggcaagttgcgccaactgggtttcaatcatcttattgaaactcaactggttttgaaatgcggaagcaaagccatctagtttcacatttatattttctaagatcttgtcattggcagccatctttttgttgagtgcgtcggtagttttggcttgcgcaaagacaagatcctttaaggaagacagattagaaaagctaccttggttattgcctccttggaaatacggacggggatggtttcacccctgacctccttg

SEQ ID NO: 28546 - DNA, 6183 bp, Oryza sativa
  unsure (1)..(6183): unsure at all n locations
gtcacgggacgtgggagtgagtccattataaaagttctacaggatcagccagtcgtccatctcatgatgaggacaggcggccacgtactcctgcagacgttcccatgcctctggaatggactcatcacgtgtctgctggaagctcgaaattctcccacgaagggcatttgtcttgcccatcggaaagaacttcgacaagaatactatcgagcatttgtcccaggtattgatcacggcacgattggcataaaaccactgcttcgctttcccgaggagggaaaacggaaacagccgcagcctgacgacgtcaggactgacgccctttacggtgtacgtgctgcagatctccaggaaccattgcatatgtgcattagcatcctcgttaggcttgccgcagaatgggctagcctgcgccatcgtaatgaggctggatttcaggtcaaagtccacgtctcccatgttgagttgcggcccagtggccacgttctcagaggagggagcagcgaactcgcggagggtcttgtcagccatagtcttgaaagttggtggcgctggtacggctggcttctttgtcggaagagtcttctgcgggggaacaacccgcggctttacgcttcggaagaagacttctggattttcttgaaaattttccggcaagtcgaaacctgtcatgcactaccctgttttcacaacaaaaggtgaaaacaacatggttagcctgcaaagcacagtgattatatagaggtaaatataagatattagttttagtaatctctttttacaaatcttccccgggaacggcgctagaaatgcttgttggtatttcttaacgacattactagaaatataattcccagcaatggcgccaaaaatagtcatggtatattatggttacagagtttatccacaagcgcatggatataccattgtagcatttcacccgagagtattccaagggtatcatatttgtttatcccatgggaagattataatagagagaaccaaactaatatttatatgttacttgtattaatcatgtctaagcaggggtaaatataattgcagggtagaatgacacacaagcataagctactcaatcttatattaaatctcctaagctaagtggaaagagtatagaaaagaatctatttctatacttctagtatacatattatacatacatcctaggtatatgattaactagctaataccccctttccgatgccctcctggtactttgagaagccacccctgacagctgagttccttacgacagcccgtcataaccattcaaccagggctaaatacggaggagtaccctccccagggaattaacttaggactatatacacgcgcggaggaatacccatactgagctgtcgccatcagcggcccacctctcatccgcagcatataaccccaaataatgataccgagtaatctagataccatgcctaaactaccagatactactctagtatcatcgtcatgacatagagtaatttcatatgcaaacattatacccgtaccaatgcatctcccagataagctagcagtataatcataatatctcagacattgtaaagcttgtattcatataattggagagtattacaataccagagtcgtatacaaaagtatattctaaattaaatactagtcttacaaaagaagaaagtaaagctactagagccatacccgaactcttccgaagacttccggactttgactacaattttattccgactccactagcttgagagcactaaactaacttgagagaatatgagagctttgttgcttgaagtgtgtggagaaagtgagagggtgaggggtttatatagcctcccaatgacgattgtgatggttggaatggtcggaaataccctccaaccatcattgggggctaatctaagttgttcccccaaagcgctgcatccaacggcgatgaggagggttacctcaggccggcccaaccagcccaccttttatcctgcggcctccctgacttcatctctccgcagacttatgaattttgggcattttgggtcttctgaaattgatattttcagcccatcttcctttaagtctgattctcggcatcgtctgattgatcgatcgagtgttttgatgcctattcttctccatttattgcttattctctacaagaggttagtaaaccaagtaatagtggattttattttattctaacactatatgcattgtaagcatgactagttctccttttattccggtaatattgacgggcgaaattgatcgataacgaccgtcaacagcgggcggcgccagaggagatgttgccgccattgacggcggacgatttgtgattttgtggttttttagatgatttgtgaatttgtggatgattttgttgtttagtatgttcattcgatctgtgacgtcaatttgatgtggggatttgggaatgtcggcaattagcaaaataaaaaacaatgaaaaaaagaaaaagagaagacctttagtcctggttggtgaatctttagtcccagttatttcaaccgagacaaaagatagatatctttagtcctgctttcagagtcccagtttgtaacccgggactaaagaggttgtaaaccgggagcaaagagggtatacccaacagtgtatagtactaaccagtgggtttagttaagttgcccgcatctctttcgataaaactgacatccagaaagtaaggcaagtgggggtaagcgtaagccaaaaacaagttacgtcaaagaaccaaagaagcacggcggtatcttcttctgttcacgcacatgcatttatgcatttccaactcgaatgtgtgccagtgccactcgcatatatcaaatcaacatattggctcgtccctccaattcgagacaatactacaacatctagaaaacaactttaaacattattttttattataatatatatgaaaacaataacaaataaatgatattattaaaatactttttaagactactctatacatataatctccatatttctaagataaatattttagaaattattatagataaagattttaaagtttgatcttatattctcatttgtgttcaaaacgaccagtattatttgtccggatgagtagtataattacttttagagtttaaatttatcttaaaaaatataggtatttcttctttatcttctcattacagtgaataataacaatctctcattgaatttctatacctactttctatttttaacaaatcataaacttctaaaatttatacacctattttctatttttaaccaatcaaaaccttccaatttaaaagtatttaagaatacttaaattttagtactgaggggagtagtctggtacccacactacctgcatgaaaataataataataaaaaactgatgccaccacactaccacagcaagtctggtacccacgctaccaactttctctaacttctactctctcgttttttatgcacatgttttccaaactgctaaacggtgtgtgttttataaaagttttctatagaaaagttacattaaaaaaatcatattaatttatttttcaagtttttaagactaatacttaattaatcacgtgctaatggacaaccccattttccgtggaattcaacctcccgaacgtagccctagttaacataccatcaagatttcagatcatctatctttggatatttgatcaagtaagaggagcagctaaattttataattttttttataaaatttggtgaaaaaagacgaaaaatttgcactcaatctgcagggcctatgccaatgtccaaagcttcacctttttttttataaaccagcttgatgttttatcattcttgaaaatgtatcagaagaaaattgaagataccaacaagaaacgaaacttactcttaacttcatttaaaattattaggaaaatatacaaaatatgatacagcactttccgaggaaccagagttgtcagagtcatggtctcatggagcctaattgatttgccaaccaccaaggcaccaacttgttaaattagtagagttcttctcactacgctaactcgctatgtccttaagatcttgactggtctctccgagtggcgacctgctgattcttcgagtagtagttttcgtattggcagtattgtccggccgctgattctgctcaaagaccggccatggccgccggcgtcctcatgacaaaaccgttcatggctgccgcttctgctctagcctgcttgctcgtcatgctgcgctgcttgcctagcgtcgtcgctaccacggtatctttcaactactccaccttcagcaacgcgaagaacatcaccctccagggcagcgcggcgttcgccggcggggggtgcatcgagatcaccaccggaagcaacctgccgagcagcggcaccatgggacgcgtggcgtacacgccgccggtgcagctctgggacgccgccaccggcgaggttgccagcttcaccacgcgcttctccttcaacatcactccgacgaatttggacaacaagggcgacgggatggccttcttcctcgtcggctacccgtcaaggatgccggacaagggcgacggtggcgccctcggcctcaccagccggtactttgacaccgtccagcccggcgagaaccggttcgtcgccgtcgaattcgacacttatctaaaccgcgacttcgaccccaacgcaacctacgaccacatcggcatcgacgtcaactccatcagatcggtgcagaccgagtcgctgcccagcttcagcctcaccgggaacatgaccgccattgtcgactacaacagcagctcgagcatcctgtcggcccagctggtgaagacatggacgaatggctcgactacactttacaaccttagcaccaccgtcgatctcaagagcgccttgccggagaaggtctccgtcggcatcttggcggcgacgggcttatcccttgagctccatcagctgcattcttggtacttcaactcctcgttccagcagaatccaccaccggcggtgcaacattccccgaccacctcaggttccggacttgccggagttatagctggagccaccgttggtgcagcactgttcgtcgtgctcctctttgccatggtagttgtccttgtgcggcgacgtcggagcaagaagagaagggaggtagaagaggcagaggaggcgagacacgtagggttggccagagatgacgatgatgacgatgacggtgagcccatcgtggagatcgagatgggcatggggccaaggcaaatcccataccaagacctcatcgaggcgacgaacagctttgcggcggaggagaagcttgggcaaggcggcttcggtgccgtgtacaggggatacctgagagagcagggcctcgccgtcgccattaagaggtttgctaaggattcctccaagcaagggaagaaagagtataggtcggagatcaaggtgataagccggttgcgccaccgcaatctggtgcagctcattggctggtgccatggccgcgacgagctcctactcatctatgaactcgtccccaaccgcagcctcgacattcacctccatggcaatggcaccttcctaacatggccgatgaggttagtacctgttctctttaacttcatctaaacttcctttgtgatgttaaattaattggcgtgttaaactcagctaacttggtcttaacttgtcacagggttaagattgttcttgggcttggatcagcactattctatctccatgaggagtgggaacagtgtgtcgtgcaccgtgacatcaagccgagcaatgtcatgctggatgagtaattcaatgccaagctaggcgacttcgggcttgcaaggttcatcgaccatgccgtggggatgcagacgatgaccgccgtctctgggacaccaggctatgttgatcctgaatgcgtgatcaccggtagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28547 - DNA, 735 bp, Oryza sativa
ttgttctattggaagtggcatgtggaggagaccaattagcctgcggacaccccagaacaattgcttcttccgactggtggaatgggtgtgggacctgtacggccaaggagccgttctcaatgcagcagacgagcggctcaacaatgaatccgacacaactagcatggagtgtgtcatggctgttggactctggtgtgcacatccggaccgatgtgcacgtccatctatcagagctgccatggcagttctccaatccaatggaccactacccgtgttaccagctaagatgcccgtgccaacatatgcaccgccgatggcctcagcggaggggcagccgttgtcgtcctcaagtttgacactaacgtccatcacacctcgctaggtttgcaagttttctcactcataggatttgtatagcgagataatttttgtcatatttagatttttatccatacccacaagttggtttggaggactcatcttcgttaattgctccatacaggagtattagtcatgtttagttcattttacttgttctacatttacaagggatatgtacagctcgtgaggcaattggtttgctctttagagagctgcctaattggcaatgtgagcaatgtgtttagttaacatgatgctgtctattttccaagcatttatttattttgtccagaaaacttttcctacaatttcctctgtccaacaatccaatcaaacagtccatatatctaactg

SEQ ID NO: 28548 - DNA, 14434 bp, Oryza sativa
cgggaaggccattggcccccgggggaggaaaaaaaaaaaggaaggaagaattggcccaacccggcccaagaggaaagggggggaaaaaaaaccttcttttagggttttctttttataaaacctttttaactttgttatttccttttcaattattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgccttcagttcgtcttcgcgctcccaagtagcttcttcttcggcgtggttgctccactggaccttgcaaaaacggattactcggttcctggtcctgcgctccatggtgtccaggattttcactggcctctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaagcaacttctccgcgtcgagcgatgatacggaagggacccacataccgaggtgcgagcttcccttttgtctgaaacctgtgcacacctcgcaatggcgtgacccgaagatacacaaagtcatccactgcgaattccagatcacggcgacggttatctgcataacttttctgccgagactgtgccacctttaggttatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttggtagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaattcaatcgagtacccagctcttcctggagcttcttccaaaagtgagaggtgaattggcttcccctatcagatacgattttcttgggaataccatggagactcacgatcctagcgaagtagagctccgctagtttattccctccataggtggtcttcacaggaatgaatcgagctaccttggttaatcgatccacaattactcatatagaatcatatccaccttgggtttttggaagtccggtgatgaaatccatcccaatttcatcccacttccattctggcacttagagaggctggagaagtccggccggtcgttggtgttctgccttgacacgctggcacacatcacatagagccacaaactctgcaatttcccgcttcatgctaacccaccagtatttctccttcaagtctaagtacatctttgtactgccagggtgaatggaataaggactttcgtgagcttcctgaagtatcagctgtttaagttctctgttatcgggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccgcgaccaactatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatccggcaagattaacactggtgaggaaaccagcttttctttgagagtttggaacgccttctcgcattgcgggctccacacaaatttctcttctttcttcaacaactgtgtcatgggtcgagcgattttggagaagttctcgatgaatctccggtaatatcctgccaaacccaagaaactgcgaatctgagtgactgtcttgggttgcttccaatcggtgacggcggtcactgtttcggggtccacagcaactcctttagcagatattacgtgccccaagaatttgacttcggacaaccagaactcacacttgctgagcttggcatacaattgatgttcccgcaactttcccaacaccagacggagatggtgctgatggtcttcctctgattgtgagtatatcagaatgtcatcgatgaaaaccacaacaaacttgtccaagtattccatgaacactttgttcattaagttcatgaagaaggcaggagcattggtcaagccgaacgacatcaccgtgaattcatacagcccgtatcgcgtggtgaatgcggtcttcggaatatcttcttcccgaatacgtaattggtgatatccggaacgaagatcaatcttggagaatacagtggcacctttaagctggtcgaacagatcatcgatccggggaagagggtacttgtttttgatggtgacttcattgagagctctgtagtcgacgcacatcctcttcgtcttgtctttcttctctacaaaaatcacaggagcaccccaaggggaagtactcggacgtatataccccttttctttcaactcttccaactgtttcttaacttcggccagttcatttgctgccatacggtagggtcgcttgtgcagaggagtggttcctggagcaagatctattcggaactcaatctctcgcttgggcggcataccaggtagttcttccggaaacacgtctccgaactctctgactatggggatttctgacagacctatctgatgcagttctgaacttctgacagaggttgggggtgcaaagaaaacaaccggttgttctggccctcggtacagagtgacagtgcgcctcgcgcaatccactactccttggaattgagccaaccaattcatcccaaggataacatccaaattcttggtgtctagcagaatcagatccgagggaaaaggaatcccctgaatttctataggaacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggacgaggaacgtaccgacgatgacgtctggagttgtcagcacgtcctcggccgtcacgtgattcacgtgaccccgaatgacatccttcccgccgttgttggagcggggaggcgcttggccttgctgacgccttggctttggacatttatccgcaaagtgtccgggctcgaagcagttgaagcacagacgctgctgaccttgagcgtccctgcggccttgaacgggctgcacagttggcgtaggaggacggggcgcacgagtcccttgctgattctgctgctgctgcggcggtgggacgcgcaccacgaattgaggtcgaggcgcggagcgaggttgctgctgctgctgctgctgctgcgaggaggatccccctgggtagggattggtgtagcggaccctctggttagcaccctgctgattgcggaagttcgccaagcggcgcttgtgcgattccagctccttgtgcttggcctccaagcggatgctcttgtccaccagacgttggaagtccgggtagtccccagagactagacgaacggacagctcagggtccattcctgccaagaacttctcttgcttctcctcatcttcccgcacatcctccggggcataacgggctagattgttgaactcatgcaaatactccatcacggagcggttgccttgcttcaactcccggaattcccttttcttaagagccacgactccagcgggcacatgggttctccggaaagcggcggtgaagcgggcccaagtaatcggctgcccctctggctgcgcagcctggaagtggtcccaccagagagatgcgggtccctgcagctgatgggcggcgaagacgactttctcctcatcactgcactgcaccgtgtctagcttcttccccacggcatgcaaccaatccaacgcatctacgggattgttggagctggagaaggtaggtgggcggatgcggaggaactcggcgagtttagagtgttggggaggtggtggtggagcattctgttgtggcggattttagaggtggtggaggaaagcattcatcatgttggcttgctgggcgaggatttgggtgagaatggcgttggtgtctggtggtggtggtggaggtggattgccttggtggttggggttgctgccctcgggttggttgccttcaccggtgttaacatttctcctggtcgtcaccatctgaaaaccccacacagaaccagcaaacagagaaggagagctgacgattaaaactaaccacccacgactactataattcttgaatttattactgctattaaattggttcattaatgttcaagttgcttaggcaaataaaataagacaggctccgacatagttacaccacacaccggtgtaaccatgccccacacaactcaaaaagacaaacgaggaaaaacacacgcgcaagcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttgaggcggctgtcctctccctgggcgatcttgagctgatgcagctgcgcctccactgcgtcgaggtccttcttgagctgcaggttctcctgacgcagctccaggatcttcaggttgttctccaccatgccacggcgcaccatctgatggaagtcgatacgagccgcgtcgtacgcctccaccatgcgtgccagatgcacgacggtggcgtcatcctccgagctggcgtctcggaaggtggcgtagtcgcgggctcctccgcgacgagggtgatagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgcggataccccaagaccacgcacatgccccgcagctccaagacgaagccagtcatgtccaaaccacgacgggtaacgctgccggccatctacaaacaaaaacaaaaagagaaacaacattttaaaggacagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagcaacgaaaaacagcggaagactagggcgacgaccacaggcgcttgacggcaggcacgagctagacaccaaagccttcatcttcaaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggctattttgtaaacacgaatctagaactatacaatattattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaagcaatttaggggattttgaatagagggggcggtgtgaagccaattccacaataaaccaacaattccagagtatccaggtgatatgaatatttcccaaagtctatagttgtaaaacctcctaaggttacctaattaaattgcgaagcatctacctagaattaaactagtggtgtcatgagtagagagtccactagttgaggttttgtttgcctagggtgaacaaggtaataataataacaataacaataataatatggtcataacaaaggtaagtaggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaggcttaaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaaattttaattaaaaatcggattattgcgtcagccgagggggcgggcgtgcggaccgggtccacgggaggtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccacgagggcgcgcccgagggcggcctcgccggcacggccgacgggagcggcgcgcccgcgccccgatggtcaccgccggcgaccatcggcgcggcggagcggcgcccgagagagcggagagaagggggaaagcgaacggcggtcttcggctcaccccgggacaacgacgccgacgagaacggcggccggagcggaggaaagcggcggcgcggttcgggatgacgatgacgacggtgctccggcggtcggcgggcgaagcggagcggcggacggggtcggcaaccactcggcgaagccgatggaggtggcgccgagtcgggaggaggaccggagcgacgacggcggcgaaacggaggtcggcggcgacggcggagagagaggagcacggcgcgagcacggatccgacggcgagagcgagcggcgagcggcggaaacggaagagcggagctcggggagcaattatatagcaccgagagggggagaacgcggccggagaggaaggaaacgggcgcggggatctcgggctccatagatgtcgccggcgatgaatgcgggaaggaaatcggacgaatccgagggagagagaggggggaaaacgggggaaacgggagagggaatcgcggggaatgattcccccctcattaaggcgcgcggggaaggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcggggaggccgatgggccgcgggggaggagagagagagagggagggagaagtgggccgagccggcccaagagggaagggggggggaaaagaacttcttttagggttttctttttataaaacctttttaactttgtttattccttttcaattattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacatgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaactgacggagctcgtggctcctcaccgggagaccgcacaggccccccctttgccggttcggccgggggcttagggtgagatctcaagctctcgctgtatgtggaaagatcgcgtgccaggaagaaacgcgagacacggacgatgtatacaggttcgggccgctgggaagcgtaataccctactcctgtgttttggtggatttgtgtgtggaggagctacaaagtgtgagccgatctatcccttgctctaggctctaaatctggaaaaaatccatcctcctctccctatgggcaaggtcctccttttatactttaaggggataccacatgcactcttccctttccaaactggacttttcttctttacataaatggacggagatttgcacggttgccctccgaacgtccttctgatgggacggcccatacctacctccacttctgccgggggcaggcgcgtcgtgggaacgtggctatgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgaggcgtgcgccaggccgccagtcgccacctaaccgttgatctgaccggtctgtgactggtcacagaccggataaaagagtgcgctgcattgcgctgcatgctgcatgacacgcttgaccagatcgcaataaatgcggttaggtgagccctaccgtgttcacccaacctatgtacataatgcaaaccccacaaggggtcggggcacctcggccctcggagctggggcaggagcaacccgacccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagcaacgaaacctctaccgacaattcccaaatttaatctttcaaattccttgcataattccaatggcaactgtcgtccttctgtagcattgcaatagccttttctgctaagagcgtctgctacaacattagccttccccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttggaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctatataaacctccgataatatcctgcaaggcctaggaaactgcgaatctctgaaactgtctttggttgcttccaattggttacggattccacgttactaggatcgacggcaactcctccggctgagatgacgtgaccaagaaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatgatctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattatttccttggtttgctgattctgaaattgctgcatcatcatgttcataagctgtgtctgttgagcaagaacttgggccagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactaaagactctcacaccactaaactcaccaacttcctaacactcaaaagcaaacaaacacatgcaattacatcccaccactgatgtaaatcacatgcgagccacacacaagcaaacttaaagcaaaccaactaacacaacgatctaagacaacgacttaacaagtcactctagttcttccaagcatcggaggtcgattgaaggctcgtttttatcatcttgagttgctacccactcaatcttggaattgttgtgcttagattcttcttcttcatcactacttatgatgatgaccgaaggatccgcttgagctggggcaacttccttctccaccacacgaacctttggcgccaattgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagctgctaatacagtctccgcacgactttcatccatagcccacaacatctcaaccaaatgtttcgtggtaacatcattctcaattccttcagtctcaaggtaactgccacggtcacttccctggggttggcgaggatggtagcgatactcaatgtcggccaactgatcactgtagcgatcacggagctctcctatggcgatccttgccacctcctgacatgcatggatgtagtttcttcctccagcttcaaacatcactgaggggacctcttcactattactgttcaaagtgactttgactcggcacttctcttcatgacgatcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaatagttggaaacgaggtcacaaattttgtaattttgaataactggtttcaaaagaaatgaaagaaaatgataaaatcaacatgataaatttattttattgcagcaagattaaataaaacagtattataaaacttttgctggtaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaccagttaagtaataattaa

SEQ ID NO: 28549 - DNA, 822 bp, Oryza sativa
tcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagactcactcgtggctgcaaccctgcttactcaaaatctattcacacatggttacgttttggggaaattatgaggggatctctcagtaccgcgtaggtactcccgtacgaagttaacattaatttccccggtaccagctttacatgttattatttgcgtattttctcttttatgtggttttctctagatttgatttacgttgtgtttgagttaagtcgtttagtcggcactaccattacaggttcttaagttgcatcattttatctaaagttccaccgttcttggatgttctcttttacgggtttttctctagatttacgtggggttcttataacctgcacatgtcaatcaggtcttgccttctgtcaaatggctcgaccatgccag

SEQ ID NO: 28550 - DNA, 874 bp, Oryza sativa
atcagtatcaccttgcacacgatctatcgacgctggatcgccgacggcgaaggccggcttttcgttgaccacttgtgctaccggccttgtcatcttcttctccgtctgctacctgcagcccctccggctcctgtcgccgccttgtccttcaactactccaacttcagctcaaacaaccagaacatcgaaattgaaggcaaagcctccatccgcgtcgggtatattgacatcagcgcgaacgacgctcgggacattttcaccagcgcgggacgggtatcctacaagacaccggtgcagctctgggacgccgccaccggcgaggtggccagcttcaccacaaccttctccttcaacatcgtcaccccgagcgataggaacaacaggggcgacgggatggccttcttcctcggcagctacccatcgaggttgccaaagaatgcctccagtagtggactcggcctcaccaacaagtcctacaccaacgtctccaccggcgaggaccggttcgtcgccgtcgaattcgacacttatctaaaccgcgacttcgaccccaacgcaacctacgaccacatcggcatcgacgtcaactccatcgtatctgtgacgaacgagtccctaccagacttcagcctcaacgggagcatgaccgccaccgtcgactacaacagcagttcgagcatcctgtcagtaaagctgtggataaatgacacaacgaagccgccttacaacctaagcgacaaggttgatctcaagagcgccttgccagagaaggtcaccatcggcttctcggcggcaacgggcgcatcagttgagctacaccagctgacttcttggtacttcaactcgagcccgtcgttcgagcataagcatggac

SEQ ID NO: 28551 - DNA, 5765 bp, Oryza sativa
gcatgcaaatatcaatatatatttgtaaatatgacgaattgttctttcgttattagtcaaaagaaaatgagtgtgttcggctgccatttgtttagcagcggctgcagcaattcaaaattgctgcagcttacagcgactttgaactgccgcagccgcagcggctgcagcagccatacctgccgaacagagccatacctgccgccgaacagagccaatgttggagagaaggactatcatctgttcttaggaccatcgtatttttgtaagtatattcttgcatattcagggagtttgcacttacccctactctaggaatatttggcatcaccaaacatttcaagcatgcttatagcatgcacaggtaatacgagcacgcaagtattgtgatgtgaatgtggcgtgtttaggttttgtacgtacgtctagttgcctaaaagaccaaagagtttgaaaaggggaggtggtcttttgtcactctccttgtcgcttatgcatatatgctttatggaaccgtttattaattactaataactaaagtaaaatagtttaaattctaaaaaaattaatttatgggtataacttatccttactgatttataagcacatactgtaaaaaagactataattaaaaaaatcacaaaaacaccttgaaaattaagttttaataagatggcttataaacataagcgaaatgagactatacatgtcccactttgatttgtcagtaactacatttgattggatcatagatagattaacaggcatccacaaaaaaacagtaactgcaagccacagggctccatgagaaaatggaatataataataaataatgtacataatgtctcatgacattttgcatatttgcaatttcttttttgttatctccttttatctctatggatggcaatgtttgcatccattctcctttttttttttccactggactcttcccagtgaacataaccgacaaagaactactaggaagctagtaaaattgaaagaagaaaaaagaaagaacaaagaaaatttcagagttcagaccaccccaactttcagaaacaactcctccctttgttctaacaaccactactagagcttgcttttgtgagggttgaacataacaaaggctaaaacatgaaggaaaatgaagcagccagataaattcttattgtgatctgagaccaggctacctccatgatctctgcctaccctcttcctttcagatcaatcacaacgacactaatgttatctgaactctccctgccgagggcgaggcgcgcaaggagagcagcggcacggtagcagcgaggctcagattcttggcctaccgctgctgccggagcaccggcgctgctggaagcggcttcgccgctcctagctgcgcgacgcccactggtggggctcccgtcttcaaggcattgtcgagcgacatcgctggccgtctcgtttgagatcacatcccacatcccatcgctcgcgaggatgaggcattcgtcgtcgacggtcctcacggttatggtgatgtctggctcacatatgacttcaggctttaggtacttgtctcctgcgtgaacatatttagaataattgagagtaacatacatgatactgaattagtttacataaagaatctcataaagtaagtaatatacaggaaaggaaataaattttcaaacatttcaaatggtattgcattgaattctagtaaatgagaagattcatggtattacatagtattttcaggaatcctatttagtttcatgaaagaaaaaggagaagatgacacatataaacctaacgaactagtgaaatcgagaacattattatggctacggcatttcaagaactccatccaaatatttaagccacagatacctctgaagctacaatgaaaggatacacagggaccagcccttttgcaatgaaaagcttaagcatcaaaacaggggcaaacgtgagatgcagaaacataaaatattctataaccactcagtaactactagaatgtagggaaatttgtactgcctatatcaagggaaggtgatgtatcatgtataagcctataatgacaagttggacagataagtattttgaaagaacacatttcctttgaccttttgggccaagtaaactgcttccttctgctgcacataaattatattatcattatattaattaatctactatataaagtaggaatcttcattgattcaaaatacttaataagtgataagtagtgtggtgcttcctatatgtgaaatgggcaattcctacaaccaaaatggtgtgtctgtaatataatacaaccctctccaacttgaaacctgatatataaacatactaccactgaactctagtttaaaacagagcttgtgagatagacagataaaaactattttaagaaaaagtggtttatcagaaacaacatcagatctgcagagacaatattttctatgttatttgattataaacattcgatatgaagtacaattatatagttttgaaatcaaatagactgacaaggttctacaatggtgcaagttgagcttttctctattgtcaaaaggtccaaattattactacccaaggtatttcctttgtcaatcctgaaagctagattaaaaaaggtgtaacatcactattgggaacttaggatacaacagaggacaacgtcactagcctaatcaaacatatatgtcccacttatttatgaagatcatttcttttagtcagttggttaggttacaatcagagcaactaataaaaagagctagcactttcacagatggtgaatcagagatgaacgcgtgtcttttatgtctaatccatctttcttctttcagacatctgataatataactaaatgaaataacaccatacaggcactgccaaatgttaggcctaatggctaaagtgagatggactgggtacatatggtcattttcttgataagccagataatatggcacaaaccggtggggtcagtgatgtgactgtgtatcaactcaacaaactgccaagtaacatctactagaagctcattagaagctggaattgtaccttttatctttgtcatagttaattgtataaaccacaaaaaaaagttggtaccttcggacagatgcaaatatcctatgtaactaaagtgtaaaaaaccttaaattcatagggtaccatgctattgtcatattcataaccttcctgccacgaaacttgcatataatacttattttcctcatagtcttaaagcaggaacatccttatttgacctagattctgtcaccaggcagtttttgattggtcaaggggtggaaagatgcagagcaataggttcctttttatgtttggaagaacatgcagagcgacaaatgtaaccaccctttgtgatatagtattaccttccgatcttttgtttatttccatttcccccaacctcgttgggggcaacatgatagtttaagaacaactggacacgtcttagaaactgacttgccaatggagcttcagtggtttagcccaatgatcaagcaaaaccaaaaggctagtgaacaataaacaaatgatatccagagcaactaaactagaatggcaaggcattaccaaccatatataattggtctccctaactccagattatgtgcacaagtacaactcctgactacttctattagagcaagtttaatattatagccaactactagctccaatttatctatagccaatctaatagctcatttatacaatagttacataatacactattaatacctggtcccaccagtcatacacacactgcgtattggagtctgtgctatagctggctacaaatctgtaatctgctactcttctctctccttatttatcttcttaaaatatgtttgcagctggcttatagcctactattgtacctgctcttagcagacttcttttcgaaacatttactcattgagtacatgtttccgcgtgaaatcaaaacccacgccaagacgaacacgtgagcgacagaaattggttttattgtggctccaagttctatccaaagctagctagctacgcaaacattcagattgtgccacccactgctagctgtatcatgtggtcttaagtgaatcatgtgtgcagctagcagccaagacattgtagcccaggacacaggcaatttcagttcttctacagcagagtagcaaacacaacacacaaagatagtgcctgcagacagaatttagatcaatgatgatgacgatgacattacctaatgctcgcgacatggcgaggatgccacgcaccctcggcccgttgaggtacaccacccggccacccaccgcctcgatccgcgccttctcgtccggccggtccggctgcataattcaccgtcaattatagtaccatgtaatctaggttcgtcagcagcaagatcacacttatgattagcaagatacaagagcaagattaggttaatcacactaccacatccagcacgaatattgtcgcaccaaccactgcccccatctcctacccccctcatggacctaccacagccaaccacacccagccaattttccccttcttttttccccctttccacagaaaaggaagctctgaccagtgtgggtccacaatccatctcaggaagagcaaaaataaaaaagaaaaaaagaaaaaaaaagaggcaaagggacagcaacttcacagtacacaggagcagggacaggtggcagaggtggcggccaaccccctctcactgctcacgtgggccccaccagacagcagcaaagcagctggccccacactctgaccagtcttatccccccacgtgccccgcgcgagagcaacacgtgtccccctccaggaaagcgatggattaaggccctgtatagatgggactaaaactttcaagtccctatcacatcggatgtttgaaaattaattataaatattaaacgtagactattaataaaactcatccataatcttggactaatttgcgagacgaatctaatgagcctaattaatccatgattagcctatgtgatgctacagtaaacattctctaattatagattaattagtcttaaaaaatttgtctcgtgaattagcttttatttatgtaattagttttgtaagtagtctatatttaatactctaaattagtgtctaaagacaggaactaaagttaagtccctggatctaaacaccacctaaaacacttcggaatcccccccccctcccccgcccaacaccacgtgggccgcgcccctccgcagccacccccgaggttcccacaaattctccaaattgccactgccctttctactcgcattaatgagagggccaaaacaaaaacagaccataataagagaagaaaaaaagatactagtaattattttttttattattattttttaatacgaggtgataatcttttttgtgatgacgctagcggggtccacgtcggcgagcacggcaaggcgaggcgatccatgtctctccgacaagcgagagcgacctctctctttttctccggtcgccggcggccaaccacgcgtcgccggcgaggcagccgcggccgcgaaggttccggagaggcgacacctcggctggggcccaccccccgcaggagtcaacggtaaacggcagcgcgagacttggaatattttggcaggtacggtcaaagccgtggtgtgagggacacgtgtgcgtgtgaggagggtgccacgtaggaatggaagggctgattaccttgtggtcggaggagagggggaggg

SEQ ID NO: 28552 - DNA, 14222 bp, Oryza sativa
gtggcgagggggtgacacgtgtccggggactgcggggggcgcgtggtgcgcgcgccgtcgggcggtttggctgcgcgcctctcttccctggttttcgccctccccgagcccggtttggccggcccctgctgctgctacatcaccacccaactaccaaacaaaccaaaagagccccatcctttgacatattagagaaaagacgaaatgatatatttacaaatataaaataatttgtaaattaaaattttatatatgtatttttaatgttctaaataaagattggaaaataaactatgataaaaggtcctaaaatcaacttcaaatctaaagctaaaaatttaaatcctgactgataaacataaccgagaaggtgaggctgaaagcttttgactctggctgggattagaacttgcatcatttgtattgaataatgggaaacaaaggtcggtgataccaccaaaacaaaatgacgggagaaagaaaaaaaatctttttttttgcccctaattagcttctagaatccttctatatgtgggagcacgtgataaatttggatggtggccaggctatatttcttagtgtaactcatttttcaggtgcatttgtaggatttcatctcttacctatactaaaggtgttatccatctccagcacggtggttcctgaaggatggaggaggaaggggcagctaccggcgaggagatcaaccaaaagagggatcaaaactattttaaacacatctactaaagagtaaaaaaaatcaaagtaattttacctctataacatggtaggacgggtgagcaataatcttcccttctttcctctcttctcattgataacgagatcaccggaggtgttgatagtgagataggcattacaagtgcgatgccaaacaatgaagaggaaggaaccattcacaagtttgtggagtatagtatacgaaggaggtggaagaagagatcaccttataaacttgcctctatcattatgtcgcctcatctcacacgtctttgcatcgcatattaatgagaagatatggttaaatgtttttaaactaccacatgttatgcatgcacctagacgttgttcccaacctccacaacgctggatccaccatccccgacctcctcggcgatggatctacccctcccaagggcgccgccggtggatccgctcctcccatggcctctagccgtagatccggcatcaccgtccccaacctcctcggcagaggatctgcccctcccaagaccgttgccggtggatccgcccctctcatggtctctagcggtagacccggcatcaccatccttgacctcctcggtggcggatccgcccctcccgaggctgccgtcgatggatctgcccctcccatggcctctagcggtagatccggcatcaccgtgcccgacctcctcggcagcagatcggcccctcccatagcctctagtgctagatccgacatcaccgtccccgacctcctcggtggcagatccgcctctcccaaggcccccgccggtggatgccttcccatggcctctagcggtagatccggcatcaccgtccccgacctcctcggccgcggatccgcccctcccaaggccgccgccaatggatccgcacctcctattgcctctagcggcaaatccactactcccatggccgccaccgcccaagcctgccgctgttgcagcccaaagccagtcacctccacctcgaccacccgaagcggttgctgctatgtatggggagaggcaaagggaaggtggagtggcgaagtagaggaaaagccaccaggagagagggaggcgatgggagaatgggagaagtcggagtaagacattgtgtcttatagccgcgctccagcccttgccttttatatcttgtcggtattttctcaatcgatagccccgagagctgtaaagagacccataagcaaaaaaggtggtttttttcaaccgggctcttaagcggtccatatgtaaaaattggtttgtctataaaaaaccaattttcacttatgggtctttgggatcccttaattatccattttcacatgtgggtatctttagctagactgcatgtaaaactggagaggatgtgtttacaataatggttttgtagtagcgtggtttgcataattttcttgttttaatttccttgtactttttctcaatagattgaggcaatgatatgaagtgcaatattgtcgatgtatgaatatgtgtatatcatgcatgtatgaacaatatatagatgcatcatattgctttgtatatcttttctggccgggttgatacctacttaccaatactgcctgttcaagatcgatcagcggtgatactctctagtagtatcactgtacattgattgccctctcttcatgttactaattagaaaaccagcagtgacgccgtttatgaactctcctaacgggacggctggtggcagtgatcgttcggtcgttcaagaatgtttttccaatgtaatgtgctaatatagggttcttaattaatgtggacgcaattaacatcttaggccctgtttagatccatttggaatagcaaatagcaaatggcaaaagttttggtggtaaaagttttggtattgcaaaaatactagttggtgtttagatgcatcctaaacttttgccattctagcactaaagtgagagatagaaagaaagagggagtggtcccaaagcactttttggcacaatttgctactatagactagcaaatgccaaatgccaaattgccaagttttgttactagtgtttagatccaaaatagcaaaaagtgctttaaaacggcaacattggatgatctaaacagggccttagcatctcttggaatgcaactatgcaatcatatctttcgaggtaattaaatcaagaaattaacgcaccttttacacataagcactactctctttgttataaaatataacaatgtttagcatttaaaatttcacctaaaatatatttctttcaaccaatcacaatcttctaacattaaaattccctacctaccttctcttttttttataaggaaagagaaatatattactcaacaatatatattgtcgtcacaaataagttgtgagatgaagttacaaccagaaccagcccagaaaaccggagaataactcacattgagccttgttactgcctacctcctcttttaaaccaatcacaataaatcctcatttaattttattaacctttttaatatgtatctttaatcctaaaactttttatattacatgatcgcataaacttcaccacattcttatcatgcatttatgcaatcatgtatatgctttttggccttgctcttttcttcggctctgctaccgatttttagaatgcaattaattattgatcgctcttaagtgtatatttggtcgtagcaaattgaaatataggatggataatttgtctaacttttgctccgtctggatatttcaatttttatgctggcgcatcgatgtatcatgtactctgtactgtgcatgtctgtgtggtactcttgcttgggtgtcgcgagatatttgaattgttaaatttactccaccttcatttaataatattctctccgttccaaattatgattaagaacttatagtatttgaatacttttctaaaatataaaaatttataacactacaaacagtactattatttatctcatcaattattcctcattcaaatctcttctcatcttacccccacttctccatccaaccccacttatttttcatttattgaggggcattaattaaagtatttttcttcttaaccttaacctctacataacaatataaaaatacttatattttaaaagaaatatagtaatagataattctccttttttttctctcaaaaagacatgcaaggcagcaacaagcagccatatataaatgggaacaagtacacaattaagatgctcggaggaaattaaaccagagataaaaccattataaaaaaggaagatatactcccccccttctctctctctatttcaataactgcaacgtcaattctcttccaacattaaccaatgctcccttcgttttatattatcaatcaaactttgagaaagtttgatgaactgatgaagtatataaaaaagcatagcaattggtttcatttcgtataacattgaacatatttttttatattcttatttatgttataaaaactattgctatattttttctataaatttgaaaagcaaggcagaaacaagcagccataaaagggaacaagcaaacaagatgcttgaaggaaattaaaccagagacaaaaacgcgttataaaaagggaagatatactctctctctctctctctcaataactgatgataattttcttgtttctattccctccattttatattataaatcgctttaatttttttttaaaatctaacttcgagaaagtgaaaaaatatagcaattggtttcattatgtctaacattaaacatattttgatatcttttatgttgaaaaaatattgctatgtttttttataaatttggtcaaacctaaagtggtttgacttagaaaaaagttaaaatgatttataacatgaaacagaggtagtattattttttatatactcaaaaccatattgttagattcattttgtatagaactttgtaatagggtagagtttcaaaagtatttgcaaatctgaaaatatcaaagttcaacacagccccatccttttcatatgttccctagaatttcatttgcctcgtataattttttttatttttctactatgtctactatattgattagaccacctactttaagttatttgtgaagtttattagaccacctattttaagttatttgtgattttttttaaaaaatatattaatttatcatgttaataaaataaacaatccgcgtcaataatatgaaaaaaaatgtctcaaacagcgtcaacgttatcggtctattctgatagatatagatatagatagagctagatatacatatgcatatagatagatagatatagatatgcatataagatatatatagatataacaatgtcatatatactgccatctgcaaggtcgtcaccctcggctctacaagactattgcaagagtccaacttttgcacgcatagctagtactaggatcatatagctactaagctacaaatggcgatagtaattttgcttaattaatctagtggccgtcctggactcctggtttgaaaaaagtctagatagctcacaaatgtacgcaagatacatgcatgttacctcactctcaaaaaaatatcattttttatccagctcatatacattaatacaaagagcaattttacggtcattgaggtaccaagaggtaccaaatttacaatagaaaaaatggtacctcatggtacctactcaagaatcgtagaattgctctaatacaaaactaacagactagaatacttttaccaacttttatcaaaatacaatacaataattgtttcaaagtcaaagtttttcttaagacaaacgaattgataaaagatgtggctatttgagattgaggatgttacaatactatggccctgtttctttcagtttgggattattataatctagattattaagtcagattactataagctagattgttataatttatataatttatagtagaataaccgttggttgtttctttcctagattattagagcctagattattgggttttgcaagtctaaagagggagtggggtggcatggtgggtaattttgcacccaatattctgggaaaagctcacctaaatgagcttatcaaattataataagcgggactctagattataataagctacttcaataaggcttatttgtttctttcagcttacttcctatatatatatatatatatatatatatatatatatatatatatatatatatatatatatatatatatatacttttgttattggcgctcacggccttggagattttgtgttgttggcggtaattaggtagatgggctctactaataagaaatcaacgaaggtgcatgcacctcccaaagaggaaacaaatatgaaccagtccagtacttgtactgttcttttttttttccaaaaagggaactgttttgtgttgcttgaatcagtcggctatatatttagctcttattaaatactatctctgtattttaatgtacgacgccgttgattttttatccaatgtttgaccattcgtcttattcaaaaaatttatgtaattatcatttaatttattatgacttgattcatcatcaaaatttatgtaaatattttcatatttgtacaaaaattttgaataaaatgaatggtcaaatgttgataaattctgttggtgggagattggttttgattaattctgttttgtcaagtctagctatgtttattatgtttatgatatcgttttttgagattcctaaaggggttcttcaaaaaattgattattatagatcccgtttcttttggcaaggggatgaacataaaaaaagtatagattgacaagatgagatattatttgtcaaccaaaaaatcagggtggacttggagttcataatttagaaatataaaaccaatgtcgtttaagtaaatggttatttaaattaataaatgagcaaggtgtgtggcaagatttactgaaacgaaaatatcttactggtaaatcaattactcgggttgagaggaaacaaggggattcccatttttggtcaggtctgatgaaggttaagaattcctttttaaatatgggttcctggattattaataatggtgaacaagtaagattctgggaggataagtgactagggaactattctttgaaggaaaagtacccctcgttgttttctatagttagaaggaaaaatgcctcaattgctaatgttatgggttctgttccgcttaatgtttcttttagaggagttttagttggtcaaaatctaattagatggcataatttatgtgcttccattgtgcatattaacttaacagacgaggatgaaatttttagatggaattttcattaaaatggccaattttctgttcgatctatgtacttagctttaattaataatggttacatagagaaaaataaaattatttggaaacttaaaatgcctcttaagattaagatttttatgtggtatctccttaaagggattgttttaactaaagataatttgactagaaggaattggaatggtagtttgagatgttgcttttgtatgaaaaatgaatcaattcaccaactattctttgagtgccatttttctaaatttctttggagagctatacaattctcttttggactttatcctccacatagtatatctcatatgtttggaaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaattaaacttgagacggcaattatgcatttatttgccaacttcaggtggaggttctctattagaattcagtagttaggggatctttttcttttgttggtgtctattagtttgcttagctttgtttctgctttcgtgaactttctgtgtgagttctgtaataattggctgtaactctttgagtaaaggccggaatgttacattccattatctaaaaaaaaacgttgataaaaaagtcaatggcgttatacattaaaatatggagggagtagttgcttagcagtaataagcaaccaagtgggataaaactgttgactaactcaaagaaagtagctgcatcgcggggttgacctgctttccctctctttgttactcagtagggcgtagtttctagcccaagctagaggtggggaaaatgaccacaactgaagaaccgagttctcaaaaaagaagaaagttctaaaaaaaataactgaagaaccgaaccaaacaaagaccaagactagattgaacaggactccaaattttggtcacaaaatcagtcataaactcctgctaattgagtttgataaggttattttggtcatatgtcccaattaaccgaaatgacaaaattttaaccgaaccctaatagaagcctaatatcccaagaagtatcaaaacccctaacatctaactaaaccccgtctttcccccacgctccactcaggtgatgacatgttatcattcaccctagctcccagctaccacctcccttgcctctcccctccatcctcctctttctaccgtccgcttgcattcttcctatcgtgccgtccaccatcagtgtcgtacaactgctaacactttacccctgctgaggacgtcctttgcctccagcctccttcttcggcatcaacgtcacccaccttctccggtgccgctcaccccatcacctactgtccaagcgtcgctgctccccaaccttatttgccttcctctttctctcattccaaggtcacttaaattcctaggtattgtagctcacaatttagaggtaaagatgggagcttgattttctttaggttggcggttggggatcgatatatctccacgtcatccatcacagatccatatttcagctatgtccataacttgaaccgacaaaaaccatatagctcgatcttcaccattttgcaatgcaattcgttctctatacttagggtgtgtttgaggagaaggggattgaggagattgggaagatacgtaaaacgaggtgagccattagctcatgattaattgaatattaactattttaaatttcaaaaatggattaatatgattttttaaaacaactttcctatagaaaatttttgcaaaaaacacaccgtttaatagtttgaaaagcgtgcgcgcggaaaactgagactcaatctcccctatctcccccgaaagaacgatgccttagatgactgaattttactcaaaagagagaaagaccgagaccgacacaggaaggctgaaacactggaattaattaagaagacaaaggtaatatatgttcttggttgcttattagttctgattctgatcgtattgattaatgtaatatgtcaaaaacattataattgggacttgggaactaaacaatatcaaattagaagccaatatatatcgaccactccactcaaattcgaagcaaacattctagccctataaactcaaattcttctctactacaaactttcaaaataagttagctatatgtatagtttcgtataaaagattaacttatttttggaacgggggataatctatagtggttttacgataactcgttcatgtataatttaaccgttgatagttttatttgaaccctaaaccgttaccacaatggtaatcccagggcccaggcaccctggcctaggttacggcctggggccgagcccaattagcaatagaaaccccttattttaaccctagaaatcttagcccataaaatatggcccgaggcctagctgaggagccgttagaaagatagagatagcgagaggaaagacaatgactgtggatcgagtgatttctctttgctggttccatcactcatgctccaagatcccttgcgcatcgctccccaccccgtctccctttctagcaatatggtcgtgcgctcttcgtcatagcgtcacctcaggctccaggctccagtgctcctctgtgctagcctgtaatgatcgggtgaggatgcttcgcttctcacctgctccccactctggtgaggacaccttccccatctttccgaggaggcggcatggcggcatcagccaaccaacaaggacatagctattagaaactcggagcttatcaaaatcctggatccaccagtttacaagattgatggcttgagtgaaagaggagataatcggcacatccgagttaaaaaagatttgaaaaagaggagctccaaaagcaaagaaacagaaagcacttgtgccagtagctagctgacccacgttccggcaacagaaaacatatggaccatagctgccacagtagtgccatagctgttggacggtactctacacttttgataggtactaacactacacaagtgtgtttactccgtccgacgtgtcaacgagaggtctctcaggctgggtgaaaagttatatgacacgttttaaagcattaaacgtagtctaataaaaaataaattatatatttcgcatgtaaactgtgagataaatttattaagcctaattaatctattattaacaaatgtttaatgtagcaccatattatcaaattatggcacaattaggtttaaaaaaatatctcgtaatttacacgtaatatgtgtaattaatttttttctatatttaatactttatatatgtatcaaatatttgatgtgataggtcggatgaaaagtttttgcgtgggaactgtttcgcctcactctctggcatctgctacggccggtggagcccacaggcggtgttcctccctagggccgtgcgccacgtatggtgtcggagctccaccatggaggcgccgtccatatgagtatatgaccctataggacacggcgccatacgcttttacacgtggcagatcacttttacacgtggagtataacgaatgtggaaatcatgtacagccttttcttttttatttagagctggatttttggataggatcttcgtgagaatgggaagggagaagattaagaagttgcgtctgatgagatgagccattaattaaatattgattattttatacttaaaatacgatttcgctagaaatctaccgtgtgactttttcccggtgattttacggatttgctgaccgcacgatggtggaggctgcatgcgtggtcagccggtcgggatgatcttgttcgtactgtgctcgtccctttgggcatgaggagtggagacgatcgccggacgggacgaccttctctgcacttgaatcttgtgcgtaagtctgaaccaagccaaagctaggatcccacactaattacaccaccatgtggccatgcctaacaaatctaccatcgctataaacctgttctattcaattctttttttaaaaaaaatttaacagatataattacaatacaattatagtgtaattatactgcaacttatatataattacactgtaacttatatgtaactaaattacagacatatataactaaaattacatttgtaaattcagttgatatgatatgtaaatgcactgtaattttgataaaaataaagtataagtaaatatgtatttgttattttttttaaaatataaaattacagtcctacataactaaaattacatttgtaaattcagttgatatgatatgtaagtgcactgtaatttttataaaaataaagtgtaagtaaatatgtatttgttattttctttaaaatataaaattacagttttatataacaaaaattatatttgtaaattcagttgatatgacatgtaagtatttagaatataacattacagtcctatataactaaaattacatatgtaaatttagttgatatgatatgtaagttcactataattttgataaaaatattgaataagtaaatttgtattagttattttattttgtagtccgttggatataaatctaagtgtaaaaaaaaaatctggtgatttcttattaaaaatcacccgacaaatgtgtaggcatagtaacttttttaatatatatttttaaaaaagtaccgttgattaggaagcgtacacgcaaaaaaaaaaacgagataaaccttctcccttttcatcctaaacgactatgcttaagtgttgtttcgttgtctttagaaacagaatcggtggcatctcgtcaaaaattgatgctcggtcggtcaggaatcaaccatacttatcaatttaactattttttaagtgtttacgggcaaaagaaacaagaaaaaaaatcaaaattttatatattgctataaatagtaacggtcagataccacttctatacctactttgaaaaatcagtaattttctgatcgtcacgtagccgctttcgtccgtcttgtgcattttcttcagtcgtgcgagaatcctatttgctcacgatcctcttttcgccccgcgcttcctgttaggatacgtataggctacgatagcataaatcaaaattttctgtcgcgtaaaccaggaaccatgcaagtattagatcatagatcgttaccactcgacgcgccgcgcagtggaagaagacgttgagaagtcgaaggaactctcgggaagtagcgcgcgtcgatgtagagaaagtagtcgatcgcatcggctcgaccttctcctcctcgtacgttctcctcgccgtactcccacgctgatcagcaccgcaaaccagcgacgcctctaccggtatccacacgtacagggacggaacgccacgcgcagatgtgctagcacccgcgcgcggctatggttttgctcggggagggaagtgacggctagggtttctcacgtgatgcaatacctccgccggtcacacccctcacgaatatataggatccatcacttgggcctccaaggcccgtaggaatcctattcggatccctatccaaattaaactcatattggatctccatccaatccccttattccggcccattaagcgtgcgaccctataggttcatatatactcggttgtaacccgaaaactccttttcggtccacgcgtcaacagcggcccctagcagaacgtattgacccaccgggcatacataaagatcatatcggctgaacctctagtatatacttgtatgaaccccttacctcacgatatcaattaagctcaaggctagatatgtgtcgtcctctaatagctcaatcattcactcgaacctgttgatagattatataatttgtgattgactcctcaatcacctttggcatggccatgcacttccataatctacaacatcgaggggcccagagatatctctccataggaggggcaaatcccatcttgattatttatatcccactacatgtttcatagcatacccgaaaactacttttataactacccaattacgaagtagcgtttagcaatcctaagaaagctactacatatgttgggaaccatgataatctcaggtctaaggattcagcaccaacactaaatgagatcactgatgacacaacacatatggcccttgcagtatctcatgttgggtctatctaacaacatgttcactaacatgtgtctacattattaatttggtatctctataccatgatctatgagacatgatcatcaattaatacatgtgctgatcatctaaacatatttgtttcacatatgatatttgatcagggatcctttagaaatagcaacacataacataacataaagagtctcatgaaagaatcacatattcattaaccaataatgagttatctatttcaaggaacaatgtcggataaatatgtaaacatagtatgtgatacaatcatctctatgattgcctctagggcatatcactaacagtctcccacttgcactagagtcaatcatgaatgtatcttacacccattgccctagtgtgtgcctcatgcttaggctgagggagtggctttgtcaatggatctgcaacattcaaatctgtatgtattttgcatatcttcacatctcctctacccactatctcgtgaatgaggtgataccgccgtaaaatgtgtttggacttttgatgcgatataggctccttggtttgcgcaatggcaccacaattatcgcaatagaggtccatagggcttgaagcactagtcatcacacctagttgagaaacgattttttttatccaaacagcctcctttgctgcttcagaagcggcaatctattcggcttctgttgtagaatcagccactgtatcttgcttcgaactcttccaactcacagcgcctccattcaggcagaacacaaatctagactacgatctaaaatcatctttatcggtttggaagcttgcgtcagtgtaaccatttacaacgagctcttcctgtcctccatagactaggaacatatccttagttcttctcaagtacttcaggatattctttacagctatccagtgactctcacctggatctgattg

SEQ ID NO: 28553 - DNA, 13519 bp, Oryza sativa
  unsure (1)..(13519): unsure at all n locations
gatctatctctatagatccttatgcccagaatatatgctgcttcccctaagtccttcattgaaaaactatttttcaacgatgtcttaacggattcaagcataggaatatcattcccaatcaataatatgtcatctacatataggattagaaacaccagtgcgctcccactaatctttttgtatacacaaggctcttctttgtttttgacaaagaccaacgccttgactacttcgtcaaaacgaatattccaactctgagatgcttgcttcaacccataaatggatttatgcaatttgcatatctttttagctgattgtggatcaacaaatcccttggattgtgtcatgtacacatcttcatcgagatttccattgaggaaagctgttttgacatccatttgccatatctcataatcgaaataggcagcaaccgctaaaacaatccgaatagattttagcatggcggctggcgagaaagtttcatcataatcaacaccttgaatttgtctgaaacctttcaccaccaatcgtgccttgtagatgtaaacatttccatctacatctgtctttttcttaaagacctatttgcactcaatggcttttacaccatcaggtggatcaaccaagttccaaacttgattgacatgcatggattctatttcggatttcatggctccaagccatttctcagagtctggtcccaccattgcttcctcataggtggttcatcgttgtctaacaacaatatatcacattgtcctgtagttaacaatgcatacctcgcaggtgtacgccgtatcctttcggaccttcatgaagccggtgcttccacaactggttcaacaacaacttgttcaacctgttgaacaacatcttgctcagcttgtggttgtgtggacgttgaagcattttccggtgtttcctgaatttcttcaggtcgcaccatgctcccactatcctttcttgaaataaactctttctccaagaaaacactgtgtcgggcgacaaacactttgccctcttcccgattataaaaataatatcctttcgtttccttaggataccccacaaagaagcatttatctgatttaggtgtgagtttgtccgattgcaaacgttttacatagacctcacagccccaaatttttaggaaagacaaactgggacgcttccctgtccatatctcatatgatgtcttatccactgattttgatggaaccctatttagggtgaacgcagctgtctctagagcgtaaccccaaaagcatagcggcagatcagtttggctcatcattgattgcaccatgtccaacaatgtacgattcctccgttcagacaccctattccactgaggcgttcctggtggagtgagttgtggaacaattccacactcctttagatgattgccaaattcaagactcaagtactctccaccacgatcagatcttagatacttgattgtcttgcccaaatgattttgtacctcattctgaaattccttgaacttttcaaaggactcagacttatgcctcattaagtagacataaacatatctactaaagtcatcggtaaaggtaataaagtacccaaaaccacctctggcagttgagctcattggttcacatacatcaatatgtactagtcccaatagctcacttgacctttcactttgacccgtgaaaggtgcctttgtcattttgccaagtaaacaaaattcatatgtctcaaatgattcaaaatcaaacgagtgtagaagtccatctctatgaagcttctccatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaaccattgcccacagatctaaaaccataaccctctggttgcaaacaagaagcagagataacgttcttacacaaagctggaatgcaataacaattatttaactccaaaactaatcctgacggtaaagataatggcagagtgccgaccgcaacagcagcaactcttgctccattgcccacgcgaatatccacttcgcctcttgctaagctcctacttcttttcagcccctgcaacgatttgcatatgtgagcaactgacccggtattaaatacccaagaattagtagaggaagtagcaagattaatttctgtaacattaatacttgatgtggaactctttccattctgctgcttctgcttgagctactctaggtatttcttacagtttctcttccaatgacctgtctccttgcagaagaagcactctgcattcttagcgggtcctgtcttttgaaccttggtcttagagttgctagtactcatgatctcatcagagtttagctttctcttttgaccactcttcttgttgttgggcttgcgcttatgcataaccatcacatggttggagtttttcttaatgctttcctcggcagtctttagcatcccatgcaattctgccaaggtcctgttctagttgttcatgttgaaattcattataaacggctcaaagctgggagggagcgactggagaataaaatctgtagccaactctaggctaaggggaaagccaagcttatctagactctcgatgtaaccaatcattttgatcacatgtgggctcactgcattaccttctgcaagcctgcacgcaaacaaggactttgaggtattaaacctctcagctcttgcttggtcctcaaacatgttacgtagtcccgtgattatcgtatgagcatccaatgcctcatattgcctttgaatcttaggggacatagtagcaagcatgagacaacttatatcatggtattcattgcatcgcctttcatgctccctacattgagcagcaatagcattgttgggcaagtcaactggaaaaggctgtgtaagcacaaactctttgtgctcttgcctgagaacaattctcaggttgcgataccaatccatgaagtttgttccagtcaacttctctttctcaagaatagaccgcaagttaaaattggatggtgtaggagctgccatgatgtatgcaaaatcagcaccatgtttacatttaacctttcattaaacaatttaacaaaatatacttccactatgtattgtgaaacaaaattccctctagtaatatagtgagtcaagatcctcattttattagtgtctagtgagctttggcatcacagctagacaactatcaaaataggtaagcaacaccttgctaatcacatcatatgtgactcttgtgctgttggggtgacatctccatgtccaacccaacctatgccccaaggtccaaaactgttttgataaccttgtcaagtaaaccaataatctctgcatatagatgtccgacatctatcctattttatcatgataaaaagtgacactttactatggcaaacccatcacttatgatcacaaccgtaataggtgcaattattggaagagcataaattacacttaatttttctgagagaatctatcctaccatgttatatcaaatatacaacaacaataaagtaagatagatataaaaacctaagagaaatctaaggggcaacgcacacggcggtcccgttttttctacgactcatgcaaaggtcacggggtacatagatctcatctacgacccgcctgtgaaaaccttacggcgtaatcaaatttgctgaaaccgagtcaatctcattggctcattttttctcattggcgtgcgttccagtggacatcggactatccgattatacataanttcgctcggccttggtgagttctagacattccagtgaagtcnccaacacacattccgatcacctaagaactcatctacaacacgatagatctcatttactatactgtntatcaactatatgcaatgatctagatcataagctatacatggcggctctgataccactgttgggatacgatacgcataggctacgatcgcataaatcaaaattttctatcgcgtaaaccaggaaccatgcaagtattagatcatagatcgttaccactcgacgcgccgcgcagcggaagaagacgctgagaagtcgaaggaactctcgggaagtagcgcgcgtcgatgtagagaacgtagtcgatcgcatcggctcgaccttctcctcctcgtacgttctcctcgccgtactcccacgctgatcagcaccgcaaaccagcgacgcctctaccggtatccacacgtacagggacggaacgccacgcgcagatgtgctagcacccgcgcgcggctatggttttgctcggggagggaagtgacggctagggtttctcacgtgatgcaatacctccgccggtcacacccctcacgaatatataggatccatcacttgggcctccaaggcccgtaggaatcctattcggatccctatccaaattaaactcatattggatctccatccaatccccttattccggcccattaagcgtgcgaccctgtaggttcatatatactcggttgtaaaccgaaaactccttttcggtccacgcgtcaacagcggcccctagcagaacgtattgacccaccgggcatacataaagatcatatcggctgaacctctagtgtatacttgtatgaacccctttgcctcacgatatcgattaagctcaagactagatatgtgccatcctctaatagctcaatcattcactcgaacctgttgatagattatataacttgtgattgactcctcaatcacctttggcatggccatgcacttccatattctacaacatcgaggggtccagagatatctctccataggaggggcaaatcccatcttgattatttatatcctactacatgtttcatagcatacccgaaaactacttttataactacccaattacggagtagcgtttagcagtccctaagtaagatactacacatgttgggaatcatgataatctcaggtctaaggattcaacaccaacactaaatgagatcactgatgacacaacacatatggctcttgcagtgtctcatgttgggtctatccaacaacatgttcactaacatgtgtccacattattaatttggtatctctataccatgatccatgagacatgatcatcaattaatacatgtgctgatcatctaaatatatttgttccacatatgatatttgatcagagatcctttataaatagcaacacataacataaagagtcttatgaaagaatcacatattcattaaccaataatgagttatctatttcaaggaacaatgtcggataaatatgtaaacatagtatatgatacaatcatctctataattgtctctagggcatatcactaacacttccttcgtctgtgtactttttaacactgggaacatggccgggtttatgagtgggatggatctggaagaaaggtggagttgggatatgacgccacatgacaggtgggctaagactgaatataactttttcttatgctaggagatttttttttcattttatttagaaaaagtttctttgagcaaagttgactggttcgaaaaattcaaaggtctacaatgttataaatcatcatgggtcctagccaaagcaactctatgttgttgatttgtttgtgtcgataagattatgctcccacatgacgcacagttgttatcgaggtctgatttaaaacgtcgataagattatgctcccacatgacacacagttgttatcgaggtctgatttaaaactagattacgatgtgagacacacagggtttgttgtcttttttttcagtgtttaattctaattctgttatatcgggccctctactccccgttcgctctttctgactaaggtttggcatgcgccatttccctccataattaggcgactaccctctctcttcttttacttcctcaacttcctcacattttctttacttctcaatcgcattcgatgcggcaaaatgacggtgtatgattctaaggcattagaaggtgctgcaagtgaaaatatgtagataattgatgttggtaagagcccgccctctagaaccgcacagcgcagcccaatcaacgggtgagcctggttacacacaccaccccgcatatactttcttctacgcttcatgtacttaaagagttaatccgagagtgatatggttagagggaagatgccttataaattggttccacccttgctaaataacaagttggtactaaacacaagtacacagctctcatggatcacacaagctaaattctaattgagtcaggatatcacaatgttacatcactagattcatttcaatatgtaagaaagtttttctagaaaatcttagcgaatgttaaaggtggtagattagaaaaataatctatttttgagtaagttaatgaaaaatatattttctcagagggctcatatcatgaaaaacaaaccctaataatctaatatttatatatttattataattttggtttacatgtcctaacgcacgtgtatttttctagcatataaaaacgatgatcgatctgtcaagaatttaaacagcaaaacagctaactaatctcggatttgggttacccaaattgagtggcagtgtatgacaccaagtcgctaacaaacggatcgaaccgtgaactgataaagaaaaggaataagttcactttgactcccttaaaaagtgactgaatctaatccatgaccctaaaccgcaaaaccggatatctcgacccccgaactattgaaatcggtgcaatttgactccctaggtggttttggagggcggtttcgctgacatggcgctgacatggcggtgttgacctagtctgtggggttgacgtggcgcttaggtggcatttgaattaaaaagtatctgtaggacccgtttgtcattcacacactaaaaaattgtggagcccactgacatgtggggccccacatgtcatcatctctttcttcttcctcccttgtctcttcccttctctctctccccttccaccggccgcggggagcacgggctggagcggcgacgggagctgagctcgccactgccacggaggtcggcgccggcgccgctggaggcgagatcgaccggccatgcaagtgcgtgagtcctgggcctgggagcccgacgggattggaccgccacggagctgcacgttggctgcggcccgggcgccctggctgaatgcttcatgccacagctcgtcagcgtcatgcgcgcagccgtcgagagggtctgcgtcgtgactcgtgacccaccaataaaatcaaaaaaaaaagaaaatcagccatccagtgcaaattcaccacaaaaacacggtgaaaaccacctgttaattatgaaatctccaccgcgatgcaggagatgggaaagagcaggtctcggagttctctttatataggccggaggggaggaggtcgaccgcacggacggaaaacggcgccggcgacggtggagctcccaattgaaaacaccggtttaagaaatcgattgggggcaatttagtgcgggattaagtgggatttgttggggaaattgatgcccactacacaaggaattgatttttgcaattaatttggaggagaaacgatagggcagggagatcaacggaggcggcagtacttgagtttcatgggagagatgaacagacgacggacaaaggtggaagaagctcctggcgagcggggcccacctgccagcgcatggacagcgaatggaagagaaagagaggggggaggatgaggagaggatgatttatgtgggccccacctgtcagtggtcccacccgtacttttggtgaatgacaaatgagtcccacacatatttttttttatttataatgccacttaagcgctacatcaacgccacgtggaaaggagaccgagtcaacactgccacataggcgccacatcagcgaaaccgtcctccaaaaccgtcgagggagtcaaattacactggttttgagagttggggggtcgagatatccggttttgtggtttagggtcacggaattttgagggtcacaaagtgaacttattcctaaagaaaatacagaatgaattataatcaggccgaaagtacagcccaaggccgggccaggcctatatatgtattcatactgacccatgttttcgctggccttagtctgaccatcaacaagaccaaagcccaaaggccatccaacaaactagtcaccctgcatctctctctctctctctctctctgtgtaacattttgattttgtttgaatgcaatttgatcccaaaactaaaattctaaacactaattaaattaatgcgttgcaagtggagcctaaatagctgacgatggacccatcaatcaatactaatagcacttcttttactatctaaaatactatcgcaactttttttaagaaaactttcaattgtaacagtaagtataattagagtataattcaaatgcaactgtgccgggtgagttttttctttcttcgctccacacaaatctcgacaggatctgaattcccccccttttttccttcaaaaatctcactgcaatctaacagtctataagttacggacatgtaaaagtttttttcacccaaaaaacttgtaatattctttagcattatcatttctttttgttacattcagatgagttaatgctttgccatttctcttgacctcttgccgccatttaatcatacagtagagatgtgtagttggattcttagcccaaaatccgtcataaacatctcattccatccactaattatcttcgttttttcaattaagttataatgttattcgatcgcgatattttcactcgtctctcccagtactcatgagctacgtcctacgctttctcctcttgtatgccaacattttactttattattttcttagctactacatactccatcctaaaataatttaaacctgaccatgagaatatgagtctgaacaaggttcgtagttaggatttaatgcttttttatgacagagggagtatataaattcagtagacaatccttaaactaatttattaattcgtcaaattccagccgggtcgaaaaactcctatccaaaacgtaaatgtctgaaaccacaaaccatttattgtttacccaaattaatttccacgtgcgtacataaaattgtccatttcttccgcatatagtgacagtaacaaagaacaataattaagcaccagaagaactaatgaacagtcaatcgattaagcatgcaaaagttcatatattgatcatgacccacactactaactaactacttacttgacactctacctgaagattaattatatatgttcgtccagcttcaataaacctagcctgccgaacacatattacatatatataattatagcttggtcatgaattaatacaaatgcatgcgcataagtaactaatcaattaaagacaacatcacgagagttaataattagttatctaagaacaaccaagcctaagctcaagatccaacccttcctccataccaccaccgactccaagctccaaatccacctccaaacccttcgtcgccgccatcgccgccgccgccgtggagaagaagctgtagacgatggccggacgatcgccggggcagtagcactgctgctgctgctgcggcggcggcggcggcggcggcggtggcggcggcggcgagaggttgaggttgggaaggggatgaggtctagggttggggaattgcctgagcctggccctctccctcctgtgcacgttcatgtggcctcccagcgcctgcgccgacctgaactccctcctgcagtagccgcaggtgtacgacgacgacgacgacgacggcggcggcgacctctgcagcggcggccatgagaagccgaagctgcagctccatggccgctgatgctgctgatgaaggtggccatggccatgctctctcgcgctcctgctctccattgatttactgatcgatttgtagtgtggttgtacaatgtgtagagctagcttgacactgagctgagctagaaggccatatataagcaactcaagaacagtgctcacggaaaactgaatagtccattagcgcgtgattaatcaaatattagctaaatttatttttaaatttagatcaatatgaattttttaagcaactttcgtgtagaaacttttttttaaaaaaaacacaacgtttagcagtttgaaaagcgtgtgcgaggaaaacgagagagatgagttgggaaacttggggtaagaacacattctaaagtgcatgacatgtggggtcccaggctacatgtatgacagacatgtgggccactgcatgtcggtcagacacacacaaactatatatatctggttagtgattttcaaagggtagctagctagtgatgcatggaaagggagagagagaagccattgaaagcagctggtttttgccaagatgtacaaacggcatgcaatcgatgtgtcgaccaagataccgtcagagcgatgagagccaatgtggggaagactatgtgacatgtgtttgcaacccctgcagaagctttccctgcaggacaagacacccgtggctatccagccatacatcagatgcaagagattaacctgctggctttagggttagcatccatgcatgcagatgcagtcacacagggcccaccatttttctgagctcttgcaaagctagtcttcgtcctaggagactgcacagttgcatatatatttggatatggattttcatctctcgaggggatgtcttctctttgcatgtcatcagttataaaaaaatttgacaacatagattaatatgaaatataaaactccaaaaacgtgcaagaccaaattcaacttccacaagttgcaacaaaaagaacaaaataaactgaaaatagttatcgtacattcgcaactatatttgttatttttgttacaacttgtagaagttaaattttaacttatgtgttatggagtgatatatttcatattaatctatcttaccaatttttttaaaatattttgatgactatttaggtggcatgcacgatacgaggggttatcacttgagggatgaaatcgctttccacacacacaatttatctaattgcagagatctagctaggtttgcactgtgatctgagctaggttttttgcttgcttctgactcactccagctagctagctgctggctgcatctgcttatatatatgcattgttcagagaggcaaaaggagtagtgatatgttaccgatgccctgaaagcatacttggccttactccatatatatttgcattcaactttggtcagcatatgttagagtacactgctcttgtgttcatctttcttcctttttttttcttttgtttcacatatgtaatgtatatgtatattcgagcttcatcattggttaggtgtcatgtctagctgcaagacatcacatcagtcaatttaagttgttcacagctgaattgaatcaatgaatgcatggagtggttttcatttttttctgggtcaactcggtcgaaagattgaaggcctgcaggcatgctatgagctcttactggcttgtctgacgagtgaacaagccttttggcagtttgcactgcatcccattggccagcatggggcgggcaattcaggcttaggaacacatgatgctcttagaaaggtgaagtaattgttgctaaaagtgtactagagtactagctacaactgttctccccaacacaactatatatgatccttgatggcatgatgtcccctgaaaattgagatggtactattatctctttttttttacttgatgtttacaacaatatagatacaatcttcagtgcatatgtttggtcattcctttttattatgtatttacaacaaaaatattggattttcagtgcaaattttcagttcaatagaatatatttgattttaccattatatttgttacaattaaatcattacaataagttcatattttgttatatttctgataaaatatataaatatgattatattgctaattaaattaattttatattatacataagatagcgaattataatggttgaaacattagaaaaatacttactgaaacatccaaacaacaacatgagcaacatttataaatgaattaatgaaacactagaacatatttactaaactatccaaataacaccacatgcaacacatgcaaataaaccagtgaaacgttagaaaatatctaatggaacatctcagtaactttcgatccggtgtttcggaaaacatctaatgaaatatatatatatatatatatatatatttcgaatatagataaagggtgtgttcgctgcagccggctcccaatgtacgcacggaaaacagagcggtccattagcacgtgattaattaagtatttgctaatttttttttcaaaaatggattaatttgatttttttaagcaactttcgtatagaatttttatttgcaaaaaacacatcgtttagcagtttgaaaagcgtgcgcgtggaaaacgagagagaggggttgggaaaatgggcatctgaacacagccaaagtgtgtgtcgcacaacaattttcgtccgggattaaaaattattaaataatgtatttctagaaattaaattaaaagttaaagcaatttaatcaagtgaattcatgagggaatcaaaattttcctttaaaaatcgtggctggaaatatttttctaatattctccgtgctatagtatactctctgaaatttcctgtgaatttttggagctcaatatctaattttaacatcacaaagttcattaaatccattaaataaaataaaaaacaaatttaaatctccatccttcactttgggccgcttcaggcccaaagcccttccttcgtcccttacggcgcccactcggccgtcctcctttccttttcccctcccgctcggcctccctcctatctactcccttccctgcccagttcgccgctcggctcgctcctctccttccccgtaagatatctcgcctccctcctctcccccgagccaccgaccgttgggacccacctgtcagggttatccacttcctccggccaaacctccatggctgccagcctccaccccacgtcgccgccaaattcagtgccctcccgctcgcgcgcccgcgtccaaacagcttggaccggtcccctccacatcctccaccatttcccccactctccccatgaagatcaccgccggtttgacctgatgcgccccacatcgtcgccccacttcgccggcgatttccgcctcttttagcctcatgccgcacctccgagacctataataaccctccccatgcatccctatatcaatttcccatcttcctgagctctcctgtgccccaaaaccatcccctcgccgcaatcctgagctctgccacttgccgcaaaactccggccaatcgttgccgctggtgtagtcactgccgcaccgcgc

SEQ ID NO: 28554 - DNA, 2118 bp, Oryza sativa
gaatgccttccgcgccatcgtcccacgggttccgtcgccatatccctgccacggagttccccgtggctccactcgcagccgtcgggcacttggtgagtaccccctcctcctcctctcacggttaccctctcatgcgcctccttccgcgccgcccggtggtaaccggcggtgaccccaggccacgcgcagccagttcgtcgccgctgtctgctcgccaccctctgccttggccgcccgattggtcgccctgaccaatccgggccgtccatgaggtggacgtgcgcccgggccacatgtggacctggttcgccgtgcgctctcccattgtgccgctgacgtgcgaggcccgcgtgtcggctcgacctctccttgatgacatcagcagtcccctttttcttttgtaaaaataattaataattgcacaacaatttgtatttaattccaaaaattgatttaaatggctcaaaacttctaaaagtcatatctaattcatacgtactccaaattatgccactcaacttgtaaaagtcatctaaaattgacttctacatgattgtttacttttcatgaactgtttatttggtttcgcgtgccagcgcgtagattccgtcgttttggaagatcgcgatgttgaggaaagtgtttgaatgatcggttgaagaagcaaggcaagtcaaacattccccttgagcatattaagcctactttataaatgttttactgtttgcaaataaaattgcatgttttgctaatttcgtgggaataggttttacctatctgcttgcttgtgccatgtttaattcataaccatcctttgtcaaacttaggtgataattttactagctcgtgtcacttatgttgatcttgcttggattatatatgcttagccatgcttaattaccactagctcacttaatgggataatcacattatttacatatagtgtcttgttgagctgcgagctcgacacattggaccgttgtttaatggtcgtgagtaatccaataaaaatatgtcttaatggtgggttgtgggtgcatggttttgctagtcgtatccatggcagttaaggactagttcgcgagaaacccttggaagacttaccgcacttaccacaagcaagaatgagcaactgctggacttgtagtgtagcttgtctctagccgacgttcctaggcaagggtgagcgtgatggagttcggatggaccgtgctgcagtctatgcggctgccggattcagcaaggcaccagggggacttcccactgccagttataggggtgggggcgaaacacgatgtaacgctctgctttccgcgtggcgttaaaaagctaatttaacgaaaaccctaattgcgaaaatttcgttctttgagtgttgagtctaagttgtaccaaagatctcaatttaaatctctcctttggtccatcttcgtgcaatcaaaaatcgcctcatcaaaaattccccacctcaagatcccaatcccgattcaagtctccaaatcaattccgaaattcacttccttcctttgaatccttgacaatattcgccccgactccaaaaatatccaaagttccattttgcattcttctccaaacccaaatctctccaaatcaatctttcagcaaaagtctattttacctccctcaggtgttgtgggccgttttcccccttagcccacctccctccctcggtcgtttctcctccgtcagcctcgcacgtgcgttgcacgtgccgagccgagccgagagagagctctctcactctctctgtttctccctctctctctcgttttctctctctcgcgccgacgccgcttcccgccgtcgctgcccaaaatccgccactgccttcgctctttcccgcgctcgcgcgtggccgaccggccggtcgttgccaccgtcagccctgccacgcctgcgccgcgcagccgcccggttgccgccgcgtcaagccctggcgtcgcctgcatcgtgcgctgccgctctgccgctccatgccgctagcttccaaagccgagagaggcagcccctctctcactccctctccctcctttaacttttcccgaaacagcaaggagtagagctccctttctccccctcctttttccttttgcccga

SEQ ID NO: 28555 - DNA, 53883 bp, Oryza sativa
  unsure (1)..(53883): unsure at all n locations
gatagctcagttagcccctcgaacgcgcgtagacgccgccccgagctccgccgccgctcggcatggccttgccgccgtcggcgccccctcccggaggccgcctctcgtcgccggacctccacggcgcctccccaccctatctgatcccagaaacgaaacccttgagccccggagatgctcccgccacctttaattgagtcctcgtcgcccctcggtgatttcccctttctctcgccgccggccgccactgtcgaattccaccgctgtcgaactccctctagcgaatccgagccgttggctcgctccttctcgatgccctcgtcactccggtgtgctccccgaagaccaaatccgtcgcgcttgctccggtgaacatggcctccgtccgccatccatctcggcctccccttcttcctcctcccgccggcctgcgtggctgccacgtaggcgccacgtcggcgccacctcggctttgaccgagccgagccggtcagccgcctcctccctcccccctcggacgcgcggtccatggtgcgccaaccggctgcgcgtgggcccgccgcatccctggtccatccggtgcacgcgcatgaaccgcgctcacccgaaaccctagcaccgccctcatgcgccgctcccacggtgagccgcgccaccgacaagcgggccccactcgggaccccacaaggtggactcggcccaccggccctttctctccctcacttaccccgcgcccccttgggccgcctctccgggccggccggcccattagttcggccgagccgtgcctctcctcttgggccgcacccaagccgcccgaggaagtctaaatcatatccctccttcaatttctttccaaaaagggtttaataaattattaaatcctttttcctttagacagaaattccttaatccttagaaaatccatatcttctcaaccgctcatccgattgactccgttaaacttccaataattccgtaaaaattgagatctatctaatggtactattatctagtctaaataggatctttattttgggtcttgtgtagatttttaattgtttgcgtatagttgcggttaccggattttcgtcgatcgcgggttttctcgaagattcgtgaagcttcgtgaagacctcgagcaaggcaaatcaccctttgaccaattgctcctataattggaaaatcattattaatttgtttgcaacttgcattattagcaacacacatttatagcatgcttggcctcggtttgcgtgccaaaccgacggacctacctagtagtcgcactaattcctgtaggctgtactaccctgaatccttgtcgctccacctttgtggtacttcggtatccgtgctctctgagcgcgtataccaactattccacatacaccgttgtttgtcgataatctgagaaatgggtttgagaagcctttaaaacccgacatgtggtgtcggcgtgtttgaaaataaaatgaattgtgaaaactcgcgatgcggatgctgtgcctgggtggcactgtcccgtattcgcatataaggaccgattcctttgggaaattcatcaagcataacaagtgcaaccacatggtggtatgggacaccctggctaagtaattagctgcttttgggaaatcttgtataccaatagaggcggaaagccgggatgtgggggtagaggcatcctgggagtccgaaacagaggaaggcacccgggagtcctaaaaggaaagccggagttggcccgatgttggtcagggagaccctctatgtggcatgaggtaacccagagttagctttggaaatgccttgtcgcgaatctcccttttccagccgtgtgtcatgaacacgggttaggtgatgggagcaagttcgtgttgtgtgggtaaagtgtacccctctgcagaggttaaccaactgttcgaacagccgtgcccacggtcatgggcggatgtgaggtggttcccgttgcgtagatttgtttgcctgtgctttgtgaaaagttgttgtggattgggaatcgtaaccagaatcagcctaagtggcagatggatgacctgagtggtcagaaacgaatctgtgtgattcgggatgtctgcgggcatcatagactaggcttcccgagtggaagcggattgttgtgctgctgggcagctggactctgggagtccacaaaaatgaaaaggctctgggagccgcctaatcaagtgaaatggctctgggagccgagaagtaatgatctgaccttggaggtcggtacattaccaattgagttgttgaaaagcatctcttaagccgaatcgagacgcaagtctcttttcaacccaaacctaaaaagaaataaatcacttagtgatttcaaaatgatttcaaacaaaagatttgcaaaacaaccttgcctctcttccaagcttgcattaaacacctaagttcccgtgacttgctgagtacgaaagtactcacccttgctctctctctctctctctatatatatatatatatatatatagttcctccgcccggatgctgaagatgaagaaaagtgaagattagggtttcgtcctggttcccagccgtcgcctgtggtgttgggtgttagaccgttggttccactgctgctgctgttgctggtgtttcctcgtctgtgtcttcggttgtattctcaggctgtcctgagctgcaacctaagttaaggtaaataagtcctctacttattttaaggatttgcaatgattcatatttgtcaccgtgggtaccagcactatgtcctgggactggtactatgatcgcggtttcgtaggaagcggttcgcgccgtttttcctacgacacgctcctgtcaggtgctgttgtacggcggtgccggattggggtgtgacacacgaggtgtggtgcgcttggttaggggggagttatgcgaagggtcttgtcacaatctctcgcatggtaacgtgttaggcatggcatggtgtcatacggtggattgtgtctcgtgggtacaattgtgcatctctggtcagagtaaaaactatttgaatagctgtgcccgcggttatgggcgatcgatcagcttcaccgtgatttgtcccactctattaattaaattgacttaatgaactggtgtagttcaagtggaatagttgggtttgttcaacatagttatagcattgataagtggagatttaatcttgagttaattaaacaattgttttaaactataaatgtttacaaccgtctttacgcaaatagccacaaacctcccattgtctccccttgcatgtctgtatcattggtgtggcttgctgagtacggtggttgtactcagccttactgttactcccccttttcagaagtgttatgcttctgagctgaagacagagttagaggaccaaggcttataccccagttgagttttgcctgtggagtggagctaaagccatgctaggatcacctttttccgctgttgttgctttctttttgtgtgaggactaattgcctattctataagtatgtacgctttatttatgtttggatctgtatattaatttgtcgttttgtgtaccttggctgattcctagacagggacttaatacacaaaatactctagaaatttcggctaaatttctgggagtgactgtgcatgcaaaatgagaaatccattagcacatgattaattgagtttaaataatttcaaacttaaaaatggatttatttcatactgtaatggtacttctacatacaaaattttcatatgaaatgtatcatctagtagtttgagtaccgtgccaacagaaatcgatgaaaaatatgtattttaatcagaaaaaagaacggggcttagagtggttttgacaaacaaacagattgtgttgccactccgataatttcgtgtagagtcgtattcggagacatttaattgtattttttctctcaaaaacggaaacaaatatggcatcaatgttattgggtagatatgaaaaaaagtaagaaaaccgtgtatagatgcctaccaaaagtaggaaatactttttttttcacctacaaaaataaaaacttaaaaaatgcttttcataggcaggtcctaaagagagccacccgtggaaatcgatttacagaaacattcgtaattcagcccgtgcaaaaaccagcgatttctataggcacatggttgtaggtggatcagaaaacgctcgtgtaaatgggttatcagccacctgtacaaatgttttatgtagtagtgcgttttactttttctttttcttagaattcctctaatttattagaggtgacacatggcagcagggtttgtaagaacatcaccaacagcatctcgatatcatttcctatctggtattttggagatttttggttaaaaattgcatccaatagattctcaaccaactctcccaatccttccagttaccaattgagttcgctcccaatctgtctaagggcggcgaggcggcagttagggttgcatgcgagcgtgatctcatgagagcgaggagtgaaaactgatttctgttggaagtatcctaatgggcccacctttttgtttttaggaaaccaattatagctaatgtgttggagggatgttcttggtgatgcatgctcatgtttagtggattttaagaatatggataatatggagattgctacctatcggacgtatgacattttgcaaaaaatcggacggtgtttcaccacatgtaaaaaaatgtttcaaatgtttcatcactcattgaataatgtttcactaaaaaatgttttagatgtttcattactcgatgagaaatgtttcaccacttggaaaaaaatgtttcaatcagataaaacaatgaaaaaacactggttgcaacattaagactctattatgcaacatcgaagaaaacacatcgtacatcatgtgcaacatccgatgaaacatggatgaaacacacaaataaaatagagtgcaacaaacatatacaatatattgcaatgcaacatgatcgttaagaatgatctcatggctctattcagagaatttcataaagggacattacccctttatagcctaaactttgggatcatcgtgctgctgccaaaaaaggctgatgcaaaacaaatttaacaatataggcctatttgcctactgagtgtaggctttaaaatttttacaaaagttggcaccaatagaattacagcggttgctcacaaagtcattcgcccaacccaaacggcgtttttgctagatagaaatatcatggaaggggtggtgattttgcataagactgtccaagagttacacacaaagaaaatggatggtatcatattcaaaattgacttcgaataggcttatgacaaagctaaatggtagttccttcagcagacattacgaatgaaagggttttcacaatcatggtgcaattggatttccaactgggttgaaggaggaactgtaaatgtcaaagtcaatgataatgtaggaaaaaaattccggacatgcaaaggcttgagacaaggggatccaatgtccccaattctttttaacatagtgactgatatgttagccattcttattaaaagagccaaagccgatgtccaaattagaggggtaattccacacttagtggatgatggtttgtccattctccaacatgccgacgatagaataatatttcttgaacatgattttgaacaagcaaaaaacatgaaggccattcttgttgaacatctctcggggctgaaaataaactttcataaaagtgaaattttctgctttgggggagctaaggaaatgaaggatcaatataaacaactgtttggttgtaattctggttcctttccattcagatacttaggaatccccatacactatcgaaaactcagaaattctgattggaaatgtgtggaggataggtttcaaagaaaactgagcacatggaagggcaaaaataactcctatggtgggatattggttcttcttaactcggttctttcgagccttcccatgtttatgctattcttttttgaaatacctcgaggtgtacttcgaagactggatttctaccgatcgagctttttctggagcagtgatagccagaaaaagaaatataggttaacaaaatgggattatatatgccggccaaaatatcaaggtggactgggtgtcctaaatcttgatatcatgaatagatgtttgttgagcaaatggctattcaagcttcttaatggtgatggcctatggcaaaatcttttacccaacaagtacttaaagggtaaacccctctcccatatgtcacacaaaccaggaacatctcaattttgggttggcctaatgaaagtaaaagatcaattttttcagtatggatcttttaaacctggtaatgggatagagataagattttgggaagacacatggttgggcttgcaacctctcaaatatcaatatccttctctgtacaatgtggttcgaaagagacattctactttggcagaggttacgagcacaacaccgttgaatgtttcattctgacgatcaattgtaggaccaaagttagttgagtggaatgatttgatttctcgactagctaatataaccctgtcaaatgaaaatgattgctttatttagtcgctacataaaaatggccatttttcggtcaaatccatgtataatgcgatcatcaattccaatgtaaggatctgtaagaggatcttatgggaggtgaaggtaccactaaaaatcaaagtatttatgtggtttcttgacaaaaaaaagtaatcttgatgaaagataacttcacgaagataaaatggaggggaaacaagcaatgttgattttgtaatacacaagagaccatccaacatcttttgtttgactgtcatgctgcacgttttgcttggcgatgtgtcttctttgcttcaatattccctgcccacaatgcaaaagatatttttggtaactggctaaggggagttcctagacccacaaaaaaaataattttatttggagctagtgctctatgttggtcaatttggcgttgccgtaatgatatagtttttaaccataaaaaaatgcctaacatcatgcaggttatcttcatatgttctaattggctccactcttggtgtatgatgctttcacagaaacaacaggatactatgcgcaatggtgctacacgcttggaattggtacgtagccaaggaacttttattctagtttggatagcgtagtacctacagaatttcgtgatagaatctacgtgattttaaaaaatattatttagtagatcatattatcggcaaaagttggggatttgtcccatctcgccttttttaagctcttttctgttcacttctggactttttggttgtgtgcctatggacagaagccggagatgtaacccatttccattatctaaaataattgcaatgcaacatcaaatcaaaataaagtgaaacagcttactacaatagagtgcaacaagctaaaacagtaggatgtaacatccctaaactccaactaaataaacccgtctccgtcttcatcaaaataaacccacctccatcttcttcatctccggtcgccggcgagtccacctccatcaccggcggcggctgttcttgctgtagcgccactacgcccaccgccggcggggatgggggagataggtgcagaggtggtttacctggcgaggccaatggagggcggcgttggagcagcaggagaggagcccatcggggtagaggaaggtgcacaagcagccgagcatgatgccaacggcgaccgccgccgcgatgcacgaccccaccaccgtcgtgtcgtgccgcccccacccctgtcggcgtggtcgctagcctcctcctccctcttcgcgtggtcgcgagaagcagtgctacggtgttgaggggagagaaagagagaagaatgatagagataaggttgatcggtggagagaaaatagtgtgatagtggttaagtgggacccactcggtggcacatctgattttttgcgccgtatcgaaattccgttgtaaagaattttcgggataatatccatgaaagtgacagagacgtaggcatgagtatatgacacttaatttgtctattcgttgcggaaactggacgagatggaagctgttggctcttcagagtacatccggataaaaatacttcctaaacatacattgttgagagttgcatgctttaatttgtagtagtacgtacgtacacgcaagttttattttaattcatagcataatgcccgtgcttcgctacgggtaaacaaaatttcatactaaggccctgtttagtgcccacgcaaaaattttacaccccgtcacatcgaacgtttgaacacctatataaagtattaaatataggttaaaaaataactaattgcacagattccaactactttgcaagatgaattttttaagcttaattgcttcatgatttgacaatatggtgatacagtaaatatttgctaatgacggattaattaggcttaataaatttgtctcgcagtttgttgacggattgtgcaattagtttttttattaatgaccgaacaccctatacgaaaccctatataatacccaatatgaaacgctaaaactttacgcccctagatctaaacatcctcttaaagtatatttcatgataaaaacaaatcacaataaaataattaataattatgtgcttatactacatttcttggtaaaacgaataacaaaataattaaatcctatgagtaacattcacaggcctcactaacgcaccaagatttttaatttccaaacaaccaagaatttttggatgaaaaaagtggcacgaacgagaccagagctacacgaacgtgacaccgtgttgtgtcgaccaccaccgtcgtcttcttctcctcctatggcatttgaaattgacaaaaatcaagaggagacacaagcggacgatggacgatggacgaaaatcaagccgagagaagttgcgcgctgcggacgacggatctctgtttttttttgtccgctgtatgtgattacgagcgcacagacacaaagggtgtagctctcggtcggattacggacgataaaattgtgacgattggaaaattactaattttttaattagttaagatttgaatacttcagagcagatgatttttgacaaaagaaaaacattatgatcaattatacgtcgccacgccagctgtcacgagtaactaacaaatgaaggtcgtactatatatgtactcacgcagattgacgctcctgggatcagtaatgcccatggtctttttctacatatgtcattttgacaatctagcaacacacaacaataatcgtcatttgatacatattccatgaatgattgatctcttttgcatttgttcgtccctttcgttttcaacttggtactcgtaatttcttttaaagaacaactacttgcaattcccaaacatggagtactacatttgtctagcttccatcaaagtatatatatatgaaacagcaaccttcaattaatttagctctcgttgatcgattgatcgatcagtttgcaggctgtgttggctgcatcaggtcagcaattaatctagctagtcatctacggctagataacccttgcagttctcgtctacacacttctctttgcgaggtacgtatgtgttctctttgtcttgttaaagttaatttcgtaaatataatatagattatttgataaaataatggaattaaattatagattttgaagaattgtgtcaagctggaacctttttttaattctcaataattttgtcatgaccttgatgctagaattcttacagcgctatggctttgcagtttcgtgacatatatgcatgttcattgctaaacctgtagattattcgtagataaatcttcttgattaaatatatatgtttacaataattttattaaactataataaatacattcctgatcaagaagcagaaactttgcagagccgttgttcatcatggcaggcgagcaaggttcagctatggccaacagaggaggccgggcaaatcggaaagaaggggaggacgagctacgaggctggctgatgttgctggcgacgctgacggcgtccatcacgtacgcggcggcgctgaaccctcccggcggcgtctggcaagccgacgacgccgccaaggacttcgtcgccggctacccggtcctcctcgacaagtcgccgtggcgctactacgtcttctactactgcaacgccacctccttcgcgtcgtccgtgtgcatcatcgtcctgctcgccaccaacttctacctgagccataccagtgtcatggtcttcaacgtgctcgtcgccctggacatggccagcttgggcgccgcgttcgtcgcgggctcgtcgagcagcaagcggtttacggctttcaacgcggggctgatggtatgcctcgtcgtgctgttcctcctgtggaaactgaagtttctcatgggtaatgatcaagcaggtcaaaatcctgctagtggaggtgtcgccaatttacaacatggcaacagtgcattataaatttataataatgtaaataaatttctctgatttaatcatgtcatggtagatgtataccggatataatgcctgctgcctggcactttgctatggaacctaatgatgaatttatacgttaaataatgttgaaatatggtatatggatatattttaaaatttaatattatggaaatgatgtcgaggatatatagcatgatgatatgattagtcagtacacgatgtgatatatttatattttgagctttagaagttcataattattattggatgatgttgcggtatatttacatattaactttaggatctaatatttactagcgggtttcaattttatacaagatatactacattaggaatgtttatcgtgtcattacaaaatatttcatttttattggctagaactagattatttaatattaaccgattggatgaaagataatattacaagatgctattgaaggaactagaaatgtaagtgccggttccaaagaagtttaatccatctcacaacatgccattttaaaaaggtaaatcctattccaatcatcctccaggtgaccaaaatttaaaaattctgtagctcatgtatcccagcaagttaggccgtctccaatggacagctcttatctagctcatagagtgttttaatcgatgaacaggaccgctagctcttcttcaagcgttagctcgcacgctcaccgaggcggtgccctctcacaggcacgctcgcccaggcaatggccggcactatgccgagcgcgtatgagctagcagccggctcataccgctggataaggccttagacaaactgagccaatgccacaagcaacagtggcgtacattcatgcacctactcctctatgggtagatctatttagagaagcttctagcatctatatattcttctacaattttcagctcccagatttttattcatgtactgagaatatatatagtttcagaatctatatttacgccaaacttttcatgtactgaatatgaagctgaaaaactaaacttttctagcttccgaatcttaagcactcttagacagtacttaagccagtgacgagcatgcgagtggtttggacggacaaacacatcgtgcccgctctgataatatacataccattgtactcggagacatattaaattttaaattggagtttttttcactcaaaaagggaaacgaatatggcatctctagtatcgggcatatatgaaaaacagtgagataaatatgtatactgcctaccaaatacgaaatattttcttttgagcataataaaattcaaaaattcaattttatggatgggaccttaagagagtcatctatgaaaataatttttaagggcagttggaaatttgcccgtgcaaaaccggtgatttctagatgcacacgcgtggtggcaggtgggtataaaaatgcccgttatcagccgcctacaaaaacgtatatttgtagtagtgtgttttgctttgttttccttaattttttctctaatttattagaaatgacacatgatggtttaaaagcgtttttagtatatttaatgaatttttaagaatataatagatatcccatgacagggacagagatgtaggctgagtataaaatgacgattatggttatatatcagattgacgctcttgggatcagtaatgtccatggtctttttctacatatatgtcattttgacgatccaataaacgcatataacaataatcgtcattttatacatattccatgattgattgatctcttcttttgttcgttcttttcattttcaactttgtactcgtaatttcttttaaccaacaacttgcaattcccaaacatggagtactgcatttgtcttccatctcaagttcgacatatatacgtacgtactaacgtacgcatgagagtatgtacgaaacatcgacctttaatttggctcgttgatcgatcgatcagtttgcaggctgtgtgtagctaagctagctagccatcgacagctagataacccttgaagttcacttctctttgggaggtttggtatgttctctttgtcttgttaaatttaattttatgaatagaaattctttgataaaatcatgaaattaaattataaattttgaagaaatgtgtcaggccagaacttttgaaattcttgattttgtcatgaaatcgatgctaaaacttttggctttcaacgctgcgctgatggtatgcctcgtcctgctgttcttgtggaaacgaaagtggctcatgatgggtcgagcagcggcgaacccaaatcctactagtggagatgtcgccaatttacaacacgacaacagtacattatagtgtaaataaatcgctgaattatatcacggttttacagatatgtatatgtatactagataatacctgcctggcgaactggtgataataggatgtaccaatgcttatttcctccatttagacactgcagaagttctgattgttggtacactttgtaccgtgtccttcccaaaatgcccttcatccactaagcttgggggaaaactgtggagtgtggacgcccctgttcctcattcatctctctacccctctcctgtcctcaaatggcttcgcccttcgggtcggagtcccgaaccccgtcgacgggctgtagcggcgacgacaaccaccaaatctggtcggtggtcctcccaacgacaggcagcagtgaagacgcggtggatctagaggctgccgttgtcgctctgcaatggcctcataaacatggtgcttggcttctatgacctgcgggattggcggctagcacagttgagctcctgagccagaaggtaggaggagcaggctggcgttttcaccatgtagcgctggcgcggcaagcaacgcggtggctgcgacggtgagggcacgcgtcgaggtggccatccgtcgtagatctcgggggaccccatcctgctagccgcactgggaaggtggcatcatcctccccgctacgctagcggcctagcgccagaacggtccagcccggactagaagcggttccagggcaagggtgcttcaactcctttggacgaaggaggcctcaggcgtgggaagtcctccaagatgcgccattcctctggcaagcgcgctcgtctctctcaggagtgtggtgtgtaggagactgaagacgatgggggcaatgttggaagcggcagaaaaagtacctaccccaacatctgcattgtgtactttttcctacagtaatatttcatttggtgggaggacgatgcatctcagtatcacacatcttagcacctattgacagtgcagattgtaggtgcaggcgaacccaagctcaaatctgtattttcctctctctctatatatatatatgtatatatatgtatgtatatttcctctctctatatatatatacagaatcattttcatatatctataactaatataaatattcatatttttccttttgtcacatctaatttcgtccgagttttgtccatacgcaatccgattaagttagcaatagcgatggaaaaaaattgcaaaaaaaaaaatggcggccgccgatgccaccaccgcccgcctccactccgtccaggccgccgcccctcccgcctcgccgagccgcagccgcctccatgccgccggatctggcggaggtgaggtccggccggccacctacacactgtccgacccaccgcctctatgtcgtccgtcaccaccaccgcggcacctcccctccccccgatctcgcggaggggaaggcgttgccggcccttcctccgctgccgcacagagagagagagggggagaagtggagacagtgagggtgggggagggcatcgcggtggggagagggccgctgccaccggatctacccatcggagggcgccaccgcggccactcgcggtggagaaggccgccgttgctgccgctagctgtgggagagggcaccgctgtggccgctcacgatgggggaggacgtcgccgtcgccgccactgctcgtgatgggggaggtagccgccaccccgcgtcggtcgcgagatcaccggccgccgctgaggatgatggggatcgcggtagggcggtagctgtcgccgtcgccgccgctgctcgcggtagggcaagtagccgccgccccgcttctgccgcgagatcgccaatcgccgccgccgctgctagcggtagaggagggcatcgccccggccgctcatgatgggggagggcaccgctgtcgccgccgctgctcgcggtagagaggtagccaccgctgtcgctgtcgctgctcacggtaggacaggtagccaccgcctcacctcggaccccagatcgccggtcgccgccgccactgccactcgcggtgggagagggaggagaatgagtttagggttagggtttcaacatggaatgttttatatatatctcgagtgatcctaaccgttcgattgaatccgacggctcttaatgcatctaagcagacttgggccacatgggccatgtgcacttaacaggccaagttgtggaagacattcggcccatccttatgggcctaattgagttttatctattctgagttgatttaaactatttctccattaacaaacttaatattttcctatgtttagtttttctttcttcatgttaaattatttatatctaaatggagtcaacaaaaaatttaattgtatatttgtcatgatatataatttaaatttggattaaaaataaataatagagtaaatttcattttggaccactttttattacccgtgttttgctttcgaccaccccttaattaacgcattcactttggatcagataatcttacctttgttgcattttggactaccctaactctcttctcaagcatatgaacaatttcgagtacgctggctccgattcatcagtgaactcccaccactttataccctacaatttatttgacatatgacaagtttgatgtagatagataaaatatttgagtgtgctccaaagtgacacaaaggtaagattttctggttcaaagtgaaaatattagttaaaggatggtccaaagcaaaacaccagtagtaaaaggtggcccaaagtaaaatttactctaaataatattaattatttcttgtatggactatagcctcttttggagaatattactctcttccaatattacttattttataattcataattttttagtccaaaatacaaaaagaaaactaaaatacacaaaaaaaaggtttgcagtacaggagttcggttagtttttctttcccttttcatccaggagtgttggtctgcccctcttttctttccgctatttttagcgctcccactaacacaattttatagatttctgtcgcacactatattgaacctaaaacaaaattcagctctcacaagtacaatgcatagaaaatcgagtataatctcacaattacattatatagattacaagaaaatataatttccggatgacgtgtattcagatgtgtcctttggtcaattccattcatttttcattaggattatgtactttcagaagcgtcatccacaacacacaaatataaagtaaattaattgtcaaaaacaaacatgatttgtttatcactctacatatagccgatgtaatatggtgttttggtaaatcattaatatcaaacttcagtcaccccgccaatacccagtgcaacgcacgggcattttgctagtgagtatatatatatatatatatattctacacccacctcccccaccctacttgggcccaaaacccccctcccacctcagtcaaagcgtcctcccgccggtcaaacccgcccaccactccttcccccacccaccactttgttgctctcgtcttacaggaatcgtgcagtaataggacggtcatcgtgcagtaacaagacaacattatcgcagtaacaacgtcaaaaagtagccatgatggatctagtttcgttaagcgtttttttatgaacttcatggtgcaaacggattggaaatacaagatatgatatgagagaaattgctctctaaagattgagatttacctcttttttagtcctcgtctcactagaacagcatattaacacgacggctaatatgcagtaacacgtctgcttttcgtagtaataacgttaaaaaatagttattatggttctagtttcgttaatcacttttttttacgaacgccatgatgcaaatgggttagaaaaataagacatgacatgtacgttagtactctctaaagattgagatttaaaatactctagatctaaaaaaacattactactatagggccactgttactatgcatgttctctgttattgcaaattttgtcatattgttactgcaaaaagtgcagtaacaacctataaagtttacagtaacaacctataaagtttacagtaacaacctataaagtttgcagtaacaacctatacatttttgcagtaacatatgatgttactacccttttgggataatattactgccgaatcatagtaacaaggtatgattgttacatgtacataactgatttgttcacaaatcatcatatggtaatttggttagaagtgctcgccatgaaccatgagatcatggattcaagtcttgaattcaccaatttatttttattttttctaaaaaagagagaagaaggagggagagaagaaaaaagaagaaaaggagagattagggggatgagagatcgagactttgggaggagggggaggagcgacgggagggagagaggaaggggcgcggcgggagggggaggagcgacgggagggagagaggaaggggcgcgggagggagggaggtgaggacggatggaaggtgggagggggtgtagaatagttataataagggatgggtgtataatagagctactttcatgtatgtagaaagtctaaaaaaataattgatattaaaaagttccattaataaaactataaataaaagctaacaaagaaaagaaatatgaaaaaaaaggaagtagaagaaaaaaaaaaagcttgattcgtatataggaggatcatgtgaaaagagaaaaagggaaaattaggaacaacataatacacgcgagtcctctaatcctcctcgcgtgtcctctaattcttctcgtctagatccatttgtgagattactagggagcgaatgttcgctcgctagcctttccaggaaagtggtgccaacctagaggctgcgcgttctaaccaaattcgtgaagccaaaaatgatggccccccaactattttggagcatttatacggtgaaaatactatcacgcggatgatcgcgcgctcgcacggcagcgaccatgtcgggtttgcttttttatggatcatatgtgattttttttttgttggtccatcatgttttcccattttggcaatatttcttgtgcgggcctgtttgatggttttttaatgggctagacgcatgtcgttctcttcgtgggttgggctcgttacagtgtaggctgaatatatggcccaatcaagtgcttgtgtttttttttatttgattcgaatattatgtataaccatttgacaaatttttctccaaaaatttgacagatgtaattacagtacaattgtagtgtaattacactataacttatatgtaattacactgtaactatagtgtaacttatatgtaactttcaaaaatctctccgtaacatgttatttcggtaaaatggaggtcgtgggaacaaattcttttcacatatgtgtgtgctatgatttgttttcttcctcaccaaaacaaatcgtgtaatagatctaacgattcaaaattatgtgaaacttacatataagttacactgtagttacatgcaagttacagtgtaattacatataagttacagtgtgattacactacaattgtactgtaattacatctgtcaaatttttggggaaaaatttgtcgacaaatgtataggtagtccctaaactttatacaatttatatgaaatacttttacatataaagttttcaaatatttctacgtataaagttttaaatgtttatgtgcataaagtttctattccaaatatttatgtgtgaatttcaataccgaatatttatatttataaatttgtatatcaaatattttatgtataaaatttgtatagtaaatatttatacatagaaagtttctatatatggaagtttttatatataaacttttttaggccaacatcgggcttctccattcgtacgtgggctaattgaaacatgtgggggcaatcagctacagtcgtttatatgacaaatcacaaagaggggaggaagaggagcaaaagtgcggccctctctcaagttgaggatggtcgccttcttccccaaccgtcgtgcccgccttcctttccaacagcccagccgttgtgcatgatgacgctctctctcgtggcctgatcttctggtgatatgataactctcgctttgatcaagtgcgacgtttgcgacgtggctaccaaccagaacaagtccaggacgccgtgcaatcgctacaccacaaatgatatcgtaccaactatgacgcgcggttgatgatccctgcaatgcaaacgagagaacattgcaagaacaagataagatgcagtctaaatattgcgaataggtgattaagcacaaaggaatagttacgattgaagtggtagatctaaccgacccggcaaatcaacacaccaactattgggggctctgaatcaatagtcgccgattaatcgagcgaggactagagacaaggtgaatggcacttggcaaaattcaactaaacaaaacccaattgtttttgaggatgtacaagttatttatagaggaaaataaagctagggttaagtgctaattcgtggaggtggagggggacagttccgagatgggcctagtctattacacggcccaaggcccaagtttggtttcagcaacatcactgccttgttttgaagattcccattgactcggaatgaatttggatatgggactggatgcgtttgaaaggtagcgagataagctttccacgaagtccaagatcacctaaatcggagttggcatgaaggcgctaggtccatttgaagttagtgctgtctccggaggccgaactggattccaaaacttattagactttaatatcttgtagatcctccattcatccgatgtattctttggcaatattttatatttctcatgcttggttgtatgcatatacttgatgatcacatcagtgctcgtcttccacctcacggtcagtggctcgcccacttccccgcctcccagccccgccctcgttcattggcctccccgcacctctgctggtttggcttccgccgattccgcctccgctggcatgccggctgcatctggggaagagggagaaggagaacgggagaacatagagaagagaaggaggaagtggggccactattttttaatcagtagtcccaggggcttcacgagtgaccagaaattctcccaaaacaagaaacctgatgatgtttgttcacacattgctaggatgttgtatttgtaatctatacaaagaaaaaataaatatcgaaaaatcttgatcaatcctggtccaatgaactgttgaaagcgctaggtggtccttgcatgcatggccgatgtggctccatcagtccatgtgcaattctccatcctgtcctgctttggccacactcctgtagaatatccaaccattggatcacttttttgtttttttatggaggttgtggcctgttggccccaaagctgacttggcagccgtgatgacaaatttcatgagcactgcatctcgatagctgacaaaatatgacttcatatatgtgtaaacatgaaatctattgtagtatatagaaatggaagtttgagatttgtccatgtcactatgagtaaaattgatatatcaatgtcgtttatggggaactggtactctaagaaccagtgttattgtggtgaccccaatgagtggaattctattctgtagtttgcagtcaaagtttatcaatcaaataagcactagcaaaacacttttgttaagtgcatgaacgaaaaatatgaatctggatcgtgactagagactcgtgagggcaaccgtgattatcccttatccgaaggaaggtgcatgattccgtttggcctaccaggggtggatatcaagctaactcggtttggctcattaatatcctacgagctaaaaactggctcggctcagcttggctcgtttgaggcctcaactttgtatttcccaccggagcctctaattttgagacggccctgggaaacactcgtagttgtggacggtgctggcggcaggtggcggcgttcgtgctcgctggggtgcagggcgctgggatgccaacaggaggcggctgcacggggcgttcgcaggcgagcggtgccgggggcaggagcgcggggatgccatcagatggcggcgctgggaatctgcggacggccgacactaggcacacgcgagcagcaaggctagtgctacacctagcgcctagagtgagtaggaggggatcagggagaggaattagggtttgatgcttggtagggccattttgggctcgtttttgttgggccttccccatgatggactgatatgtagatatgaagtgttaggtttgggtttctgagctcagctatgttggctcctttggtttgtgagcagctcacgagccggctcattatctctaataacgagctaaaacatcatctcaactcattaagaaatacaacaagccaaaccgagccaaccacgagttgagcgagttaactagttacgagcttttcgtccaccccctagacctacctactggcaatttctcactcttcaatgcatgcgtatcttctttctatccattggacaagcttttggaccttgctaacttggtttgatcgattggtaattggatctcttacagaggggatgtatccctcgttgtaaagctaatttgtcatgtatttgctatggatctctcccactcttgttctcttactaattcggatgtattagttagttactccctccatttcatattataagacactttgacttttttaagtcaaagttttccaagttcgatcgagttttcaagaaaatatagaaacatttacagcatcaaattaatttcattgaatctaacattacatatgttttgatgatatgtttattttgtattcaaaatgttgctatatatttctataaacttagtcaaacataaaaaatttaatagaaaaagttaaagcatcttataatatgacatgaagggagtgagttctttttattacatggaagacgtacacacttacaagcgcacctctttaattagacacatccttgagcaatagatgccactaaatttcacttaatcatatagccgacttcactactagttcattggtcctcactacggaaccggcatatcagcattgacgtattcagaagcctaaagagagaagcgttttccaaaacaattatcccaatttggcatttctttgaaaaagttttaagaggtggtgtttcacactatccccaacggccgaaacctaattatcctatccctaaaatagctcaactaatgtcaataagagaatgaaatttcttaattattctaaaaaaaacaaatatatgtcatatagattgtcattatatcctatatatatatgatcctacaagatttgtgtctcactaaccagttatctatagggttatggacaaaaattgacctctgttactgggctaccatgcttggtgcattttgatactacgtacctgcattttttatactgcatgtattttgatactaccacaaggccaaaaaacatactggttaatgaaatgatgtttgttcacaataggatattggaatatgttgtgtataccactggtttaaagttttgtcatatcctgtacaaagagaaggaccatggtccaggactcatggattgacagatcctgatccaatgaactgaagctctggtccttggcatgcatgtctgatgactccatcagtagtccatctgccaattcttcatctatccaaagtccaaaatgtacatagcacctggaccacccaacttgcctgttgcctccatttgatcagttaatatggttaactaatccatagttttataaagcagtttttctcttcgactaatgtacacatgtcactacaatgaaaacgattttacagacagctaaaagtgcttttcacatgtgggagagaaaatcgtctgaaacaaattaagggcctgttaaaataggtcatttccattagtgggtaaacgaccgtccgtaaagattattttcgtatgtggtattcttaaccctgccacctatagaaatcgattttcacacaggtctgttatatggtaactgattgtgtaaatgaattttttatgccaaataagcactaaaaaatatttggaatcttagaagccatctatacattgtaaaaattgatttctatacgtgaatgcccaagtcaatcgcctaaataaatgatgttacttcttaaaaggcggttgacttaattatcctctaatctgccattgaaaattgatttccagagccccccccccccctcccctcctcttcttttcctctgctatgtagcatgtctcattttcctctactatgtagtatgtgtttaattcaagcatatatattggcatggtttgcacaattgcacactgcatttaatcaaattcggtggttatctttctatagcaaagagttacagtatactgacatgcttggcttcaagcgcgctgttagtttggatatacggagtatattggatggagtgggggccctgctttggcgccaagctgacttggcagccgtgatgactgatttcaggagcactggatctagatatatactccttccgtcccataatataagggattttgagtttttacttgcactgtttgaccactcgtcttaattaaaaaaatttagaattattatttattttttttgacttactttattatctaaagtactttaagcataacttttcgttttttatatttgcataaattttttgaataagacgagtgatcaaacactacgagtaaaaactcaaaatcccttatattatgggacggagggagtagacaggctgcgaatatgcaggggaaagcagctgttgctccaatccaaatttcatcgaagaaagtgcatcattgaatcttgatttttttttgttcacctttgctcctttaatttccaactgccaaacgaaagtaataatataatgcaacttatttggagaaggggttgatattgacaatttttctttccttggtaaggaaaaactgaaacactcagtcggggatgtaatttcagccgatcgatctgtccatagtctatcttgcataacctatgcaaacacattgcgttcagcgttaggtccataatctacaaggtgtcgcagcttagccaattagctgttatctgcttcttcttcttcttcttttttttttgaaccaccctgctggcctgctgtagtgctgttgtctgtttgttgaagcatggagattgtagagggctggattaaatttggctgggcatgggtgagatgggcggctgcattgggcccatccatgaaagttagggcctcaactcataaattatataggccaactaagcaatgggatggaactactaataactactaatcccatggcagaacgtgagtatatgttaaacaacaaccaagctacacaggaaaattctcataaataaactacgatgaaataatatctttttttttagaaacaaagtacaaacgcaggtgctcacaacgtgcgcacactcaccctatgaacgcacacacgcacaccctacccctatgagcacctccggaagactggaccccctatgagcacctccggaagactgggccgacatatcttgagattgacgaagtcaccacaggcacctcgctgtcgacgggtacgtcgcctaccactgaaagaataattagccgtaaatgtgagcacccgtgtcaaatctaggatttgaacccgggtgggctggttccaccacaaggaacctaaccagttgagctatgctcacttcacgatgaaagaatatctaaaatcactctatttaaatttttttattttggctactcctaattagcacgttatgccatgcaagtgcaacagtcaaatcctatcttactataaagtcgacgtccaccaacttataaaggtccaacttataaaggtcaatatactaatatgttatatcatcacacactagtactctcatccttaaagactttaaggatttttttgtgggatgtgacatatcctagtataatgaatctggacatgcttctgtccagattcattgtattagaatgtgtcacatccaaccaaaatcccttatatttacggacgaagggcgtaattagagtatttcaagaaaaggctatatgacatactaactttttcttactaaattcttattaatactgatgtgtcacgttatgagtacatttagacttttgatgacttctaaagctcaacatgcaagtgtgtcacatcatcacacactagcaattattatctagagtattttaagaaaaggctatatcactagaacggtaaccaccatctcaatcgggtgtatcgaggagtgatcctctgtagcgggagatcgtgagaccccctttcgtgagttcggccgggggaaaaagctcgcctctagaaatcacgtatccgttcccaaggctcctagctagctcgcacaccaccaaattatacaggttcgggccgctatgaagcgtaataccctactcctgtgaatgggatttagactgagagttacaagggttcctaaactcgggagaacactcttcgttccctcctccacgagcttaggttttctaagagtcgtcctctttcttggtgggcaaggtcctccttttgtacctcaaggggataccacatgcaccgcctctacctactcttctttcgagtggggacccaccctatcttgaccggaactcgacccgtgccttcgcctggaagctaaaccacagcttgtccttgagtggggctcagcgccatccctcgcctgacacggggaacagccctgtcattccctcatttatgggtaaagacttgtggtggctgccgtccgaatgaccctccgatgggacgggtcatacctacctccactccgccggaagcagacgcgacgtgggagcacggttgtccgtccagtcagacgtgaccggtgtcaggccggtcagacgccggtcacagactggtcattcttgaccatcgcgcgtcactttagcacgccgcatgtctgccccactgcattaaatgtgacaggggcagttggggcgctgcgcgcattaaaggaggttcagcctgggccccctcctcgctcgctccccccgccaaatggcggctgggcgagggcctcggggcaaggcggtgcaagggcccgagggacatgacttggcaccccgaggccccgacccccctggccactcctgcggttcgcggaatgcgggggcaggatcaggctgtagggacacgtggtaagatgtgggaaggtagattcccctcatttcgcatacccccgggcccatatctccgacagtagcccccggcaccacatcggacattggcctcctgaggtcggtctgacgtggtgcctcactacttcccaagctggggttgtgggcccggcagggaatctaagcggatgccgccgagtggccaggttggcatatcaaccacaacagcggtttgaccgccacttaccgcgctgatgatgaggatgcttaaggcgcgaaaatcagggggtcggttagaccacacctcgactccctcgcacgccacgcatgcggaggtactggtgacggttcacccagattgtgcccgtgaccgtcgcacgcccaacgccgagtgtgccgctgacaggcgcgctaaatgcggggcgcggattccgtgggcgacgtgatgagtagttgcaggaaacgatgaggcaactgcaggcgcgagaattgtgggcgcaaccgtgagggcgtgaaacaaggaggcgagcgcgggcgaggcagggataaaaggatacggaggcggggactttgcctccttcctttcgccaactgctcacccgcacactcgctccctaagcccaaacattctcgccactccatgctactccgcacaccaagcccctcgtcgcttctccgccggtcatcatggctcaagatgctggcgacgcagtgcttccggcatcgcgcattacggtggataggcaccttagtctcccccgcaagatcatgccagaaggcgccgccgtgagggcgggggagtcgcggccgcggccacggtacctggagcgatccgtgcacctcctatcctttgctatggcgggattgatcccgccattcttcggattcttccacgaggttttggatttctacgaaatccatgccttgcatctcgcacccaacgtcgtgatgacgctggccatcttcgcgcatttatgcgagatgttcatcggggtgcggccgacgatgcggctgttccagtctttcttcgtcccgtagttgctgcaaggtgcggtggtggggagatgttacttccagccccggccaggcacggcggggcaatacatcgagagtcatctccgcaagaaattggaggactggaagaaggactggttctacaccgcactgccggaccactcgtgacttcggctccccgccggccctcccgaatgatccgccgcatggctggcggtttcggagctgggcgaggagtacgacacagtgcgggatcgccttaggggcctgcgaagcctgggcctcacgggggtaatggtctttggcgactacttccgccgccgcatcgcgcctctccaagatcgatcccgtggcgcgtgggagtacactagacccaacgaccccatgcgcacgcatgtgggcgagcgctgggattgaggcgaggaggatgcaaagatggtgattcggcgggtgctaggtctggacaccgttgagcaaacactgattccagacgggatccttcccctctgcagtgaccgcgaccgggagagtatcttggctgtgatgtcggccatcggcgccggcaggggtcggtcccgccggggcggcaccggtagtggcgctgtcggcgtgggtagcggcggcgcgaccgtaggcgggagtcggaccggcggccccggcgggggtggcagctctagggcacctggcccgagccgcggacccagggtcgactcggccagcgacccaaaagggaaacggaagatgtccgaatctcgaccgccctctcccccgcgcggagggggcgccgagcgcgtggcggaccgaccgccggcgggccacaagcgccccgccacgcctgaggttggacggaagaagaagcggctccggaagataggtcaaacagagccgtgtcgggggagcttcgttgaacccccgaagtggactttcaaccgccctccccacaggtacgactgccggcacccgcttcggtgctttttactcatctcggtcccttgttccttcctcttctttttctttgttaacgcgatcagggttcttctgtagcgagattccttcccatgggatctcggggtccgaccctttgcagggggcaaagtccgaacgaccgaagcggcccgggctttgccgatccagggccgcggggccttcacagcctcccggtggggcccacgggccgcacaccgggtccgaccctgggttcaccacagccgagactcgacccgccgcgagcgatagcggcggcgtctctcccgggggcgactccgaggcccggatccatgcagagcgccacccgggagcggggggcgagggaggtcgcggcccgaaagccgaggctggaggcggccctgagcccgaggccgaggccgaaactaggggtgggcctgagctcgaggccgaggccgaatctacccgagggcccgaagcggggagcgagaggagtagccgctcctccttgcacttggggcgccctcagggctggccgcgtagaaggcgagctgagagcggcccccagtctcgcaggggatccagcagcactccaccgtccgggaggggctcaacgcccaagttcaagccctggcggaagagcgagcggccctggaggcagagtgggcacagctccctgcggaccgcgcgcgggttgacgaggggcgccgcgccgtggactacatggtgaaggtgggacgcaaaatgcgccaagcccaactggctaaaatctaggcgtgcgaggagacgctggactccgtcatgcgggagacggaggaagagcggcaggcagcactgattgcctcaagcgtcctagatgaagcgctgggcgacatccgcttacagtacgaggtccatgccgaggacttgacgaagagggttaaggacgcccgtggtgtcctcgatgcggctgccgcccaagagcagcgcgagtccaccttggctgcccacgagagaatggcggcggaggcggagccctcccttcgccttcgtgaggaggccgcagccaagcgtgaccggaccactctcaccgcgaaagcttcggtggcccgtcacgcggaggagctacggctccgagaagaggcgtgccgggaacgggacgccgcactcgccgagcgcgaagccgaggtgaaccgccgtgaggtggcctcgtgccggctaggcgagcaactcgcgaaacgcgaggaggccgtcgctgggcgcgaggctcagcatctggagagtgctcgcgccgtgcacgcggcgatggcggcgagggcttctgagctggaggctcgggagaaggacctggcggcgggcgggcagcccggcggcgcggagttggtgagccagcttaccgcggctcatagcactcttgccgacctagagcgcctggtgcaagaccaggctagggagatcgcggccctccgccttaccaacgagatcggacccgggcagctctccaatgccgtcgatcggctggagcgcgcggggcgccgagtcagcatctccgtgcgtcgggatagtaagctcccgcccacacagccggcactcgtgctccggctggacgggctggtggcggatctggagaggctggaggaggaggtcggcgagaccatgaaatcgtcgtcggcttccttggcgcgggccgcggtggaactggtcctcgcgagccaccaagcccgcaacccggacttcgtcccatggcccggactcgaggatttccccccggggacctaggcaaaggctcgggagcaagtccgggaggcggccgacgcgatcgtctctaacttcgaggggtcggcccctcggttcaccttcgggcttgcctcggacgaggagagcgggagcggagatgatggtgacgacatcggcggcgaggactaggacgacgttgttagcggcgtcggccttgggggcctgggcactccgtgattatccccacttttaacttccttttgctgtgtgcctatagcggacacttcttgtctttaggccatcgtgccgtcttgtctgtaaatgaagcttccccttcgcactttctactccttcgctttctgcattaaatcctgcggcacagaaagaagaaaaaacaagagcaaaagtatacaattaacctccctgtgatcgaaatgtcgtttttaccccatccccnccaccccccccccccccccccgtcgggctcgttcttgcgaaaaggtaaatccgcactcggtccgtagtacctaagtggtgaggggcaagaccgtcgccccgagggagccgcccagcggcactggccagaccaaggctacgacgaccgggggtcggggacggccgtgtgtaggcccttccgagcccccggggttcggcacaacccggggcgcggcccgcgtttaggctccctttcggtggttttcaggtcacccaacgccacttagggttcggagtaagcacgaattgtcctttgaaccaggacaagccagaggaaagagtgagaaaaagggcgcgtaatggcctccactttaggtggaaaacatttattgcttggaaagggaaaaggatacaaagtaattgaaagtggtagcccccggccaagcccgcacaagccgaggagttgtgcgggggttggcccgagctcctggaaagcaaaaatcgcgacgctatggatagaagcgacggaggtgttcgatattctaggggttaggcaactcggtgccgtcctccgtggttagtcgaacagagcctagccggggaactgtgatcactttgtatggcccttcccacattggcgagagcttgcttagccccagacgcgactgcacgcggcgtaggacgaggtcgccaacttgcagtgaccgagcccggacgtggcgctgatggtggcgccgcaggctttgttggtagcgcgccgcacgtagggccgtgtgccttctccgctcttcaagatagtcgaggtcgtcgcggcgaagataatcctggttggcctcatcgtacagcgcgacgcgaggcgatcctagggaaagctccgaaggtaggaccgcctcggcgccgtacaccaggaaaaagggcgtttcccccgtggcgcgacttggagtggtccgattttcccacaacacggcgggcaactcctcgagccacgaatccccgtgtttcttcagggcggtgtacgtcttggtcttgaggcctttgaggatttcggcgttgcctcgctcgacttggctgttgctcttggggtgggcgggcgaggcaaagcacaatttgatgcccatgtcgtcataatagtcaccgaacagctcactagtgaactgggtgccgttatctgtaatgatacggttgggcactccgaatcgggacgtgatgcccctgatgaacttgagggcggaatgcttgtcgatcttgacgaccgggtatgcttcgggccacttggtcaacttgtcgatggcgacatacaggtgttgatacccgcctcgagccgctttcaatggtccgaggatgtctagcccctagaccgcgaaaggccaagagagtgggatgacctgcaaggcttgggccggctggtgggtttgcttggcgtggaactcgcacgccttgcaccgccggacccattcttgggcatcctgcagcgtagtcggccagtaaaaaccttgtcgaaaggctttaccaaccaaagtgcgtgaggccgaatgggccccgcactcaccctgatgggtgtcggctatgagctcgatgccttgctcccgagaaacacacttcaagagtatcccgttggcagcacaccggtagaggatcccttctacgagcacgtaccgtttggagatgcgcgcgagcttctcagcttctacgcgatcctcaggaagagtatttttgtcaagatacgcccggatgtccgtcatccaaacgacctgacgaggggggccagggtcgaccccctcgggccccgaggcacgcgggtcaccaagggtcggcgcagaaggcgtggtctcggggtccctcggggggttcggtcgcgccgacggctgcgcgagtctttcctcgaaggaccccgaggggagtggggctcgcgccgacgcgacacacgacaactcatcagcgattgtgttgtcgcgtcggggcacgtgccggagctcgagtccgttgaagtgacattccatgcgccgtacttagcggacatatgtgtccatttgtgcgtcggtgcagtggtattctttggatacttgattcacgaccagctgggagtcgcctaggaccaggagacggcggatgcccattccggccgctgccctcaaccccgcgaggagtccttcgtattccgccatgttgttcgtggctcggaagtcgagccgaacgacgtatttgaggatgtccccgcttggcgaagtcagcgtgactccggcacctgcaccttgaaggttgagggagccatcgaaatgcataacccagtgcccgccacgaatgtcggcgtttgggtcctctccatctccggggagggaaggaacgttggatagaacaaggtcgtcaactggggtccactccgcgacgaagtcagccaggacctggcttttgatcgtgtgctgtggttcgaagtgcaggtcaaactcagcaagctcgatggcccactttacaacccgaccagtaccctctcggttgtgcaagatttggtcgagagggtaggatgtcactacggacacccgatgcgcttggaaatagtggcacaatttccttgaggccattaagattgcataaagcatcttctgggcctgtgggtatcgggtcttcgcgtcacctttcggtggggccggtccgtgctgtcaggggcagatgatctggggcacccttgctcaggggcaccggtcattcttgaccatcgcgcgtcactttagcacgccgcacgtctgttccactgcattaaatgcgacagggggtagttggggtgctgcgtgcattaaaggaggttcagcgtgggctccctcctcgctcgctccaaccgccaaatggcggctgggcgagggcctcggggcaaggcggtgcaagggcccgaggggcatgacgtggcaccctgaggccccgacccccccggccgctcctgcggttcgcggaatgcgggggcaggaccaggctgtaaggacacgtggcaggatgggaaggtagattccccttattttgtatacccccaggcccatatctccgacagggtggcaacccccatctcaatcgggcacggtgtccgtcacagcctataagtcacagatgtgaaaaattatctcaatcgggcaaacggctgtcatcgatagctttgacccagacgaatagtcaaactatagcccgtcacggatgacctatctcaatcgagccacaactagcgcccgtcacagatgactactcatctcaattgggcattcactatagcccatcacagatgaccctcatctcaatcgggtgttggtatttcttaacaacattactagaaatataattcccagcaatggcgcaaaaatacttctggtatattatggttatagagttcatctgcaagtgcacgaatataccattgtagcatttcacccgagagtattccaagggtatcgtatttattttatcccgtgggaagatcatgtagagagaacttgactaataatttatatattacttgtaataatcatattctaaacaggggttaagataatccaagggtagagtgacacacaagcattagcttctcattctcaatatatattatctaagctaagtggaaagaaaagagaaagaaaatctattctacttctaatacacataatatacatatattctagttaactgatatactagctaataccctctctccaatgccctcctggtacttcgagaagccacccctgactgccgagttccttacgacatcccgtcatgaccatacaaccggggctaaatacggaggaataccctccccagggaattaacttaggattatatacaggcgcgaaggaatacccgtactgagctgtcaccatcagcggcccacctcttatccgcagcatataaccccaaataatgatatcccgtaatctagacaccacgtctaaactaccagatactactctaatatcatcgtcatgacatacagtaattgcataagcaaacattatacccgcaccaaagcatctcccagataagctagccgtatattcagtataacatgaacataatgtaaagatggcattcatattctcggaaagtatttcaataccataaatgtatatagaagggtattctaagaaaagtacaaagcttacaaaagaggaaaggaaagctactagagccatacccgaactcttccgaagacttccgaactcctgatttctactctattcctattccaccagctagatactactaaactaaacatgagagaaatgagagagctcttgcttgaggtgtgtgagtgaagtgaggatgagagctccttttatagcctcccaatgacggttgtgacggttggaatggtcggtaataccctccaacagtcattggggagccatctcagccgtccagaagaaccctggatcaaatggagctgcggggggttcggccgaaccatgggctgggccgacctggcccaatttcggcaggctgcctcctcttttgctctcatacgcagacttgtgcattttggcccaattcatcgtgtcaattctgagttcttggcccattcatacataagtctgattgccgacatcgttcgattgatttatcgtttgagttgatgtcgattctcctccactttatggttattctctgcaaaaggttagtatacctaatattagtggaatattattattctaacacatttatgcattgcaagcatcactagttctcctctattttggtaatattgacggtcgaaactaatcgataacgaccgtcacaaatgaccctcatctcaatcagacagtaagttaatggccgtcacagatgagtataatccaaaaataaataaattttattttttggctagcatcatgtaatgttccacctctctcaggctagaccagtcttttctgcacactttgtcttcactcatgtacactttgtcttaactcgtgcgcacctaggtcacccatcccgaaattgcttcaggccaagcacgcttaaccgaaattgcttcaggccaagcacgcttaacctcatagttctttggagatcggctttcggagaagaagttgtaacttgttagtatgagtattctattaatcctattaagccctgggccaggatgtcacaccttagcatccctcattcatatacattcattcacatacacaaccatcaacatatttaacaaaaccacattcacataacatccattttgatcacatatttcacattcattcacatatttcacatatttcaccagcaaaaccggggttaattcgatcaaatatatatttagcaagtattatcataaaagaggaggcaaatcagactttaggaaaaaatgaatttctaattaaattttatgatactaaatgaactcataagaaaaatctatcaaaaacaaagtagtagaactcattgagatataccaattttattttggtcatttctccatccgggtttgattgaagtatataaaatttaaattttaaaatataagaaatacaaataaattttcgggtagtaaataatttcaaacgaaaaggttatcaacaacaaagttatataactcatcaagatctataacttttattttgctcatttttctatataacatatttgaacagtttgaatttgaatttgaaaatatgacaacttcaaacaacattttcaaatactaaataatttcaactaaaaaagtcatcaacaaaaaagttgtataactaatcaagatctataacttttattttggtcgtttttctatataacttttttttaacagattgaatttgaatttgaaaatttgataacttcaaacaacattttcaaatactaaatgatttcaactaaaaaagtcatcaacaaaaaagttgtcaaactcatcaagatctataatttttatttttggcatttcttcatcagacaaagtgatagtaacattgttcacaaaattcacatatctctcatctggtttataaactataacagagatatgtaattttttttgaacaatgttactagcactttgtcagatgaacaaatggaaaaaataaaagttatagatcttgatgagttatacaactttgttgttgatgaattttttaattgaaatcatttagtatttgaaaatgttgtttgaagtgtcatattttcaaatttaaattcaaactgttcaaaaaatgttatatagaaaaatgaccaaaataaaagttatagatcttaatgagttatacaactttattgttgatgacttttttagttgaaatcatttagtatttgaaaatgttgttttgaacttgttatattttcaaattcaaattcaaactgttcaaaaagagttatatagaaaaatgaccaaaataaaagttgtaaatcttgataagttatacaagtttgttcttgacaatttttccatttgaaatcatttactactcgaaaaattattttgactaataaaatgaattattatactacagttaactattttgctacaggtcaactcacaaatataaacatttcatatgaaaaatggaaaaaaaactaagtcatctcaatcgggcattagtgtagttaacggatgagtcatctgtgacggacctagttattaccgattgatatatggtcgcacagacatgttagataggcataaaactcaggcccatcacagataacacctatcaatgacgggccatagtttaggaatgagtcatctgtgacgggcctagttattaccgattgatatatggaatattatctcaatcgggcctaaactacggcctgtcactgataggtgtcatccgtgacaggcctgaattttatgcccatctaacatgtttgtgcgaccatatcttaatcgggcactttttcagcctgattgagatgacttcctagtgacggcccgctaattccaggcatattagaggccgtcacagatggaaggttctgtactaatgtatgtactaactttttcttactaaattcttactaacactgatgtgtcatgctacgagtgcaactagattttttataacttctatctacctacctaaatcaaacaattgagatgattgttagtaaaagtttagtaagaaaaatttagtacatgtagcagtgctcggtattttaaatcacatgcatgtgtatcacatcatcatccactagaaattattatataaagtactttaaatatcatgcaaacatgacatatcatttagagtgcaactagattttttataatttctatctacctacctaaatcaaacaattgagatgattgttagtaaaagtttagtaagaaaaatttagtacatgtagcagtgctcggtattttaaatcacatgcatgtttatcacatcatcatccactaaaaattattatctaaagtactttaaatatcatgcaaacatgacatatcatttacaattttgttgtatttttagacctcaatatgcaagcaatgtcaaaacattatctccatatcattttcacattatttaaacatatacatctaccatttctacgatgtataacatgtatgcatctacatatgccgcaacaagcatggggtatgaactagttagataacaaggtatgtaagatctttatgataacttggcaaggaacatatcctatacacatgagcttttcgtataaacaccgtacaagctaactaacaatttttaccaaaaaatgtaaaaaaacgtacgtatattttcaatagtattacatcagaccaatgcatcaggccagattttcttttattcgtgcaacccatatataggtgtcgattcctaaaccagcaccttcgatggcatatcatcggtatcgcttgtgaggtgccagttagggaatctagcacctaagtagggtttccaaccgacacccattacgttttctgtagtagtgtcagtgctacgtttaatccaaccggcattgataggttatttgtggtagtgtgaggtcattcaataactacaacattacatttaattatattacatagcatgaaagtaaatgtaattcattatggtggtaaaaaggatccaaccttttagtctcgccccggccccttaatatcccaaagaatatcaatattaggaacaaccaatcactactacaaacccagaaagctgtggcgccggcgccggcgtaattggtgacgccctaggaggacaacgtgttgtgccttaaggaggtgaaggctgagctccgagacccggacaggctgctctcaatgagatcctgagcagcaagagatgaagaggtgacgcgacgccccaagcgcggcctcgccctccctggccgtggggtaggaccagttcgacgtgtcatcattgcttgatctcggccgccccttctcccctcatccactctacttaggggcggctggatctgctgatgcatgctcgtgggaggccggatccgcgaccacgagcacggggctggctggctcgatgacaataccagcggcggtggtgggtcaagcggcagcagtgagatgattgattttggtatctttatgttctcctctatttgttcttggatgttgattttgtattttagtgctaattctttgattgtgttgttggatagagagtcaggggtgatcgagagtgatgcgattacaacttgacccctatttgaggtcaccatcgtccaaagagacaagaacctatgtcgctgcaatgttcttctctttgtttgttcttcaatgttgatagatttcatcattatgaggggatctcaggggtggttcgtggatggggatcagtagctcgatgcatcgaacacctctagtattttttttattcctagaatctgttataggtgccagttatggggtaagaaccaacacctatttataggtgtcggttctaatactggcagctatgccaatgggcataggtgtccctaaattggtacccagcatctatatgtggttcccaaccattacatatagggtgctctgtagtagtgaaaatgcaagaattagaggggccagccatcatctccatcccaaaatcattaaagaagaacatggaattttgcaattttcatctttggtctttgtccaactaacaagcgaaagtaaaataacatgaattatttcataaagatgggttgacatcgatgtttcggttatttctttactggaaagacgaaacaactgaaacccccttagtcaaggaatcttttcattttgatgcttttagaaaatttatgtcacaaacaaattctaaaaataaacatttagttagctcaatgcatgtggattttgttttgtgtgtatagcacttaggccttgccatgcatgctgatcacctctcggttcaaataatttgcattatcatcatatcttgaaggaagccccagtagtaatcacataggagaagaaaaggagacataatctttaatttagatagtttttgctaattccaaatcattgacttcataactatatgcatgtctgagctggtttggaaaacactagagatcttcatgcgtgagatatatatatatatatatatatatatatatgtatgtgtgtacacacatacatgcacacatacatgtaagtgtgtacacatacatggatgtgaggcacacacatacacatatatacacatacatgtatgtgtttccagatataagtatatgtagtgccgtgttcttgcagtctaattttacatttttagaaaaagaatgcatggtaaaccaccttgaacagcttttcttccacatgcattacccttagtctcagccgaccaattttgacaggtcttcagtactttaacgcatgacttgtctgaattttcagactgcttgtataatgcagtccatgcacgcgaaaaggatatgcataagttcatgcaatattaagtgcttctatatattctatatgccaactttatgtgatgatttcatgttttatatatatatatatatatatatatatatatatatatatatatatatatatatatatctccagtgacgtagtacgtccttgactgaaagagaggacgcaattaatcgatcgatcgataatattctacagagaagacgttttcacgaagaggtacatggactgaacatgtcgttttcaagtgtgggatgagctgattgatttgtctattaattctatttaattagtatatacgtggtatgcacgataacgtactctagtgaatgattgtctctatatatcaagatcatatcgaacaattccgtgagacaccgtaaaaatcatgctagaaactactccctccgttctaaaatataagtatttttagctataaatctggacaaatagttaaaagatgttacattttgggatagaggtagtatatatataactatatatctagaacatggcactggagagatatttatttacctaattaaaaataattttcacaggcgatatccgaactagtaggctttctgaaatggcattgcctgtgtataatagagggtgttatgaaccgtctatgaaggtcatcactaatcgtagatgggaataatattagaattactagtacaagtgatcgggtataggatgtccgatagtcccacgcgaaaatagttttcataggaaatgaatatgtgtctatgaaatctgcatataggtatttagttcgaggcagctatagtatccgcatgaaacaaccatatttagccgctgaaaaaaatcttgttttacggtgagacataaatacaggagaaagttgatacatgaccgtagttttgaaaagtactgctagcagtgagtgttttttcaaacgttcaaaggacccaagcaacctttttcttctgcggttgtacaaatcgagtacacaacggtgaatttgaagaatgtgacgtttcaaccaactcccctagctgatactccctctgtcccaaaatatttaacgccgttggctttttcaaacatatttgacaattcgttttatttaaaaaaattaagtaattgttaattatttttctttcatttaattcattgttaaatatactactactactcaagtttttaaataatattcgcaaaactttttgaataacacgaacggtcaaatatgttttagaaaagtcaacggcgtcaaatatttagggacggagggagtacttccgtcctctgtttaaatataaatacaattgtaactaaaaaaacaaattatacgaaaagttagatctagatgtcctcgttaaatgaggggtgattgagagtgaaaacgtagttagggcaagattgaaagagatttggatgagggtgattaatttagagtatgggataaaattttgattctaaaattgcacgcacttatttattttgagatggagggattatttatcccttaggtttctgatgttgagcataagtattgaactactccctccatttaatattataaatcacttcgaatttttttaagtcaaactatttagaagtttaaccaagtgtagagaaatatagcaacacttatagaacaaaattagttttattagatctgatagtgaacacattttgatagttctttttaaaaaatatatattgctatatttttctagcaaataagtccattatacaccccttaactactcacgttgtctaaaattcaccccttaactttaaaaccgagcatctaacacccccctactatcaaaaccgtttaatttacactcctagaccaaatcagggtggttttcctacttgcgtggcatcaacatatcaatacgggttagtaaaatttttaaaaagaataatggacatacatgtcattgaaatttcctcttctcacaccttctttcctcccccttcttgagattttctcgatacgcctctgccgacgggttcgctccatcacccgtgtcgacgaggcaacgatcacctcagcctcccagccggtaaggttgacctctatctccccaagtgcctccttctccatgcgccggcgagctagaccttcagcttcccatcatatacatgtcttcccaagcgtctccctgactccacgcgccagcgaggtcgaactctggctccaagctacatcttggagtgcctccttctccagggattggtgagctcaagctctcctcccctcgaacccccatcgtctcccgattgccgcaagcttgagctcacgctgtggctcccagctgcgcccccaagtgcctcctccactccatgtgctagcgtggtcgagctcgagctctgcctccttgccgcccggagcacatgctccatgctcaagctggtacgcaagctctagctttgcctacgccttctccccgatttgccggcgagctaaggagcggtccacctccccttttcttcaccaagtgtttcctccatgcgccagcaaggtcaagttccactttccctatcgcccctcgagctcgagcttgcagatcccactcaagagaacttcgatgctggcgcttgtctcaggtgagtcgagatagggaactagggggagaggatagatcagagagaggagaagaatgcctcctgactgatagttgggccctgtgttttcctttttatatttttttactaaattgccatgtcaattgccacataggcgaaaaatcgcctcatattgacttaggggtgtaaccgtgcaagtttaacacttttgatacactactagaaaaacaatttttcatggcgtttggaaaatatttttcatggcggctaagtgaaaaaactgccagcgtagaaaattgcaagggtgggggtcacgggccgccagcggaaacacatcttcgctaacggtcgccttaagctagccgccagcgaaatgtctttgctagcagcccacttaacttgacgccaacgaagataccatatcttcgctagtggtaaggtgatgtggcccacaagcgaagaccacctacatcttcgctggcggccctcttaagctgccgccacctctaattattttctatggcggttcaaactaatcgacatatgttgaccaccaggaaaaatgtaggtacctatatcagccagctacagtactttcaggcaccattaggagcacgattttctctctcttaagaacacgttcatagaggggaaggttttgattatcagccaactacagtactttcaggcaccattaggagcacgattttctctctcttaagaacacgttcatagaggggaaggttttgatcatgaatttttgaaagatatattgcaccagaggttagtatactttctcctactctatttgtcttttttttcatttttattggttgttcgttgacattttgcatggcaaaaagtatgtaacatggaggaacaaaagtatattttatttgctatttggagcttgaaatggacaaaattgtaaagaatattgtgcatgatcgatgttccacatatatatatatatatatatatatatatatatatatatatatatatatatatatatatatatatatatatatatatatatatatatatagttttgatagatttatttgtaggagatctaaactgcagacaatgatgaagaagagaaagaggggtagtttggtaaattttctagttgtatgtagctagtttccatcttattatatatgtagatatttggctagctttaattatgttgtctagattatactggttatatacattaattagtaggattttaaattgacatattgttcaaaatatttaaactaactaagttgtattattttttccgcaattaattaattaatgcatagatagcggacacagcatagatgtataaagagagatcgtgcgtcatacatcgaaggagtcgacatattcatgaaagcagctaagaagagtgctgcatctaagaaaacaaaagaaattatatgtccatgcgcgcactgcaaaaattagaaaatttggatcgatccatctgtaatcgagcagcacttggtgacgcatggatttgttgaatgctacacaaattggtcacatcatggagaccccaagcaaacaagttcccaactaggcgacactacgtgatgtagtgttcagctgggacaaggatttcatggtagtagctgaagaagaagaagtgcatgcagtagaacccgttgatgatgatgatattgttggcgacaatagtcagcacaatacagttgatgatgccggtgatggtaatgtgagcgtagatgatggtaattttgcagatttggaagagatgttgcgtcatgctgaatgtgaggttgtagctgggtccgctcgtgggttgtataacttcgatgcattgaaaaaggcagcgaaggatcttttgtacgatgaggcaaagggttgcgagaaggatttcacattgttgcggatggtgcttgagcttatgagattgaagaccagaaacagttggtccgatattagtttcaacgatttgttggttctgttgaagaaactttttccgcaacccaactccttgccaaccagcacctatgaagcgaagaagcttatttgctcgttgtcactgggtgtgtgaaagatacacgcgtgtgttaaccactgtatcatgttccgtagagagtacgaggatttggacagatgcccaacatgcaagagtagtcgatacaaaacaagccatagcccgtctgagtgtccgaatgttgcccttaacgatgtagaagagtccactccatgcaaagacaacaaaaaaaaagaagattccgcagctggtcatgtggtacctttcggtgaaagatcgattgaagcgtttgttctcgaacccgagggatgccgaactgatgcactggcattatgaaaagcggaaaaaggatgggatgattcgacatcctgcagatgctcgatagtggaaggaatttgacacaaagtaccataagtttgcagaggacccaagaaatgtaaggtttgcattgagcaccgatggaatgaatccattcagtgacttgagcagctcacacagcatgtggctagtactcctaaccatgtacaacctccctacgtggctgtgtcagaaaaggaagtatattttgttggccatcctcttacagggaccacgacaacctggcaatgacatggatgtgtttctggagcctttgttggaggatatgcatgatttgtggaaacatgggatccgagtttgggatgaattcctacaggagtacttcacactatatgcagttatctttgtcaccgtcaacgacttgcccgcactgttttccctatcaggacagatcaatgaggaagacgggccgcgttatttgtgtggatggtaccgtgcacaggtatcttaagggatcgaagaagctagtgtacatgcgacaccggcgtttcttaagaaagaatcactcgtaccactccaaagcagaatatttcgacagcactgttgaggatggtgatgcaccagaaccatggaagggtgataaagtgtcaaaatgacaaaaaaaacgtcaaggttgtttttgggaaggcaaaaaagaaggaaaccaacaagcggaagagaaatgatgccgaagtgccaacaagccatagcgggacattcaagaagcactccattttctctaattaccttccgtactggagagatttagaggtacgtcattctgttgatttcatgcacctggagaaaaatgtcttcgatagcaccattaggattatactagacataccaactacgacaaaggatgggctaaaatcacgtaaggacctcgtgaatatgtagataagggaagagcttcatcctgtggatgaaggcaataatggaaaagtgtagcttctgcctgcttgctacaccttgacaaatgaggagaaaaaggcaatgtgcaaatgcctacgtggggtgagagtgcctactggcttctcctcaaacattaaacgactcgcgtcgatgaaggatctgtcgctttcaggctacaattctcatgactgtcatgtaatgctcacagtattcctcgccattgcaattagagcaatcgaaccagtacacgtaaagatggtcatcacaaagctgtgttatttcttcaatgccatatcacagaaagtaattgatcctgaagagttaggtcctctccgggctttcgctatagagacagtgtgcgagcttgagatgtgttttcctccatcatttttcgatatgatgcaacacctcatagtttatattgtgcctcagataattgcacttgggcccctgtgcctgcatcagatgtggccattcgaacgatacatgtccattctaaaaggctacgtacggaaccgcgcccacccagagggatcgatgatagagggatacacaaccgaggaggttgttgagtgttgcattgattacctaaaagatgggaaagcaattggtttacaggtacctcgatatgaaggtagattatgtagagaaggaacaaaagggaaaaaaagaatccgtgataatgactacaaaaaagtgaaagatgctcatttcactgtgttgcagcaacttgcgatagtggagccgtacataaagcagcacctgcatgaactacaagcaacaaatgtggggcgctctaatgcatagatcatgaaaaaacacaaacatcactttaccgaatggttcaaggacctcggtctaccagatggtgataccacggaagaaagaacaattaaaatgttagctgatgggccatcaagtgtgtacacctcgtggcaagcatatgatctgaatggatacacgctttataccaaagcaaaagaccaaaggagtgcatgccaaaaataatatataatgttgtttttaatttttttaaaaaaaatacatcttcacaggcgggccacgtgtcagaagtcggacggtccctatcttcactatcaggccacgtgtctatccccagaagcctttgggcatttttcctagcgggccacgtagcctaaaatactataagctgccagcgaagaaatatcttcgctggcgaccgtccaagcagagatatttctttactagcagctggcttatattcgctgccagcgaagatatttcttcgctggcggctgccttaatactacccaagtgaagatatgtctttgctggcgggtgtggcttagtcggctgccagcaaagacatatcttagctagcggtatataaccgctagtgaagatctacatttttactggcctttgctttgtgacggctgtgatttacgccagcgaaaatccaaaatggccaccacgaaagatggtttccatagtagtgatagttgagggtagtgaaagtccggttttagagttatcggtaaatttcagacaacaagaagagttaggaggtataaaatgaactttatctcatttttctattaatttgatcaaacctaaaaaattttgacttaggaaaaaaatcaaaatgacttataatatgaaacgaatgtagtagctgttttgttaaggcttggttttaaacagttaatacagcttagctacttctcgttttcaattaccacattttttaatggctaagtgagatgtttcgtaaaaaaaattatgtgtagaagatgctttaaaaaatcaaataaatctaacttttaaattttactaactaattatcaaaaaccataccttaatcgtgttcctcgttttatatatagcaactcagtgaaaacctatgggtcgaaaagaacgtcactagtacagatcctctcatctgtgatggcccatcacatgcctgggcaacgtgggccgtcagaacgaagtcatctcaatcgggcctaaatttttgccattgtagatgtactcgtcggggtgcatattcctaaggccgtcaccgatgacattcatctgtggcgggctcaaagttaggcccgattgagatgacctccactatctcaatcgggcccaaatactgagcccgtcacagatgagtgtcatcggtgacgggctccaaagaaggcccgattgagatggccttaatgcccgttcaccgatgactcttattggtgtcgggcttctatttgtgcccgttagagattagtgtgcgcccgttagagatgacattttttggcccaattgagatatactttgcacactatatatactccaggagtccgttgtctgtagttatcccactgttcactattttggtgggaggttgaagagggcgaatttttgtaatttttttacaaacaaaaacatgaagatcataaaaataagtaaaagggtactaatcatttcctattaatttagtagtacttatgttatgagatgttaactaatattttgttcattgttcagcgatgaattgaagttggatgtacacgactggcttgaggcgtcagtacaaggagtatagagatgacgtattaagttttatgaaagccgcagaggaggataggataagaagaaacaacaagtacatgtgttgtccatgtagcgattacaggaatgagattttgttggaagatgaaaaggaagtacacgctcacttgatacaccaccggggattattcatggagagatacacatgttgggtgaagcatggagagcaagatctgggtactgatggtgcagctgcagacggaagtggtaaagacaatcatgaagaaggagatgaagaagagcataacatgtttgtcccatctccattgggtggtgaaatggttgatgtggaccctgatatgctgcaagacatgttacatgacgttgatgacccaactatgaacgagagagattccatgaagttaagcaggttggtcagtgactcggagactcctctatacgcaggatgcaagccaaagcacaccaaattatcagcaacattagacctaatgaagttgaaggctagtagtggatggtcagacaagagttttacagaacttttgggaatactgaaggacatgcttcctcaggaaaacacattgcccgagacgacatatgaagcaaaacagattctgtgtcccctagggttagaggtccggagaattcacgcatatccaaacgattgcatattgtaccacaagcaatacgcggacttagtgcttgtcctgtctgcaaggcttctcgatacaagcaaaagaacagtgcaggggagggaaagaagtcaaagcggggtggtccgatgaaggttgcgtgttatttatcaatcattgatcgtttcaagagaatatttgtcaaccctaatgaagcaaagttagtacgttggcatgccacagagagaaagaatgacggtttgctaagacaccccgcagatttgatttaatggaggaatatcgatcgaaagcataaagactttgttaccgaccccagaaacatgaggatacgtatgtgctcctaagagcatgtttaatagcagagctcactgctagttataatagttataaattcattctagacctaacattatgtgtaataggttagctttaattttccctcatctctttttctcacactataaatttaatatatatatatatatatatatatatcttgcagcatgtgtagagttagttctttcatgagagctaaaaactcctaatttttctttattttttcttttatgtaaacctatagcttgtatatactgtagctcactgttatccttcctcgatcgcgtcagtcaggtttgaactcgagacttctgatttagtacgttacataaggattaacctactggagtggccaattcacttttagttcaacaataattcaattccagcggtataggcgacaagggttgtcatatcatctcctttaatcaaaaggcgtcgacctgaatcatatcctgtctcctaattaagcatgtgggaacaggagagcaaatctggtgctcccttctctaaagtatgcaaataagtttctaataatgtttatgactatacatactactccctccgttctaaaatataataacttttagcctttaaaatttgtctaaaaatataacaacttcttcaccaatattattttcttaaccaatcacaatccaacaccattcaatttttctacctacctccaccttctatccaatcacaatcttcttctatttaattctaccaatttacttaataaccgtgtataattctagaaatttttatattctgtaacggaggagtaagaattttcttgtaaaagaaacgactcatgactaaggagaaaaaataatctcattctaattttcattaccactgtgatcactgattcacttcactcatgtctaactcaatttttggcatgccagtttttttttcaattttttccacacttaattttatgggttaattggatccatgcaactacaaatatgtcaaattagaaaaacaccactactactcgcgatatcggttgggtgccactgcagttttgagaaattggatccatgccactccgtcgcgttttccgtccactccccgttaatgccgtctcttcggggcgccacttcatattttcccgtgcatggacgacgccaccgccgctccactcgacggaggtcagcctcgccattgatgatgccatcgcggagatcgaaggcggtggcggctgggacctagggtctggatgcggccgtcgccgtgtgggacgggaagaggggggccgatggcagcggcgccggtggtgccgactgcatgaagctccataggtcgtcgtcgctgccgatgacgccgccgttggcaccaccgagcagcctaatggccgcagtggagtagtaggcgaggccgttggctgccgaggcgtcggcgtcgaagcagagctggtcctcgagaggtggcagcttcacgaagccgtggccgccgagcatggtgtcgattggccggaggtacctcaacgctggcctgcggcgaggtgagctcatgctcctgcttacttgacctgcccatgtactgcaggatctcgtcggcgcatggtctccctgtcggcctctagcgcctggagcggctgcacaacgccacgaagctcgcgcgcagcaacatcaagagcacaaacatactgctcgactaagccagcaaggcgtgcgtggctcacggactacggcctggcgcagctgggctcgtccccggcggtggccgcggcgagctcgatcggcggggtaccgcgacgtgtacgcgttcggcgtggtgctcccagaggtgctgacgcggtgcccgggcgtcgcggcgagctcggcggggtactgcggcgttgaggctgtcggagtaggcgcgcgtgtgggacgcaataaggcggagccaagcgcgacgcggagagacggtgtcaacggagagtggatggaaaacgcggcggagtggcatggatctaattttccaaaattatagtgacacccaaccgatatcgggaatagtagtagcattttctaatttgacatatttatactgcatggatccaattaaccctaattttaatatagtctatgtatatacatagtaaactatacttgttagttagcaatgttgtgccacttcgcctctcgttggtttcttgttggcttatggaccgtaagttaactagtaaaatttaattttgagtaaatttcactttagcccatttttattacgatgtttcggtttagattaacatatttttattttggaccaggtaattttacctctgacactttgaaccaccgttagctcttttactcatctgcatttaactagcttggcacataaagaaataatctatatacagctgtaggagtttatttaaaaaaatcgacatacttgaaattgtttatacgcttgagaagagagtcatggtggtccaaaatacaacaaaggtacgattacctggtagaaagtgaatataaaaggataataatacaaagtgaaatttcggtaatcaaaatatcatccaaagtaaaatttactcttaattatttatacttagttaattttgagggtttttattgtagtttattttcaacattgatttttaaatcactaaaataatggctataaaggttttatgtacaaattatcgtctgtgcttcgttcctcggatgcttctatctcttcaggaaaagaaaaggatgcgtcggatatgatctccgatctcccttaaacagtaaagaatacagcgacacctttgctttaattagcttcacaccaaactttgaattcttttttttttcaaaatgaaaggacgtaacagcctagccacaacattaattttgttataatatattcaaaaaagttgcaaaagaggcattattaccaaattaactcttttacatacacattcatgtttacttttcctaattaagttgatgcacgaaaatttggaagccaatcatacttatttttatatttcgaagaaaaaacaaaggaatggaatcctccaatttcaatctaaaatttgtccttcggtgctaatatgtactccctccattttaggttataagatgttttgactttggtcaaaatcaaactgctttaagtttgatcaagtttatagaaaaaaataataatatttttgatccaagataaatttattataaaaatatatttaactattaatttaataaaactattttggtaatgtaaatattactatttttgtctaaaaacttagttaaatttggagcagtttgactttgaccaaagtcaaaacatcttataatctgaaacggagaaagtaatatactacatctgaccgtcctaaaatgaaattgtttctggtttgtctaggttcctaaataaaatctatattttagaacgaaatattattatgtttattaatataatactgcactcctaaagctagccaagtcgatccaaatccaagcggctctagctacctatagggtagcttagctcaagctttaatttggctcattgacggcacacttgctggttgtactagcattttttttaagataatgaaataaaaattctgatctttgcttcaaagttataacaacttattacaaaattctctcaaagagagcaaatactcaggcaaccataagaactgaaaaaataaagccaacacacaaggaaaagccaattattaaattctatttgtgaatctccgttcgtagttggcgaaaatctgcactgcataaccataacttctaagctaagacatgtagaatcatggccggccctaggacagtgcggggcctccaaaatatgtatactatagtaacaagcctgataggctattttgtgcattgagaagatgctgctagatcagattgttattgacactatcatcactgattttgtatctagaactattagaacaaattattttaaatgatctagagatatttatttttggtattttaaacttattagtgtgaaattcgttaatgacaatgagtttttaaatattaacttgtatttttatggtgaatgggggccttcattttttgttccgtactgggccaccaaaaagtcagggccggccatgtgtagaatataagaactccttgttctcttcacatttttgaaaatgtgcccagaaccggagccagtgggatgttggttgtagctagctaggcgtccaataggagatgcatgcatatgtacactagatctggctttcattcactgattcacagcatgtgttgtgcacgccgtcgtgtcgccgatgacggccggcccccatgactttgagagatgcttccatatgaaaaacagagcatgcttggtttttgcagcgatccagatttcgacgtatgcatgcgaaatggcagcatatgcaacgcctgtctccaagatgtactcctacactacttacatatttaaattttgcatacgatccaaa

SEQ ID NO: 28556 - DNA, 11431 bp, Oryza sativa
  unsure (1)..(11431): unsure at all n locations
gggccgtcaacgccggatttgggcaggtgagggccgccgcagtcgcccacgcccaccaccaccgtcgcaggagccagtcgtcagagtgaggaggaggggggaaaggaatgggttagatgggagacaagtggggggccaggagagtaagggccgccggatccacacggggcagcgtcgctcgctcccggttgccttctcgttggtggcggcgcccactcctactcagttaggagggaaagagagagaaaagaggaggtagaaaattttgtagtttttttatttgaaaaaaattgtagtgttgagagggaaaagggataggaggggagaaaacatctatagagaagaggaggtattttgcatgcggaccatttatgtggttcgcgaaaatttatttttgcatgtggccccttaaaaggaccacatgggaaaataaacttatttttgcatgcaactccttaagtgacttacctgcgaaaatatatttttacatgcggccccttaaggagttgtatgcgaaaatagaggttgatttttgcgaacactatcaattatggtccatttgcaacttacaggggtcctcatacagaaaaattgttttttaagtagtggtagctaatgcctccatctcaaaatatattagtaatacaatttaagacagatatgcatatatactatctggtattaaattgccatattttaaatagaagtagtaggtcagagtatgcatgcatgcagctaatcttatctatgatttctttttgagataacggaaaatgcaaccttatctgcatatgttagatatggaggctacatgaggaacacgagggttgatttaattaggatatatattgttggtcagatactaagtgatatgttggttcttcttcgcaacgacttaacagtgagtgcttgctgatttgcgtatatttagttaggacttgtgggacctaattgattttgggaaggtttgttaatttgtttaatttgatgcttggattttagttgcgtttctccgtcaattggactggattgtgattaattattcctattaattgggtacttgtgctgtcactcaaattttcactatttaaatatttttctagttaaattcttgtaaaggatgtatttatttgatgaaaaatctgactataaacaaaggtggatgattaaataagaattaaatattacatataaatgtactccctctgtttcattttataattataagatatttcaatattttttctatagtcaaacttatataatttatacgaagtttatagaaatacatagcaatttttaacacaaatatactagcaaaatatatttaatgttagattaaacaaaactaatttgatattatatatgttgctatattttcatataaagttgagatatttaaagaagtttaattttgaaaaaagttaaagcgttggagcgagtagaaaatttttggacaaattatactctaaaagtgtgccacaaaacgatctacaaataatcgtggcctggtaatctacagatacttaaataatcttgagtgaggatgataattgtgggccctactaactgccatccaaagtagaggcaaatgactggctcgtttcaaaatatcaaggacaaaatcgtaaaccctactttaaaatcacaattagaactaaaagtgagggcaaaaatgtgattgtccccccccccccaaacaaaaaaaaataatgtgtgagctagagggtttacatgccaatatccctccctaattctgttggaaaaaaaaagtaatgtgtggagctagagggctacatgtcaataaccttaactgccaacattttatctttacttttttttcctttaagaaaaatgacagtaggtaacaaatatattcagaattcaggaaatgatatatgcagaaaataatgctaataataaattaatgataattttctttaatacaaatccgttgcatcacacgagtcatatgctagtctaatccttaaaaatcctagaaacattatctaagtcaacaaatcaacaaataactaatattcttacatcagctactataattcttcgatgttgaatagatgaataattacgaattaattaaattgtaaagttgaaaaatcgattttttctaagaaattcacatatagaaagtttatataaaatcacaatgttcaatagctcggaaatcgtgcaaatctgctcactaaaaaaaatgctgactctataccgaatacacatccctatacgtataagtctataggtaagaatttttatatatagagaaaataacccgcataagtttatagagcatatggtaattgtgcatcatatgatattaggataaaatgaagaaaatataaaggtgagagtagagttttggataagcaaaaaatccatccatccatcctttaaagccgttggcggcgttggccggcccaacgacatcgacggccaaatcccccaatcccaccttccggaaaaccaccaacccggcagcggttttccggcagccactgccgccggacagccagccaccaccgttgctggctactcactctcacagccacagtgaccgactcggctcgcctcgcttgcagctgcacccaacccaacctcctcgccttcctcctctccttcctcttctcctcttctctactccactctgtcccacgcgcgcacacacgcacgcagcttcctcggccttggaggggtgaaggggggagggaggaggagcagaacgaaggatcttggggctcgggttggtcggggtatggatcggctcggcgcgggtgtcctaatgccgagctttcttggcaagatccatggccgccgcgcgagaaccctcgtctcgtagacagccctaaagccctcgcggcaggatggtcggagcgcgtaggtcagccttctcttcttctccttcttcttctccctggaatttcggtttcttggatttgcggttgcttcctccagggtttcgagctccgattttggggggatttgatttttttttctttttgtcgatctcatcttttgtgattaggggagttttcacatccagatcttgcttcgtgttactgaaaaaagaataaacatggttcgttcgtttgtttgatttgcaggcaaatcgacggggaggaatcaagaatcggggccttcgatcgctgcagaaaccgccatggacagctccagcaagctcgcgcgaatgcgcctgtgatagaagacttgtagttggagagcttgcagagccagattgtggaggagaagcagcgatgccaccgatcccatctctgtggatccgcgtcttcttctcctggctgctgctgtcgctgcccgccgcggctgccgccgatttcagccactcgccgtctgcgatgacggcggcggcgcgggcggcatatggagcacggacaacatcctgcaatgccagagggtgagcgacttcctcatcgccatggcctacttctccatcccgctcgagctgctctacttcgccacctgctccgacctcttcccgctcaagtggatcgtcctgcagttcggcgccttcatcgtgctctgcggcctcacccacctcatcaccatgttcacctacgagccgcactcgttccacgtcgtgctcgcgctcaccgtcgccaagttcctgaccgccctggtgtcgttcgccaccgcgatcacgctgctcacgctcataccgcagctgctcagggtcaaggtcagggagaacttcctcaggatcaaggcgcgggagctggaccgggaggtggggatgatgaagaggcaagaggaagcgagttggcacgtgcggatgctcacgcacgagatccgcaagtcgctcgatcgccacacgatcctgtacaccaccatggttgagctctccaagacgctcgagctgcagaactgcgccgtctggatgcctagcgagagcgggagcgagatgatcctgacacatcagctgaggcagatggagacggaggactcgaatagcctgtccattgcgatggacaacccggatgtacttgaaataaaggcaacaaaggatgcaaaagttctcgcggcagactcagcgcttgggattgcaagcagaggcaagcttgaagcaggtcctgttgctgcaatacggatgccgatgttgaaggcgtcgaatttcaaaggagggactccagaagtgatggaaacaagctatgctattttggtcttggtactacccgaggatggttcactaggatggggtgaagaggagttggagattgttgaagtggttgctgatcaagtcgcagtcgccctatcacatgctgcagttctggaggaatctcaattgatgcgagagaagctcgccgcgcaacacagggacttgctgagagcaaagcatgaaaccacgatggccactgaagctaggaactcctttcagactgccatgtatgatggaatgcgacggccaatgcactcgatccttggtctagtctcaatgatgcagcaagaaaatatgaaccctgagcaaaggcttgtaatggatgccattgtcaagacaagtagcgttgcgtcaacattgatgaatgatgtcatgcaaacatcaaccgtaaatcgtgagtatttgtctttggtgaggagggcattcaaccttcattcgttggttaaggaggcaatcagtgttgtaagatgcctaactggctgcaaggggattgattttgagtttgaagtggataattctttgcccgaaagggtcgtcggtgatgagaagagggttttccacatcgtcctgcacatggtaggtactctaatacagaggtgtaatgcaggctgtctatccttgtatgtgaatacttacaatgagaaggaagagaggcacaatcaggattggatgctgcgaagagcaaacttctctggcagctatgtgtgtgttaagtttgagattaggattagagagtccagaggtaatcttttgagttcgtcatccagtcggagacttcaagggcccaactctaccagttctgagatggggcttagcttcaacatgtgcaagaaaattgtgcaggtatactataaactctttaatgttctatgtctgcaacaaagcaaaatgtatcaacattgcttgattgttttttttttctcatcttgtattacttataatggatcgagatgtacattgctacatgatcacatagccagactactcttgctttgctactattattcccaattcaaggatgtgcatatatgtttacaaacgctgtcagattgccaaaaccaggacagatttttctataaaagatgcgattaattgtttctcgataagtctaatttcttaatcatcaaattatgcaagttgcaatgtcttgtctgatgaataaactgaaagagttctttttttctgatatgagccccctttttttctgctgcagatgatgaatggtaatatttggtcagtctctgattcaaaaggccttggagaaactatcatgcttgcccttcagttccagctgcagcatgtgactccggtctctggagcatcctcggacttgttccgatcagcgccaattcccaattttaatggactccaagtcattcttgtggacagtgatgacaccaatcgggccgtaactcacaagctcctggagaagcttggttgcctagtcctctcggttacttccggcatccaatgcatcaactcctttgccagtgctgagtcatctttccagctggtggttcttgacctcaccatgcgtacaatggatggatttgatgtagctcttgcaatcaggaagttcagggggaattgttggccaccgttgatagttgctcttgcggcaagcaccgatgacaccgttcgggatcggtgccagcaggcaggaataaacggtctgatccaaaaaccagtcactttagcagcactgggagatgaactgtatagagtccttcaaaacaattgaaagagcctcatggttctcatttctttcaatctcaatagattgctgtagcttgattaatagttactacgctactagtttctgccaggttaggtccatacaatcacaaaacatttgcacaaacaaaatgtatagggagatattaaaacatcctgcctttaccttggttccttggtgaaggaaagaaggtagaaattttgaagaggtcatacagttagaacttacttattcatttgtaaaccctatttagattattaatcatttgtcaggtaaattattggtggcaatttgctgatgatagtttaggttcatgaactagactaggtaatgtgtttggacaaaatccatggagctgctgatttggtagttgcacttttgaaatggatcatggatagacatggattcagtgaatgaaatataaaaatcaaaagggacataacctgaaaggtagatggaaataagactacagacaagttgcaagcctatactattgctgctgactttgtatcttgaaattaagaactcttgttgtcccaatcttaatttggtggccaatgtcctagatgcaatgcatctgtgcattcattctggtgattgcctataagactaggaaaaggttttaacttgccatttctttcgcagtgacctctgtggctatatctgaatcctcttttttcgttttccctctattgtcaacaaaagcatgctatgttagcacttcgggacttgattgggatatcagcaacttcctaattgttgaactgtccaatcacaaaaaatcaggtagattgagtgcacatttttctgatgttatttcagttctcaatggctgttaatgtgaaaaacatgtaaacacttttgaaattctcaaatcgggtgttgctcnacaaacctgttcatggcaggcaagtggttgccattttccagctttattccacatgcaagatccaaacatacaagtgatttcagaaaaactaaaaataagaagtaaaatgtaagtttgattttctggggacagtcttcgacagatgtaacttttccttggggaaatcaaactgatagacgacaggttccttctttttaatgtgcatgaaatttttcaatcccttggtattgtcattttgaccccttataattaaacttgggactatattattctgagatgtaagacaaattctgccgccgccacgtattcttcaaacccaagcgttcatttcacctggactatggtcatctggtattttattgagaaattggcaagctgcctagctaaagaaggctttgcaattggacaccttgagcaaagacaactacaagtgaccattgcagtaggtatctagtactagtactactgtactacaaacctataattgatgattaaatgtgaactaggatatatcactctaattttagatatttctttgacggagagagctttatacttgtctttcattgaaaatgtcagactttatgtccatcttataagaacagagaaagaaaccattagcttcttcagactaatgttgtgttctaatctacaactgaagcttccaactttctcgtttaaagtgggcatctttctgaactgttaaaaggtatattttttaaaaaaaaaattctatatcaaagtttttttaagaaaatcagataaaactatttttaattttataataactaatacttaattaatcacctcattttgcgtgcaaaaaaaatattcaaccaaaggctagaaccagcctttttgtttagctactaggtactttttataagcatgtctttcaaatggttaacgagatgatttttataaaacatttttatatagatatttcttttaaagttaaataaatttatttttaaaattttataatagtcaataatcaattaattatataattatatgctaataaatattttattttgcgtgtgaaaaagcctaaccttttagttgtattttgacctcagcataaggctgactttaatgaactattcggctgggctactttctcgtttctcatatgcatggtttttaaacatcttgacgatatgtttcttgtaaaaactttatacacaaattccttagaagaaccaaataattatactttttaaatttgtaatagttgataatcaatcactagttaatggcctatcctgttctaccatagttagtgtagttgggtctatctcttcctcttggttgaaatttctttcaactgataattggaactatcagccaactgatctatccaatctgagcagaactaaacagaataaaaagtgacactacatctgtactaggcttcatgcaatgaaacaaggaccaacttgtgaattgtgatgataccatccttgcaaattgcagtgctaatcttgcatctgtaccaatccatttctggagactcacctcacctgtcaagaaagtgtctctctgcagctactgaagataacacacaatgacctgcctatgtacctttttataatgcaccatcttaactttttgtgcagaggacctattttactactaccaaacagcatttgtttttgtatagattgtgatcatagtggtgctgctggaagttcaaattaatgtcagttgagtgaggatgattttggtttggagggcttccatggggggatgcacctgaaaatccttcagatctgtggttggggctttcctttcctgtgtgagctggccatgcctgcaacttgacacaatgacacaccccagtgtgtggtatgctttcttgttaaatgtcactgctgctgctgtgcctaaagaatgctggctccatatacatccatccttcctctgaatttgtgctgccgcttgtgtgtgtgtttgtttgtgtgacttcactgctcttgaccaaatacattggctctctgcctcagagaggtacagggactggtcatcactgtttggatgcatatcgacagtcagtctactgttagctactcttttcgttccaaaacatactccctccgtctagtacatattcgccgtgggacggagagagtaataatttaggataagattatacacatcataatttatccagattaatagtactatagattaatagtactatagtgaatctaatcccaatttagattagaggccggtagtatcctagaaaatggctaaacaatacctgctgggcagaagtgcaagcaactgatgatcaaaattagactagttcagattagaaaaccagaaagagtaatttgagatcaaggcattgtttagatttaaacttttttcttcaaacttcaaacttttccgtcacatcaaatgtttggatatatgcatggagcattaaatgtggacgaaaaaaaaaacaattgcacagtttgcatgtaaatcacgagacgaatcttttgagcctaattacgtcatgatttgacaatatggtgcaacagtaaacatttgctaatgatgaattaattaagcttaatagattcgtatcgcagtttacaggcggaatctgtaatttgtttgttattagtctacatttaatacttcaaatgtgtgtccgtatactttaaaaaaatttggcacacgaactaaacacagcccaatagttcgcaagctttttgacctatcctatgaccaaatacaccattagacacattgtggcaagtcgttattattggatttagtcccacattggatattcaattacagcctcatcggttcacttatgcatatgcttatctgtactgtttattagcaaccaaaaagtaatttgtgagtacaagtattatatatatgttcttagttattcaaaagcaaatgatgtaaaaacaaactgcgctaaaacaacaaaatcaacttcaaaattaagttttaaaatttaaatttggcttataagtataagcacaggttaaatgatgttctcacgcaacttagcttaattattctctctagtttcatttttttttacattttagataatggcacggtaactttgattatggttaatctattataatatacatacaaaataagtaaatatttgattatggttatctactatcttcatcagactacacatctttttcaaaacaatagaaccaacggaagtatgagcttaggattctttttgggtgaaagaggctctgagaacttggttatgtttaccttaggccggccgaagattgtcttggagagctggatcaaattatttttgggctaggctggaaaacaaatgaaaagccatgtttgggctaggctggaaacaagcccacttgatcctttactgtttgtcaccagctaggctggaccgctggagatgaagatagaccagtagtaattgtgtgattgtgtccattattatagttaagtgcatgtttccaaaaaaacagagatttttgtcaaaagaatgaatttattgaacctatatataaagtgaattagaatttgatgaaccttcacaaaatacaaagaccaaaaactattcaaacttaggagtatcttttatcaaaaactatctcatctcatccctcaaagtggaaactctctgtatttgtgctctccctcaaatagtacatggtttttgcacagagaagtacagataatggtcgccactgtttgatgcatacgaacagtctaaactgggatttacctctactgtttagatatttttttgtaccatgtttaaaaaaatatgattttttttgtggattttgtgcaagtcacatgagaaaagaataagcaaacaaatactaggaatgttatgataggagtttgttattgggtttaagtcccatattgtatggagcacagtcttttggaccgtgtatacccactatctttcgttatagcttcttttgaactgcctaggcccaagctagagagatggatcagattattgttgggctacaaataaaaggccatgtttcggctaggctgttaaacaagtccattagagcctttactgtcaccagttttggctggaaaccaagatacagcccattagtactttgtctccgttatagtttccacagtaagtttaaatttgataaaactcacaaaatagaaataccagaagctattcaagcttctttatccacagctatctcatccctcaaaacatattgttttaatagaaaaattaagtgatgaattaggtcatggggtatgatcaatgatgaaccaacctgaacctaaaatggtttgattttatatttgctctgaccaaacaatctgtaactcccttaacagtcttgaagcacctttaccttaagatacactacctccgtcccctaatataagggattttgatattttacttgcactgtttgaccacttgtcttattcaaaaaatttgtgcaaataaaaaaacgaaaagttgtgcctaaaatactttggataataaagtaggcaccgtatctggtgcaaaccagggttgctgtgcaaccttggaaactctcaatcaagaccacatgatgctcatccgatggctagggacagaggtgggttacttttacacttaaccgcccgc

SEQ ID NO: 28557 - DNA, 6619 bp, Oryza sativa
  unsure (1)..(6619): unsure at all n locations
cgcagcaactttctaagcaaccaggcactacaaattccctggcctgccaatcaagatttgtaaactagtgtttccaatttagttacagagaatagtagcaagatttactaactgagattgacactgatgtacggattttgtaatctgaaattctgaaagattgttactgcaaatatgcaatggaattgtgttatgtcatttgataatgagattgagtcaagtggaaccataaaattttcaggatgacagatgaactgtcatacttcttgttctgcattttctgcacatgtgctagagcacaacagcttgatacaggtttagtttcatgtattgtcatatattgatggcaaacatgtctcggataagaagctcttgttgcagttcatattttggcagcatctgccggactccatggtggcagcggcgtggccgaactccatggcggcagcggcccgtgacctcagaacgggcgggtttgcgacaccctcactgacatggcgtcggcggcacagtgaaggggcgccggcgagtcgcgggtgggcggtggcgaatcgcgtgcgccacataaacgaaacgacgcggggcgagcaggtggaccgtggacggacgctaggattagggggggatttgcaaaaaaaacagattagcagagctaagggtgggcagttaagtgcaaaattagcctatctctatccctagcgatcggatgagcatcctgtggttttgattgagagtttccaaggttgcatagcaaccctggtttttacttgatacggtgcgaataaagtaagtcacaaataaaataaataataattctaaattttttttgaataagacgaatagtcaaacagtgcaagtaaaatgtcaaaatcttttatattaatggacggagggagtatataagtagtggttaacctaaacttgctttactgtcatgccaggtttctcaagcaggagtcaacattattttattgttagtgtgcatagattctccaggagaagttgggaaaattaaacttttttttggcgccgtggttccaaattaatgtcacgtgttttatggagtcaatggtcatttttccaacatatgaaaactactccacgtcggaaggggcggacgctgggcgtgtccacgtcggattttgctacagtagctacagtgcgaggttggatttttgcgaaaaaaccctccgattcttcgtaatcaggtataggcccctcgcgtactgtgtttgaacagaaaaaatcgcggacaggggattcgttgtgatatgtggaagacgaggggctttttcgaaaaaatacgcccactgcgcatacccctcaaaccctagccgcttgctctccctctctcgcgccgctaccgagcactgccgcctccgcctccccctcaggccgtccccgtcgcctcgcgccgccgcctccacccccgcctccccatcgcgctgccgcctccgcctcccgccgtccccatcgccggccgagctgccgccgtctgtctcccctccgccctctcgtcccccactctctccctctccctttccctctccctccaccgtctcctcccccaccctcgcctccgccttcccctcgcgccattgcctccgcctacgcagccgctgtcgtcgcgtcaccgtctccaagcgcctctgcttccgcctccccctcgcgtcgtcgccatcgtcgtccccgtcgccctgcgccgctggcgccatcgcgtcgccgtctccgcctctggcctccgtcaacgacgaggtcggagcgccgacggctgcatcacaggcggcgcgaaaagctgaggggccaatcctggcggcgggactgccgcgaggttccggacgcatcaactcgagggggagacggcggagggagtgggggttgaggcgcgcgcggtcttcatcctcccggcgccagatctgcttctcatctccacaaggacaccccagcccaccactcatcggcgtcgacatggtcgtcggcgtcgccctcactgtcgccgtcgccaacagactgcgttaagaagccactccaccaccagcagcagcaggggcatccaccgtacgccgcaccaatgccttccccttccctcccatctgtgccctctgggtcacaggtagtcgcttcatcggcagccgcattgccgtcaatgtacaaggccaatgaccagcagcgagcaactcatggcaccagagacggcggcgatgacggtgactactaaactcttggcacaggagcttacaaaggatttgcaggtttgtgtgagttgttcttttaaggttgccatgaggaatagttaatctcgtttttcccctatacaccatgaattgttgcacatcaacattgacagtgattttcatttttttattaatgcaatggagcaacctaaggattataccaatttaccaggtgctctaatgccactgttggtgatgaaattttgagagaccctaatcttgccatgtttatgatgttctacagaacctgcatccattccatctaaaagaactcatcagctgggattgaagtactgatcagatctttttttctaggtgaactcgagaagaaagttcgaaaaatgggacattgcaatcacaacatcggaacctaatatcaacactatgctcattgccataggttctcccatttgtatagcatttagagatttcttttttttaaaaaaaattgtgaacaatttccataaactcacatcaaggtgtctcatgcagtgccaggtaaagaaagggactacaatgcttattcaaaggattatatgtcttccatagtgaagcagtcatgcactaatactagaagctgctttagagatggagacatcccgtcaaaaatctccaattacccaatgagtgagccattttttccccatgattacttactatttcagatttgtatttctatacatgtggcaccttttcattccagtgtttttttgactgggcttttcattccagtgttgtgcctgaggatcatatacatgactctgatcaatcctccaccttagctggttgctctgcttgctgtgaccatgccacgacatccgaaaacacagaggaccaggttggttagccatatttcacactcgttgcactctgaacaatcaatagagaatcacttctagcaatctattatgattcatttccagatgcattaatctattctctttgttagtacttttcttggtattttaggttttcttggggcttagttatagaatagggttttggagtgggtttgtggaggggtgattagaaagttgaaactcttttgccgcgaataaatctgcagtaacatgcctatcatttcacttcagagccaatgcatttgggtaatgtctcaaaatttgttttgtatttggttgtttcggcttttttggttgaaggaatctgcaatatatcatgcttccccaatgagtgagccattttttccccatggttacttactatttcagatttgtatttctatacatgtggcaccttttcattccagtgttgtgcctgaggatcatttaaacgactctgatcaatcctccaccatagctggttgttctacttgctgtgaccatgccatgacatccgaaaacacagaggaccaggttggtttgctatatttcatactcgttgccctctgaacaatcaatagcgaatcacttctagcaatctgttatgattcatttctagatgcattaatctattctctttcttagtatttttcttggtattttaggttttcttgggacttagttatagaatagggttttggagtgtgtttgtggaaaaatttagaagcttcacatactggatgaatttttttagtagttagcgtattggttattggcagtcaaatttttttagtacaactggtaggaggatgagcttatatttggcactattattcagaagatgttaatctcaatctcccattttactgtacttaatgttttcttaaatgttaaatacttaaaatgggactgcagttggtcactgatggttgcttgatagccataaggaaaagagagacaaaaataatgaattcatgcagaggtttcagtcaattgcaaataatatgagattggttgacttaaaattgaggatggtgtggtatgatgagcctctgttgatctgatcattttcctttttcatgtcaggtttgacacctttggattgcataccagaattttccatgttcttcagctctcaataactcatcttcaggtaatatgatggtagtccaggtttttagatgatttgcatcaaggggtgaaaataaattgatcagcacagcaacattgatctttcttatgggttgttgctttagctaccacaatgcttatttgcaagctcgtgatgtgttgcaagatctagagtagtctagcgaaacctatgtcataagtgccacaattccaaaccgaacctcccccagtgtattgttcgatgtggctgctatagttttttactaaaagtatgtaaatttatttgttctatggcttgtgtagaggagaaagggaagtgaggaaaatttgtaagtgaagaatttgacagattgcgatgggcaccagttatgctggtaattttcttgaacctgacactaatttcagggtacgtacattcttaatccaagccacaacaatgtctgagtggttttatatgtcgaccatctgtagtgtcttcttaactgttcattctgtctcaccaagactaaagaatgcatttctcttttacctatgtgtattcagtactatgaggtcagatatgcagatatacttcttctacttcataaatttgtggaatacaaataagctagggtgaagataaatatgtcaggttaaactatccgtggatataaaatatgtcatcaagccttagatttttcaagattatcaggaagtgtatatttcagactatgtatttactttattttgtttcaagtgatgtaaagccatatgagttttggtcttgtttacattgtatcggtccagaggttttgttccttagaatcatcttccattgtatgagcagcatattccaagctgctcctttaaaggaatcactcgctttccatatatgcagtatatttttattacacgataacatcactattaattggtatctatatggaaattaaatcatgccaatatatccagtgaaaccaagtgctattggttgatagcagtaaagatgtgttttctctggcattttaagttgcagtgttctgatgacttctaattactaatgatgtgatgcataaattctatggctggttctgttatttctttttatttgaatgtaatttgcttcaatgaattgatgtggttaaaggagaaaatatttaaggccatgtttagtttctcagggtccaggagttgaagccatgcaaacatgcatcatgctaatgtcgtcctgagcttccagattaggccctgctgtattgatcaatatattcaggtcagttgaggctctaaattaattctgatgataatttttattctgctgtatttgacgggcctcatgcatctgaagatctggattactgtggccgaattcgtgttctgattttggggtgtaaaatactgaaatcaatacggctgtccttgctttcatggggggtatttggtgatttggttacttcgattacatcgagttggaatgtcaatgctctctgaacctcgaatttattactgggttaccgcattagattattggcttcgcaagctggggcttgtgcaaatgatcctgcgtgaaatatgcacataatttgcttccctagacgagtttctgctaactattctatagatcatttgcataacccagcagccagctgtttctctcttcttcctttttccccctctgaacatgtttacttaggtcaatttccagacattgaaatgtcttgcaagatcaaaattcaaggttagtccgctcattctgttttgagagagttcaaggctagaagagtaaagttagtaagcaaataaaaacgatgcaaagaatatacttgatcagagctaagaatgctctcataagtcataagtctgaactcccagaaataaaacgtcaagctcttcgaaacatgatatatgccatttaaaccttaagtgcccctttcagttttaagagtagaagccatgtcttcttggatgctgtcttttgattttctgtcaaatggatcgtctcctttctagagatctaaaatagacttgcacaaaagcatgctgtgtatgctccccaattcttctccttcaactacacaaaaacacagaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28558 - DNA, 397 bp, Oryza sativa
aagtagttcttcatacaaacaataccagttgcacgagtatacaggttgggtcaaagcaggtgaacatcacagaggcttattatctagccaacgtttgcccatggcaaaaccttgtttaggattggtttctatagaggtatggccaccaccctgcacatcataaaccttgtttaggattcttcagaaagccagtatgtgaattgtgaagggctggacactatagacacaaataccagtttaacgagaaaaggtcaagaaagaaaaagtaacacctttactgtggcaaaggtcaagttgttggcgtacaaaattgtaaatctgcataaaagaagatgacacataatattaatatcagatcaggcaaacatggaaaaaacatcaattgaaatgcacaatt

SEQ ID NO: 28559 - DNA, 214 bp, Oryza sativa
aagggctaaaccatttcgatcaatggaattcggacgatctccagcccttctactcctcgttggtaagtccgagaaactttcaggccggttaactttaggctgttagcacacatcttcattcttcaacaatggcgtgtctcaatgcagggttcctatggtcgcagctgcagttcggcgctgaggcagctggcacgacggtcttcacgctgcgcaa

SEQ ID NO: 28560 - DNA, 254 bp, Oryza sativa
ccctttgcgttacgttacgtacgggaccctatatatctcgacctctccctctccctcaacagaacattgtcgtagaaaaggtcaatactaggagcaagagacgactacatgcgtacccttgaaaaacctttgattttgtatgtatgcgagtaggagtatgcgactgtcgcgtgtatgaaagcgaggtcaagttgtcaactccttccggcccggcacgctcgaattaaatttgaaaatataatgttagtttattt

SEQ ID NO: 28561 - DNA, 394 bp, Oryza sativa
tgtgtctactggacattaatagctattttcatttttcttgctatagttcctttctccgtacatgtcttatcaatatattttgtattcaattccttttttttaaaaaaaaagtttcttactaagttgttgtttctcttattctactgcaggttaattttgattcatgttcaactaggcaaacatcatatccttgcagcatctttgaggatcgccatccatcaactgtttcaatgactgttcttgttgttgttgagatgtttaatgccctaaataacctaagtgaaaatcaatctctcctgtaagagctcttatgcttcactttatctttaccttttaagtctaaaatcgtcaatatataaacccatactcccatgtactcaatttagtgtatggg

SEQ ID NO: 28562 - DNA, 740 bp, Oryza sativa
tatgggccttcgttatttagctagtttgaggtggtcctgtatgattctcccttcaattaaaaaagggtcgagttgccttctagcgagcgctataacaccacttgtcatttttagggatgtgtttttttttaacaaagcactttttaggtgcaataggaggagcggcacggagaggagatcgcttggcgcgagctctctagctccagtccacctcaccggtcagtggctctcctctttggcgtgcactgcttgccggtcaccggcgccaaccgccatcatcaccaagatgcatcatcgatcaacgggctgtgacggtggatggatactagcggatgcggagccatcgcttcttcgtggaataagcgagacggcatatttgcaaacgaaaaataatttgtgaataaaacttttatatacgtgttcttagcaatctaaaagcaaaggctgaaaaataaacttcgatgaaaaaatctcaaaatcagatctaaatttaaggttgaaaattcaaattttggctgataagcataagcataagcgaaaaaaaagagaccctagaagtagtaaatccaagaaaattggggggggatgaagtgggagagagaaagcggttggttgattacagtaaaagtagcatatactttacaagatgaggttgtaaaagaattactactcggaacgcaacaatggaggaggacagggtggtgttagttggtgggatcgctgggtgtagaaagaagcga

SEQ ID NO: 28563 - DNA, 859 bp, Oryza sativa
  unsure (1)..(859): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgattagtgttagctagtactaggaacaacctcaacgcttttgatgacaaacggcccaaagcaacaggagcatctcttccaaacccaattcccaaagaaatgaatacgtgcaaccaaagtttctccaccgtctgattatctgtccatcattagctggtttaatcagttttcagtttttttcacacacagattgcttgattagatgcagaaagaagcgaggtttattaaacttggcgccaatttagcaattaacagaaaaaccaaccacgcatatggcagcagcagcagcaactctcgccacggaaaatgctagtagtatactaggccatggacctggacctcgccgtgcaagtctcccgccggccagtctccggcgaggacttcgccttcgccacctccgacaccgacgccgccttcctcgtcctcgcccacctccccggtagtaacccatgctccgccgccgccgttgaattgacattggtgtgagatttttgtgtttttgtgtgtgtgtgcagggtatgacacgcaggaggtggaggtggtcgtcgccgatgccgggagggaggtgcgcgtggtcgtcggcgcgagg

SEQ ID NO: 28564 - DNA, 763 bp, Oryza sativa
ctgcaccattcaagaaggcagcaactgtccatgcctggtgcaagcaggccaacatgctcaccggtgacaaatttgaaatgactaacgaaatgtgctgaaatgcatatcagctacagcttcaatcaacacgattcccatctcgttggcaaacggcaatcatcaagcaggcccaaataactcagggatgctatgtgcgggctcttctgatttcagaaatttacaagcaccaattgccagccaaattaaaatccaaatcagcctgaattgcagctcacaacgaccatggcatgatagttctcacttctcagatcctttcgtgatgcagccttgaagccatgacagttgagcagcgaaaatatctatgttgatgaggcctcaatttagagaaaaaaggaaggcatagaaaggattcagaggagaagcatgctgtatcaagaggagaagagagcgcaatggaaagggcggccatcacggaggctggcactgtagtttcggcgcatggaagacaaagccaaacgaaaatccaaatcagcctgaattgcagcacacaacgaccatggcatgatagttctcgcttctcagatcctttcgtgatgcagccttgaagccatgacagttgagcagcgaaaatatctatgttgatgagacctcaatttagagaaaaaaggaaggcatagaaaggattcagaggagaagcatgctgtatcaagaggagaagagagcgcaatggaaaaggcggccatcacgggggctggcactggag

SEQ ID NO: 28565 - DNA, 28222 bp, Oryza sativa
gcacctccaaactaagcaaatcacatacttttatgtagaggaatcaccacagcaggttggtataaatagacaatatacatggaacacattttttctcgaaaacatctacatggaacatatagcaatcatgattcacaaatacaagtcaagaatgaaaggactaacatcacaacaatttccaggttcacaaatcactagttatgaatacacaccatcgctattgacaagtatagcaaagaataactaaggagggaagagaactacgcattcgacaaaggaattgacgaaacactatgctgaatgatgatacatccaaaccataaattgcttggtacataccacatactactcatttctatctgataactttcacagtggtcgaaatcagatcaaattagtgctaatcatcgaatatatctttctcataaatcccgcacaccacacctgctggcttaaacgaaaaacaactcgaaacaccatcgcatcgcatcgcatccacagagtattgaagcactctccagattacaatagccgctggacgttgcggccggagtaacgagttctaaccaagcaccaatccaacgaacaagcgcaaaggaaaaaggaagaagaaaaaaaaaagaaaactcaaattggatcggtggactggaggaagggaagcgggcggcgtgtcaaaggttttagggttggggctcgctcgggaaccaaccgtaccttcacccggaggagcttccggccgccggcgagcgtggaggagggagtccgcgtcgacgtcgaagtcggcgccgcccgtacgcgcgttgttctcacgcagcagtccgaatggacttctcactttctcagagcatccgcaggcaggcagcggccaactggttttgaacactgcggaaatggaacaagcagatcggcctcagttctttttttcccctcaaaagctttacatatatataaaaaaaaacttacaaatatttccgcacacccatacacatcattacacacgcaacagcacacttaccacctgacgaatatgttccctagcataagttcaaaacaacacaaccataatctcacaaaaattctattgaaagaccacttatttatggatactaggatttaaaccctgatgagttgtgcatgtgcttttaaaaataacttacaaaaactcactgtcaaacttctttttaacttttagcagccgttagctgcttactactccctccgtctcataatataagagattttgactttttacttgtactgtttgacgatttatcttattaaaaaaattagaattattatttattttatttgtgacttactttattatctaaagtactttgagcacaacttttcgttttttatatttgcacaaattttttgaataaatcgagtggtcaaacagtgcaagcaaaaagtcaaaatcccttatattatgggatggagggagtatgtctttaggacaattttgaatttcacagcttaattttaggaataatttaggtttgtttttcttccattgctcatctttagcttcaagagagtttcggctaaaactagtaccgattaaacattcatcaaatgacaaacggatattccatgatagaatacaacggatggagaaatggcttggaagcacatggaactgattgttgctttattgcaactcaacaaagttcatcaaaaatacattgcacatctcccacaacaggcagccattacgaaattttgatacaactcaagatttgaaactctaggcacaagccaagcatgaacataacaattcagtcagctaattattacagttacaggcagagcaaatatgcttctacagagcaacctgttaaaaaaaacaaaagaaaaggagaatgtagggatacagatacaacacaacagcatctacaaatcagggaacatgtctagaaaaaaaacattggttttctaatgactacaagttaatagggcataaatagcaaacaacaggatagagcccccagctaaatttggagggggcccaatttgttacaataatcgataaccatgctttcgcaccgatgatttcattcgcaggccagcttggtgtcgaaactactcaagcagattgcaaaggcctggaaggccgaaagggggtaacgatagtccattgtgaacatatccttcgcaaccttaccaaattgtagtatgaccttgtcatgatcaggtggaggcggcggggcaggttgcgatggcgtcggggctccagcagcaggctgtgttgcagcaacaagctggaagttcttcacagacgcgacggttaccctgcccttgaagttgaggcaccagcactgcaactgctcgtgccatcttggggccttgttacggagaatcaatggcctctccttggactcatcactgtcacccaatgcctggcctccgaccatggggccacctactgagatgtcagaatatctgctactgctgaaacggatagagcggtccataatggatgacttggaaaaggagatgctgccaaatgactcatcaagagagcgtgcaagcacactgtctggctggcatgggacagtgccaccagcctcaagcgatgaggcagggattgagtgcatcacacagttcatccgcctaggaccccgagtccccaagacattcagttcatatgaaacttgagctatgctgtaggtgctggaagggttctttggcgacaccttcctggagtagaacctacggcttgttttccctgactgtgaaacattggctgtgttgcatggaggttgggtatcatatattacaaactttgttccgagaagatttgacctaaaagtccaacacagtaaatatatcagattataccattaaaacacttagacgatgtaccttctctaaacaaagttgccattattttgggttattacctcaattttccaatgtacatgttgcttgacctagatgtattgtcagcactcataaatattgtatattctgtacaggttgcacgggagtatcttttcgccgataaaaggaacttgccactttcaacgagcacagctacatgagatgtgttacaacatgtgaagtcagcaaatataacagaaactaaaaaagtatgctggtgggagggatatatgcagtaagaaattagctcacaacaggacgaaatagctgcaaaaggggggggggggtaacaaaggaggtggtatggtatgaatatccatatgcacaaatgattagcacgcgtgggaattgcaataattaagcaagatcagtatgcaataattaaactaataccaaacaagctgtacggtcatacataacttatatgcctcaataactcatacatactggctaacagtgcaaatcatacattaacttttggttgatatttatgcaaggagaaatactgtcatgtataatatattgttgcttatataaagaatagataccacatacaagtccctcacagggaatgctagcggtgatggagcgtaaatgattatgccacatatgcaagctatacattaatctctggttgttgtttatgcaaggtatcatgcattcttgcttatataaacaatagatactcatacaagcccctcacaggaagtgctagctgtgatgcagtctaaataataagggaaaattggtcctatgacatccaaagatcccattcatagaaatttaccattgaaagatcttggtacactttaatattatcgaaagattacgtcgttcagtttttaaccattgcatccccttccattagtgtttaccggattattcccccttttttgcacttaaaacttacacttatgcccattagacatacgtcttgagcttcttgaaccagattgtcaccagcaccgctgcagcgcgccttgctgtgccacccatattctcaagctctagtgtgtatcttgttgatttggatttgcaaggttttggaatgcatgtcacagccattcacgttgctgtcagggccacagtggtgggtggcatggaggacctggtgaaactgatgaggaagcacctcaagacgttgcacagctgcagcgtcgggttgcaggatgtgcatcagcacgagctcctatcaggctgtcacgaccctagttattggaaccggaccggaccagcagttggaccggaaaaaaccggaaccggagcctccgccggtctggtccaactaaaagaccggctgtgcaatcggcccagtataaaccggttgggccgcccggttttgtagaaaaaccgccaagaaaaccggatttcaaccgcccggtctgcattgcgcgcggtcacctcggcagctggagagggaaaaatgtgagaaaaaggggcacaggtgggattcgatcccagtacctcatgcatggaactgaaccaaccaaccaccgggctatgatacaccttgtgttttgaaggaataaactatatatttacattagattgaaccgcttcaaaccagtggttcaaccggttgaaccaacaaaccattgaaccgagggcatcgccggtttaatgaccggtccggtctcaataactatggtcacgactgctctgccacgatgctagcgctgcaccattcaagaaggcagcaactgtccatgcctggtgcaagcaggccaacatgctcaccggtgacaaatttgaaatgactaacgaaatgtgctgaaatgcatatcagctacagcttcaatcaacacgattcccatctcgttggcaaacggcaatcatcaagcaggcccaaataactcagggatgctatgtgcgggctcttctgatttcagaaatttacaagcaccaattgccagccaaattaaaatccaaatcagcctgaattgcagctcacaacgaccatggcatgatagttctcacttctcagatcctttcgtgatgcagccttgaagccatgacagttgagcagcgaaaatatctatgttgatgaggcctcaatttagagaaaaaaggaaggcatagaaaggattcagaggagaagcatgctgtatcaagaggagaagagagcgcaatggaaagggcggccatcacggaggctggcactgtagtttcggcgcatggaagacaaagccaaacgaaaatccaaatcagcctgaattgcagcacacaacgaccatggcatgatagttctcacttctcagatcctttcgtgatgcagccttgaagccatgacagttgagcagcaaaaatgtctaagttgatgaggcctcgatttagagaaaaaaaggaggcatagaaaggattcagaggagaagcgcgctgtatcaagaggagaagagagcgcaatggaaagggcggccatcacgggggctggcgctgtagtttcggcgcaaggaagacaaagccaaatgaaagggtttagtgcgagtgtgtcatgtggcacttatgtcgttgctagaggacaaatgagtccgttttaatggcaacctattaaattcagatggaatggtataaaagtgaacggcctaactcgatgatattaaagtgtatagagatcattagatagcaaattactcacaacaggatctttcagtgtcgtagaaccaatttcccccaaataatcatgccatgtagcgagtacaaaaacaaacacaatactaggataaaggcttacctgagctaagacatagatataggttgtaagtttgggtagatttatcccttttaatgaagcactggatggctccattccggggcccaggctgaaaaacaaaacatggtcaagaaaagcatattaatgaacatatcaaatatttctatatcagaatttcatttcgcatactataaatgagcatattaagccgtgtatacgacaaccatcaaagatgtatgttagttaaacaaatctgaaatcgaagcgcggaaatacaagactaagcaagagagcatcatcatcacctgcttgagggaaacaggaaaagtgatcttcccgcaaaactcggggttcttgacgatctctctacacatgtccctccatgtccggcatacggcggcgcacgcgacgacgttcttcctggacggccacgccgcctcgctggcctccagccgctcgatcacgtcccggagcaactccggcggcaggttagcccagcagctgctctggaccacgtcggcggcggcggcggccgcgtggccgtcacgcagctcgtgcaccgcgctgtgagacctccccctccggtgccccaccagcctcacctcgaaccctcgcctggacaggctcccgaacccgtcgcgcacgtcgcggacaatgctgcggaacgacatctccgcctcgcctcgctccgaagctcaaaatcaagaaccctaggcgcaaccgctgtaaagaaaatcaggtgggtgaaatggggcggggagattcggagggggaggaggagcacggatccgggggagacgaacctcgggggtggcgccggcggcagctagcggtggccggcgggggagggaggcggaggcggaggaggcatggggatcggaggaggaggaggaagaggaggggaaggaaagaacaagtggtggtggctggacaagtgttggggggacgcgacttcacgtgggagcagaacaaaaaaaattgaatttgttttttatgaagaatagacttatcagttattattattactagtggtaattcattttggtttgttctgttctgttttatgttgtgttttggtagtagatttgtgtgctttttcaagtgatctttgtttaattgttcggcgaattctatccatttgtgtgcttatcgactcgactcgggcttccatatttagctagataatactacattcgtcttaaaacataaggaatttgatggataagacacatcttagaattacaaatctagatagataagatgtgtcttatttattcaaaatccgttatattttaggatggagggaatagcatatacatgtgattataaagtcaatgtcttaaatttgtatggttttcaagtgattttgattctagttaattgtccggcaaatttgggttttaacccatgtgtttactcaggcgatcgatcgacctcttggaatttgtccatatctccttgtcaaattaagttgtttttttgggttggactagctgattgcgtatgaatatatgatactagagttagaggcctcaaatttaaatcctaacgaatatacgtaaacacatagttggagaaaaagacacaaagtagggtaattaggtataagtgaattatccgtagttttttgaattacggcgtgatagccaccacgtgagcagtgcggataataaagtatacttcgaaggtaaatttagggtattgccttaagcccaggcacgcgatactgtggttctacgcagtaagaaccataatacccgggttaatttacataaaatttaccaaaaaattattttacggtaatacttttatgttttcaattactggtgctgaagccaaaagcttcacagctcaaataaacagaccctcctccactaatgtccaacaaaattattccaatcgacaatggaattaaaagattcgaacctttatatgtattttctcgtacttctatatatctactacacacctgattttgattttcttttttcccttctgagaacaaaaaacctgcttgcagaggactggtacaatgccatgaagcagatagaaaaggtccctagcttaaagaagacaatcaacttcaaatttcaagcagcaactgttcttcagaaacaatgtaaataaccacactgagcagtgaactttgcaagctttacctcctttaaagaatcctccactttgaaaaagaatcgggtcaggaaaagctggagagaacgctgaagaaaatgtcacctcagattatggatgcaatcagacattgtcattatacataaacagtaggtcgacaatgatgacaattgacaacattaacagcatataacatgatcttctgagtatgtgtggttagcaagctcactgaagaataagagttatggtacaaatcaagctcactagcacaaataatgtagggaaaaaaagcagaacaaaaaaagtatgctgaaccttaaccttcttgcgtcagtctactcgaacaacagaagccatcagcgacctgaaataaccaaaagaagaagcaaattcatgagacacaacttgacagaatccataatcagtcaagaatacaactttatcgtaattaacaagtgagccaaccctgcatgggaaggcaccatagcatagaaagtatccgtatatagcatttttgttttcacttactctgattgtggaagtaagtcatttgataaaaccactaaaaatataaggacgtaaagctacaacaatgcattttgagaacataactcataaccaaggtaaaccaatggtaataacaatttatttatgtctccaaccccaatatgactgtgtatatagaacaaatctacataatttttgcaattgcttcagaagctagaaagctcttgttttgcttttgcacaaaccaccatgtagtccagtagttatgtactccgtactacggaactagtaacttcatcaggatgaatgttcactccctataacttctgaatgccactgcgttataagcctataaagatgacattcctacacgaattttggtctgcaattgtttttcctacctcataactcacaagccatagtgaaggatggataaaacagacaagataaggtgctctatcatatgttttatctatgacacattctccagctttagaggcactaaagtgttccaataaatgattgcggaatgacaaaaaagaaataagttgtttgttgggttgctcttgatcaatcttatatgcactattctcatagtgtttccatattttgtaacaacatatttgatctactgagaaagttatcccagaacaacatatttcgtaacatgtaataaggttttccatataagaatatgcgcatgctcagcaactcaatgcgcactccacttacacagacggacagatatatgcttgcctaatcagtcccctctccctgtcggctgttgcctcacactccagcattggcccactgctgacatgtgagcgagacaccaataggatgaggtgaacttttcagtggcatatagacaaccaggatgcaccctttccaaatttattaaacaaaaacaagactctataaaggttggtaaatatgcctagaacaaaaggcatgttaaagtaagttctgctgaaagtccgatataaattgaacagatgcaaatgtgcactttagcgcatttaacaacttggactattatgagttaactagtgacataagataataggcataaaatttacaagtagaaactggtagaattttattatggaaaaggaattaatgtgaaactaaatgaatgatgtcggcactatgtgaaacaaccatatcaatagtcacagtgatccagtaaaaaaacataaatataccatgtacattaattggaatggtcacccctcatacaatgtcattaattgatgatacaggcaacttatattcttttttagctcaagtatctcaagaattcatggctcccaaaatatttattgatgttatcacatatagaacattaagctgtaaagatgaaatacagtgctaagatggtactagcgcctttctgcacagtaataccaaaaacttgataggcaaaaagggttcctcaaaatgaaaatttaggtttttaagggtaatgatgctggggagttggcttaccatcttacaagtcagccttgattggttaaaaatatgtcatgcatgattgccactgcctttttgcttgagttcaagctctaactctttgtgccttacctccagctccaagcgcttattctcaagcctcattttttcattctctaacctcatctgttccagttctctatccttatttttactgaagcgctcccatttgagccgttgttttgcaagatagactgcctggacttcaatctgcaacctttgttcctcaagatctgcagattgtgtagccaaatccttttgcgccaaagccaagttggttccatcaggaaatgctttgttgatatccagtgatatgccatgggaatcagacctcctgctacatccatgtgagctggaagagttgccaaaacccacatcctcctgatctgtcataagcctcaatcttttatgcatgggcagggcactcttatcaccttgtaatgtgtaattttcctcatcattctcctcctcggaatcagagtctacactttgatcatcttcatcggcatctccgcttgttcccctcctcagatcatgctcatctttacatctaagggcaagctgcagtgaacgctgaagggcaggatcttcaggcaaactcactcgattgttattatggtaggagcacatctcctcgtagaacaagtgctttgaactcagtatcttcctcgcatcatctttcatcttgtcagacagattactcatgcaatccagcagagcatgattctccacaatcttgcaagctgtaccccggccaaggatatctgtaagtcttttgtatctcttattgagatcattgaatttatcttcacattgctgcggtgatacactgcagcctcgctcacccatgacctttgatattgccttccacttgccctttttctgcattattgcagagtttctcttcccagctcctgaatcagctcctggatcctccccagtgtaagatactgcagtaattaaaagcttgaccattgaatcagtccacttcatccgctgccatgcagcgcccttctttcccttgccgctctggctatcagtggcatcctcgttgacaccatgttcctcatcatcactcatgccgttcttggcgtgttgacgatggtgatggtggtggtggtggtcaacctttccaagctctccgaattgaaattctgacaagtgatcagaatctgtagactggtttacatgcatcgataaattgccaggcatctgagtatggtcaaagccctgctttccaggatttggagcatgcatttgcccagagttagaacgcatcaagcttccagagggtaggttgttgccttccattcaccccaaggatcagccaggcactgaagctgcttattaataccatatacaaacagacgagattttgcgcaggcactggtgaccacttttgttacatcacctgcgaaagcaattcaggagaattgttgaacacctaaagcaaaatacatgattgagaaatctataataatatcaaaaattaatgagatgtaataactaaaactgctgatataatgagtaccatgcttcaaagatttattcaaagtgaaaattaggaaaaaaaaatatccatgtattccacagaaaaggaatcaacagggccggatccaacttgggacatggggttcagttgaaccccccccccccccaaaaaaaaaaaaaaaacttttgggagaacaaacaaactgttactacttgtattaaaagaggtttaaggctctcaaattaaggagaagagcttcttccagatctagaagagaagttaacgaacgcaagcaaattccacgtcccggtgggatgggagatagagatgaatcagaaagaggatgtggatgctcaccaggattccctcccctgctctgctcgatcgccgcccctcccctgttcagccgcgactcctcttggcggcggcgcaaggagcggaggagacaacgagacgggagatttctgtttcttttacgcgatactcgactactcctccacctttatggctgtatcacagtatttttactattttaaaactactcgctaatagtacgagtaaattccataaaactgcatgtacttacacgatatatcgtgaaatgatagatttaagaacttgttttataaaagtacagatttaatattttcgtttatcacaaactacagatttaagacacatttaatatctttatttatcacaaaactataggttttgaatacactaaacctatagttttgaaataaatgaagatactaaatagttctgtgataaacaaatacactaaatctatagttttcttaaatctgtaattttgtgataaacggagacactaaatctgtagttttgtgaaacaagcttttaaatctgtagttttgtgataaattgtgtaaaatacctgtggttctgtgaaatttactctaatagtatttctttatagtaactgatggcccatatatctatcatcaaatacttagagaaaaattaacaaactcagttagcaattgtgtcgataaaaaattcctcagaccaccagcaaccactatatgccactccgcgcaccgccatcacccctctttctccatgagccaccatcgttcatcctctttgcctttacatgcgcagttgtaccctctagtaactgacatgtctttttctcctctcctatcatcatgcacactactgttatggacttatgattgcctttgaggttggagatgtatggcttgcagggcctctgggaggcaggagctaactcgacaaagaacgaagatgctagttctggactccttcttgctagatctagcggttatccaactgtcggagggaaaaagaaacggagagagagagagagatagtgtgcggagactttggagatggatagaataaggtggtccaaattgaaatgtaaagttagctattgtgtaagtgaaaaaatggttaaaggatgacataataatatgaaaacttttaagaatttttaagaatactgtaatttactccctctaaaaaacgaatttagaactggatgtgacacatactagtaaaacgaatctagacatgcatatctagatttgttgtactagaatgtgtcacatccagtactaggttggttttttatgggacgaagggagtacttttttttctctagcacaattaaagatgagttgtctattaccagataatctcgtgatatgctaagtatggttaggccagtgtacttagctataattaataatatcatgatatgttgatgcatggcgatacatacttctattaacacaagctgattaattatagttagatagatttagctaaaagataataaaaataataccatcatttttgctcaataataaaacattcgactatggtcttcttttctcattgcatgatatatgatgactacattagtagatatttacgtaattctttgatattgttttttattttctacatatatgttaattgggactaatatttttctcataattaaatagataacaaatcatttttccatatttcttctataaaatatgaatagggcttgttggtgctaaagccccagctccatcccggcagaacccctgccctgcatgcagagtagcagctgcacagcttcgggagaggagcagcatgtagcagaagcagggtttatgattccgagatgcttctgtttcgggctctagcggaatgacggttttcgcgaaatctagtggaaagctgatagattccgaacaaatttcataaagcaaaatttgaatacaaataccttgagtttaccgataagcttgcgaaaaccagtcagctttgacgaaattctgagcgaaatcatcgaaatttcaatcggtaactagaaaaggtaactgaaagtgttttcctttttttaatacgttattcttttatttcctactataaatttcattaaatatacagaatacattttttttcaaaaatttatatccaataggttctacgaatattatactatttataagattttgtttgattttttccttttttatcaatttaaatttgaatttggatgaaactcatcaaaatctcagatggcttctattttctagcctcgtcgaaacctcaaaattttatggaattcgaccggttttcgtcggaattgtgaaccttgagcagaagtgcagaacaaccaggtcgcaaggaagaaggagcaatcaaagacaacatgtcgtggtccatgggtgattaagtggactaattggctgttagggcttccttattaagttattagtttttgcggttttttttcctacttcaattgatggaacaatcacgggattagggaagcgagtggtttttactcacaaagtaatccaacaattatcaacaattgtgttattgaatttgtggctgcgcctttgtagtattatggcttacatcgtgagaaattgaaaaaaaattgataggatatattaatatgaaatataacactctacaaacatgcaagttaaaattcaacttttaaaaattgtaaaaaaaataacaaatatagctgcgaatatacgatatctattttttcaatttaatttgttattttttagcaacttgtataagtcaaatttggcattgtatgtttgtggagtgatatatttcatatcaatccatattgttattttttaaaaattatttagaactatttaagatgatatgcaagctttcatcataattcgtaaagcacgtttgaaagaagcacccctgtattttcgttcagattcgtcgctgcactcgcggctatagcatgcgccatactggcagattcgcccgcgaagaggaagacgaggacgccaagacggtggaaaatgattttttttctgcgaaaagagattaaaaataacaagtgggacgatgagcgtgtggttcgttttcatcgtggtgtcggtattcacggtggctgacaggtggggccgttctgtgtgggccatgggtgaccgtcagtcttggcaagggttttgggctgcccgcgcaaatgtgttcttgtctgcccactagccaagttgcccactagccagtcccattttgttggctggctgggcccactttgaatgagctcatgaaagctccatatctattttattcttctcaaagaaaagtatttactgaaaatactaagagcctgtttagttcacgaaaagaaaatttttgggtttcacatcggatgtttgaccggatgtcggaaggggttttcggacacaaataaaaaaactaattttataacccgcctggaaaccgcgagatgaatctcttgagcctaattaatccgtcattagcacatacgggttactgtagcacttataactaatcatggactaattaggctcaaaagattcgtcttgcgattttccccttatctgtgcaattagttttttaatttatctatatttaatacttcatatatgtgtccaaagattcgatgtgatgtttttttgggaaaaagttcttggaaactaaacagggccactccagtgccatctcccccatctactactaggtcataaatatttgacgcttaggattcaattagttattttaaccttttaccatcaattttgtattaaaataaatggataaaatctaaataagtttatgatatttatgatagtactctatgtacatgttattaaaaactatcacttgagaaattattgataatcaaaatttaagagtttgatcaaactttatcataaatatcaaatatttattactagagcacaaagacatatcataaaacaaacccagtttcaacaaagttggggccaactccaaccccaggccatgttcgtttgtgtctatattttcaagcaatgctgtggacctttggtacctacctacaggctcgcaacgaaagaagtcacttcagttctgcatctacacaaagaaattctgtcaaggctgtcttccttttatgtcaaaaagatcacaactaccaaccgatttagcctttgattgcatcaccagtagtcattgcaagaacatgacctggtttcttcctactactccatccgtcccaaaatagaagaacctagaattgaatgagacattttttagtgcctcttaagattcattatactaggaaatgtcacatccggttttaggttcttatattttaggactgtgggagtaactgattctagcctttgattgaatcaccagtaatcattgcaagatgggagtaactgattctagcctttgattgaatcaccagtagtcattgcaagaacatgaccccatcctgaagtggtggaacctgttgagatccctgacaacgaactccctctccacaatggcactgatgaccttaaacgcttcatggcagtcacggcacatcctcaggttcttcatcaccctaatggccatccccttggggatcaccagcaatccaagccccaatgccagcaactcactgtgcactccaaccatcacacctctgccttcctgatgatgatgatttccatcctcttcttcatcagcatcaaggactctggcactgccaattctccccttgtaacccttctccctcatcttgccctccaattcatctaacagcagcatcacctcaccggcccttgagccggcaggcgataccatgccagcgtagaacacgtaggagatgtcctttatctcgatccagctgcacccgggatccttccgaatgccgcgccgcctcatgttcgaccacaccgcagcagcgtcgtcggcttgaccggctgaagcgtatgcgttcgacatgaccaccagtgcgccggccacatcttgggtgaactctgataccttctgcccagccatggttgctaggtccaggcgcttgtggttccggcaagctgacagcaatgagctccacagcatgagggcgtcattgccattgacctgtgcttcgtcggccagctcgaatgccgcctcgagctgacctgcacgaccgagcatgtcgacagcacaagtgtagtggctggcacatggatcaatgccgtactcgcttcgcattgaacggaggagctggaggccggtgtcgaccagacctgagtggctgcaagcgtgcaggacgccgagcagtgtgacactgtttggctgcacgcctcggccaaccatgtcactgaacaaagcgagtgcgcacctgccgaggccgtacttcgccgtcgccacgatgatggaggtgtaggggatgaccgacggctggttgatcctgtcgaacaccttctttgagtactcgtagatgccacatttggagtacatgtcaaccagagccactgcaaccacgtcattgtcttcgtgcccatggtggaggaccatgccgtgaatgcacttgccgatgccaagccgcccgacgcccgcgcacgcgttcaccacgctgacagcatgaagtggttgggcgccatgtcttcgccattggttctgagctcggcgaagagctggatagcgtcatgcccgagcgcgttctgcgcatacaccgacagcatcgaggcccaggaaaccgcgtttctcgccgtcacgggcattgcgtcgaacacagcgcgggcgtccccgaccctgccggccttgccgtacatgtcgacgagcgcagtggaaacgacgctgtcgcacgcgtaccccgcgacctcagcgcgggcatgcacctgccgcccaaggccggcgtcagccaggcgcgcgcacgagctggcagctgtagagaaggtgaaggcgttgggtggcacgccgctgcgtgccatggcgcggaggagggcgacggccgcccggggccggccggcgctggcgtacccggacatgagggccgtccaggagacgacgttccggtcgcgcattccgtcgaacaggtggcgcgcgagggcggtgcagccgcagcggccgtacgccgcgaggaggtggttggaggaggcgaccgaggaggccgccccgagcttgaggagcttggcgtgggtggcggacacggaggcgaggtcggaggcgccgcgaaggaggtggatcagcagcggcatcagcgtggccgcgccggcggcggcgttggatgtcgccgtcatggagaccggttggtgccagtgtcatgtcgaggatcggaagcgcttgggaggtaccacgccggaggagccgctgccggggacggggcgcgccggggaaaagcagcgccgccgccgccgccgccgcggcgcaggccctagtccgtgtttgcttggggagaaccggagaaggcaaccagatcgtttcatttcatttgaaaatgacatatactatagaggaatactacacaaatactccctccatttccacactatgactttttttttaagttaaacttcttaaagttttatcaagtttataaaaaatatagtaatatttgtgataccaaattagttttattaaatctaacactaaatatattctgatagttttttatgttgtatatttttctataaacttagaaagaattgactttaaaaaatattaaaacgatttataatatgaaacgaaggtattagtagatttgatggtacaaagaaagtatttttctcaggcaacaatactagaggagggtatattatcaaaattttcatgcgaaaaattgtaatagatgtgaggagataaagtatttttttaccattaaaatgctaagctaattagaaaaaaatcactgttgacgtgattattaaggtttaaatcccgatgcctaaaaatattacacatgcgcatgtgtacttattataccaaggctaaagatttgttgtttgttttttcttcttttgggcgtgtgtagtgtgtgtaaatatgtcttttgtgtaatcaaaaaataataattctcaagtatgttagtgtggtgtactagtgtagttgtgtatgtatatctttcatgtaactggaataaaaacaagtcgattaagataaaaaatggagtcactttaattcctttctattttccaccttctgcctattttcagagtccagactaaggccgtgtttagttcccaagtttgaacccaaaaacatcacattgaatttttctacacacataaacttctaacttttccatcacatcgttctaattttaatcaaatttccaattttggcgtggaactaaatacaccctaaggaaacgaaaatggcatgacaaggatagaggcataggacagcttacaaaaacggtgcctttgtttcgggtaaatagctaatatggtccctgaagtttcacttcgggctcagtttagtctttgaggtttcaaattatccaaataattccttcaaattaattatttgggttaatatagtccttggacccacaaaaaagaccacgtgagcatgccaagtcatcatcgcatgcagcggtataaatgaaatgaccattctacccttatatatcatatagaaaagaaacaaaagatgcaaacaaaaaaacaacaggccaacctagacccaacattgttgcagagggtggccaacaaaggaatttatacgatcagtgttgggctgcagcaatcgtaagtgacaattctaaaacgatcatacatgtgtgaaacatttgttttcttttttatatggtatataagggtagaatggtcatttcattcgtactgctgcatgcggtgatgacttgacatgctcacgtggcactttttttggtccaagaactatattaacccaaatgattaatttggaagacttgtttggacgatttgaaacctcaaggactaaactgagcccgaagcgaaacttcagggaccatattagctattcacccctttgtttcttaataaaaagtcggttccttcaaacaacaaaaccatcaacttcctatattaaccctatatactaatgggcaaggtagcagggtgccagaccaatcttgagatcaaaacatggacagccaaattgttccctatatattcaataacagttttcaacttgtttttgtgttgttcagttgcaagcaaataagcaccacaatcatgaaaaacaatgctccagtgtcacttgaatttaccatccatagttccacacacacacaaaaaggagaaaataaagggtctggaataggactcaaagtgaatcatctagctaattctcaaaaaaaaaaaagtaaatcatctagctacattaaacaataaactgttacagtaactggaaaagaaaaggaaagcaaaataaggagatgatgtccataactgcatgcacatctcaaacttttaaagttgcaacacaaactcacaaaggccaaagatcattcagacacatggagcaatcaatggttgtacatgaaaaactacagccaggaatggcccctgctcataactcaagctttctccaagttcaggagcacacaggaccatcattatcctgggctggaaggcttgatgcattctgcaatcaatcagtagcatcaacatgccatgtttgttttcagttaccacatgaaccagagcagcaggatattttcaacatttcttgcattgatcacatgacagcaattgaacaaaaggacagagcagataataattgaatattttccaaccaaagaacatggttttccggcaaaaacagcaatcagtactatagaaacatcaatttgggaggctcagtaatgaacttaaaaacatccgaaatcatgaaacaaatgttctatatatatgcagtaaattacaactcacgcagatgaattatgaatatacagaagaatgataatgtggctcaggtgacgcaattactattacaaaagatagtggtggatagttcaaattcctcaatactagcaacaaacctggcatcaacaggaactctaatatggccatgtatgattcagcactgctcaaacagacaaactcaacaatatatctcattggaaacccggcaagaacttgagaataaataagaccaagaacttagaagcacttccggtggacaatcgctgggcctgattcgtcatattcagccttggagatccacatctgttgcacaataaacatcatagtgcgctgttaattagtaccaagaacacggaaacattttaattcatttttttaaaaaaaatagtaccaagaacatgaaaaaaaaatcatatttgtgcaaccaaaacatgtagcctttcatttctcttcttcctgaatgaattggcaagtttcaaaaagagagaaaaattcatattataagtcgatttgatatttttcctagtcaaactttttaaagtttgaccagtttatagaaaaatataacaatattttcaacacaaaacaaacatattgtgaaaatatatccaatgttatatttaattaaactaatttgacctagtagatgttactaaatttttctataaacttagtcaaacttaaataaatttgattagaaaaaaagtcaaagcgactcatagtatgaaacggagggagtagtaatcaaaattttacctgttggaaggtgctaagggaggcaaggatggatccaccaatccagacactgtacttcctctccggaggcgccaccaccttgatcttcatgctgctcggcgccagcgcggtgatctccttgctcatccggtccgcgatcccggggaacatggtcgatccaccactcagcacgacattgccgtacagatccttcctgatatccacatcgcacttcatgatcgagttgtaggtcgtctcgtggatcccggccgcctccatgccgacgagcgacggttggaacagcacctcggggcacctgaacctctcggccccgatggtgatcacctggccatcgggcagttcgtagctcttctcgaccgagctgctgttcttggcggcggcggcggcgttgagctcctgttcgtagtcgagggcgacgtaggcgagcttctccttgatgtccctgacgatctcccgctcggcggtggtggtgaaggagtagcctcgctcggtgaggatcttcatcagggcgtcggtgaggtcgcggccggcgaggtcgaggcggaggatggcgtgcgggagggcgtagccttcgtagatcggcacggtgtggctcacaccgtcgccggagtccagcacgatgcctaattaaaacaagatgaacaattttattttctttttcaaatctcactaatatgaaggacaaaattttgaaatttatgaacggcaacaggatggttaccacttactactatcttttactctttgtaactaaatatttgtaatagctactaagaaagaatataactaaacgaaagtgcttttaataataaatttagtaatatttttcatacattaataatttaaaattttgaggtttgactgtacgtattttaggacgtcatctactccctccgttctaaaatataataatatagaaccggatggaatatttcatactccctatactagaaaatatcaatatccaatccatcctagattcttatatttttagacgaagatagtatttaaggacaacccccctcaaaaaaaaaaaaagaaataaatcaaatttcgaaaatgaaattttaaatttgcgttacctgtggtgcggccactggcgtagagggagagcacggcctggatggcgacatacatggcggggacattgaagctctcgaacatgatctgggtcatcttctcccggttggccttggggttgagcggcgcctcggtgagcagcgccgggtgctcctcgggcgccacccggagctcgttgtagaaggtgtggtgccagatcttctccatgtcgtcccagttgctcacgatcccgtgctcgatcgggtacttgagcgtcaggatcccccgcttcgactgcgcctcgtccccgacgtatgcgtccttctgccccatccccaccatcacccccgtgtgccgggggcgacccacgatgctcgggaacaccgcccgcggcgcgtcgtcgcccgcgaacccggcctgaattttggattattattatcaatggtttatcgttgctgttgttgttgtttactgaattttttgaacgcaagaacataaggtatggtttgttgttgttgttgtgatttgtgagaggtggttaattggattgagttgatgatgatgatgaccttgaccatgccggtgccattgtcgcagacaaggggctggatgtcctcgccgtcagccatttgattcttcagagattatatatctgttgattcaggacaaaatggaccatgatctattagttccaatgcagtaagactatatcgattgattaagaacaatatggacaatctatttatttagtagtaacaaggcaatgcagtcatgatcactgaagaattaaaatggatgtttttgtcatcacaaatgttaaacttgatcctatacatctagggtataaatcaagtcctaacatattctagtttttttatgtaatcaagtcctaacaaactgtatgaacacaccacagcatgtaagcttcagcttaattgattagccttggaaagatggcagtgcaagaagattataatttggccttatgaactggattcgaactgcagtcaaatattacatttacatggccaaaatatagcacaaagaatctgagaaagaaaggcacaaacagattcaagaatatttttggttgttcttaccgggagattgcctgcctgaaacctccaccgagatggagatggaggaggtgcagaagaactaggcaggagagcttagggctctgcttggatttgtctcctttttatatgcacatattttcttttcaactttcttgattctgttttgaaataaaaaaagggtagaaatagagcaatatatttggctgcattacagtgtgctctaatccgttctctctattttttttggtatagaaacttgtttgggatttttctttttaaaaaaagacctatatttttacgtagaatttttcccaaaatgataataagtttaccactctttatttctaaaatgaaaatgtacattgtgtgtttttttagtttaccagctatttacgccacatctaaaaatataatggatccatcatggtggccaactgttttgctggattctttaaattgaaacactattcttttgagaggaaaattaaagggtgttgatcctaccaaaataattgaaaaagggaacctttgctatgccatctcatggccagcaaagaatctcctacttggcaaataatttgatcaacttccattgtcatagtggaggccatgaatggccagaatgggcaactgttttcaaattggcctggcacacacagcaatggttatgatagattcaaccaatgttgaccaatatacgggtcgaattaaaatgctaacaaatacggtttgcaaagattctcagctttcttttaataaaaggaaggagaccccaatcaagcaaaagatcaaaagattgtttctccagcaaggaattattagtggtcctagatgaagggaaaaggagcagcaaacacagaagagagtctcttttgagcagatcaacagaggaggctggaatgagctggtgatgaataggaaacgtgggccgcacgatggatgacatggagcgcacagagtcgtcagatttgatataaacatgcagaggggcgtcctctgatttcttggctggatcctgcttggaactgggccttccagttggcctagctcatttaattaccactattcatttttagataataataataattaccactgctcattttctatgtagatgcaccgtgcacgcaattaacgcacgttactcacaattggctacccttttattgccttgaggtcatactttcatgctagtactttgctaatatcagagggttcacattattcaatatcaaggtgaaaaccggtcctatcggtcgaaaaccgaacgaaactagtagaatcgaaaaacaaagacgactttcagtccgtaagaaatttatgatatcagaaatcaaggtccatgttcccatcttggatgtagtttgaaccaagcatgccagcattactaagcttgagatttgatgaactattgtgttctttcatttgattactgtgttcctgttgttcctgaaattactatgagcacacaagcagtacttcgttcagcttgtgcagagatcgcagaaggcaatctcagcagtttatgcatgattgcacaggacgctttcttgccaatggcaggtgaacacaggaggggcagtgtggcagccaaaggtacccaaaacatccaatcttcattataatagacgggcacggcggtaaattctgagtagcaggtcgttgatatatcaagctaggccgatccaatttcctctatgtaagaacaatgagaactgagaccgaaaaaattaggccccaagatgattgctcaaaatgcatataaaaatgcaaaaccaagccaaaaatgattacgctctactcctctcaacattagtgaggcacacatcctaaacaagcacatcggtgaacgaacgagacaaacgtcaggtaatatatgcaggggatcaatctttggctcctgagtcatcttgtcgttggctggcctctcctgaagttccctgcaaaacagcaaaagggtaaatcttgtcagtctttggaacaggagaatatttacaggatttttacatgggttagtcttcccacaaaaaatctttgaaactccattccaatttccaaaggaggacttaggacatgggactagctaaactttctctgttcatggttgttcgggccaagggaaatacctgaacacgtgcaagaagatcctctagttcggctaatatatctgagaaaggaggtcggttggatggaatgccttcccaacatctccgcatcaagtctaatagctggggatgagcattttctgggagccctgggcgcaatcccttgtataacagtaaaatgtcatgcttagtgcatttcacaatgggcgtattatggtaaactgtaacaagtaataactgacagcatattatttgaatagaagaaacctgcatatgctacacacctgtctcacacctacagctgcttggagaggggtcatggtattataagggatctaaaaataccagaaacgaaaatttgacaagccttagcaaacactaataaatgcacaatgtagataattgtgtctcttcacagaaaatcgtgtaccttggacgttatgagctcccaaagcacaatagcaaaactgaacacatcagctttgttatcatagggttgatgatttatgacctagcaacgccgcatcgaagatatattagcaaggaatataatattcttgtacctttagtagacaatataaactaggtaactatagaatgtccatgcaaactacagaacattcagattattgaaacaaagaaaaagtcttgtctagcaccttgaaccttaagacaaagcatctaaaaccctgagctttacaatacgttcatataacctcccaaagtgatttttgcctaagtggaatacacattggatgggttttgcccatgtcgcgtaaatgctgaacatacgtatcaaaatctccacttactatctcctctttatcccaattcattctctcaccaagggaacaaggactgaaaaaatgcttgtatgaccaaaaaaaaagatcaaactttaggaccaatgattgagaaagcaccaacatgtcatcctacttggacaaaaccgcttgttcaagtttccgtataggcaaaaccaccatacaaaacaacttaaggggaggggcagttgtttatagatggtattgcaaagtttggggggttacaaactaacctttaaaattcgaggtgctcggtggacttccattaaaagcttaaggggtggtatgcctatagggaaatttccatgaaacaacaaactattctgaactattcactttagcagtacaatatattatattgtgataagcatccaagttttgttttcgagacttcaaaaacagtaacaatattaggcacacttgaaactgaattactttgctccagcaacagagttgtacctctggtgccatccatctgtatgttccagtttcagctgtcatgttacctccttgatcctgaaaacgagctacaccaaaatctgccactttcacaacctagaaaaataataatgaagttatttatcagttcatagatattttctctcaagtgcaaagcagatggctcctgcacatacaaaaacacaaatgaagcatgattatattgcatcagtaccatttgcccacttgcataaactatactatcttgtcttattttttcccctcatatgttcatcaataaaatgttaaagattataggctacgtacatgatctttgtccattagaaggtttgcactctttaaatctctatggataatacccctctgatgcaagtaacacatccctctgcatacatcaactgcaaacttcagcagagttggaaggtccaagacattatgctgcttgtgcacaaagtcatacaggcttcctccagacatgtattctgaaagatataaaagtagatgatgagcattagtaggaatcttccagtcaccaagatataaattaagcaagaacccgctctttgtcacataataacaagcataattatatggaattaaaaattacatctcaccaatattgtgaaattaattagcattgtgtaataattattcagcacatgctttatttttaggaacaaactattctttgcaaattccccggtgagaaccaattgatgtcataaatcttaccagtaattatgcaaaattgtggtggttttgtgcatgcaccaatgaatcgcacaacattagtatgctgaacttccctgaaaacaagtatgggagatcaaggcaaggcataaatatttagttattggtacttgcatgaactgggtaatttcagacattcttaatctaagagcagtaatatgctcatggctaagaattggatatgcttaaactattcattcacaatggtaaatgctaaaaaagaattatataaacaaaacaccttattataatgttaaataccttagaatatatacttcctgtgtgaactcattccaaacattcttattcaaatgctcagatcttagaattttaacagcaacatcctcaccgagataagtcccatgataccttgacataaggataacacaccataaaaacaaagtgcaataaatacagtgataaaacaactcagcagtatacaattgacttacaaatccccacaagatccagaagcaatcatccctcccatcttcagcagtcgtttgtcaatttcccattcaccaccttttacttggaatggcagtgttctttctgcagctgatgagtgagatgaacctgaccatgatccctgcattttcagagagcaccagcaaatatgctgttagatttgtcaaatggaacaagacattgtatcatgcatcaactccttgcaaaaatacaaaataggattatatccgcatggaaaatgcttattgcttagacgatcataatatatatcacaagttacctcattccttaaaatggacgcttccagtgcctagagcaaaccatcagtgt

SEQ ID NO: 28566 - DNA, 3539 bp, Oryza sativa
actattccagcactagtaaccattgttttctaggaatagaaggccagacgaaagacttcaatacatcagttctgcaatttacatctagacagttcagcaaatgacatgataagaaccagatattacctcaatgggccagccatcaacaacaaaaacatcaagagaatagttgtcaaatgtcgagaaaacatgcgcttccctgatgttcaatccaatgtcagatagcaaagcagacagctggcataacatattgcagttagatgataacgatatactgtgagcaaaaagtcaaacgactagtaagcacatgcttaaattggaacaatgatttagaaaatgccaatgtatcatgaggttaagttagaaggcacataaaattgctgacctgactaaggagctttggcttgtcaacagtggagaaaaccacctcatgaatgtgtgcgtatgatgtgtcctgcctgcacaatatacatagccaacttagcaagcctataaaaggtcaagatatctcaagcttctctctaggctatgtgcatgggcatgtaatagtgtgttcatgcaagtccacaagtggtgttgacttattcaaggagatttaggggatacataacttatgtgggatggtttacttcacaaatacttgaggttagtaccgatattctgtatttatgcatattctctatttttctggtgcagagtgcactgactatagaagtaaatgtatacaaacatacaaacactattgtgttaatctgtatggttcctatgcaataaggacttaagataactataatgaagatatgatgtatatcgaagctacagaactttaggtgcaacatatcagaagcatacaaaggaagcagacaacaatgagtcaggaaggttagtatgtaaattcttgagtgcaccaagctaaatgtttaaccctttcttacttcatttttttctgtaaagaatgtctgattacaatgttcctttcccacacataataatgagtggaagacattttatctacaatgacacatgattttaggaccatcaggatctccaattctctacggtggcacccacttgtcatggagagattatacgggagatggggtatagttttttcaacaagcagtgccaaatgccaatttgatccaagagggcaccacctcatggaccaaaacacccccatgacaagcagactctaccaccacattgtgtcccatctagacgctacataggccaaaaccactattaaacggacagataacaagttttacccggttttcagagttgagtagcaggttttagccagctttggagttgatggacgaaaattaaaccacaccaagagttactggacaagaaaaataatctttccttcctaaaaaacaatggaagcagcatcctagcactgtgcatgattaccttacagagagatcatcaccatcatcagccccatcttcagatgcgtcagagtcatatgtcggatccacttcttcaatctttgatcaaagtttagagtcaatttgacaactccgatttctattggtgatactaaagataaacaatcagtaatgcatggaacaaacatgtagcattggcaagataagaaaacataaaatctaaaagctagagtaacttatccctcccaatttctctatcaagatcatcaaatattgtaatgttatatgtagtatgccacataaaaaccatttaatatcatagctaaaaatgtacttctcacggacagtatagtaggtgtgagcatcatcccacctgtgctatggcatttttcaccaaagacaaccagctgcaatatatcatgtatatactatatgaacaatggtcaagcatgtattgacaaatacaccttgtcattttcttcagtatttaataagacagttcagaaaatcatggcaacactagtgtttgtctttgtacgacggccacggccctgtttacatatcatgtagagaagctcccaatgatagctacacacagttacttctaatgaaagaaataagaaaattgtcagtccactccatatctttttagattgtctacggcaaagcctttatttagtacaaaatcgagtgatatacacattgaactgaattattccttgcttcttgttgtgctcatctgtttcaccataaaataatgtgtactgttcattcagaaacctccttgaaatagtgcaatgacagctgtaccatgaaataatgctctaaagttacatggcaaaattcataatattggtgttacactattcttttcaatctagagttctagactttcctggccataataccattaagtatgaacaatatgcaacccatcatatgtaaacagaatacaactagtagccaccaatccactaaaggtgctatcattatcgcataacacaaattagttgcttctacaatagtccagatcaacataagagttttaccctcaagaaacgaacatggaacgcagggcgcctatcaggatcttttgcttctgccaagaccttctgatggactaagacgtcttcagctttgtcgacattgatatccagttgatagctacatagtgagaaaacaaaacaggaaccaatatttaactttatcattgcacaaagggcagaataatggaatagataatagcctatcaatactaaatccagaaaaaagacgattgcagttacaccaccttcctttttcagttatgacacaccataaaacatactcaggataactacacaggattatccaaacaagcaattacacaggatagctacaaggacaactccacggctgaaccaatcattccatttaaaaaaaatctatgcaagtataggaaaaaaaccattgcctccagaatcagaatgggctattagtcaagccaatggataagaattcggaatcagaaccaaataaaagtactttttggaagtgagtgatcccaccccaaaacaaacataaatgggttaatcactaattcaattccaagcttaactacaatcccagaacataccagtcaaaaatcgaagagatccagctctactcaataaatcacgcactgttccattcatcacagtagaagaaaagcactgaattcaaccatactgaattctaattccttggtcgactcaaacagcattcctaccaaaccaagcaccagataaaacttaactggaatgtcaccgcaactacaatttcacaccagttacacatgcatcacccagaagcttcatgagagcacccaaacccaaaacgattccaccacctacgtgagccgcgacaccgaacagggtttcaacgagaggaagcaaacgaacaggaggagcagaaattaaccaatcaaaccaaatcacctatgtggaagccgcatgaaatgggcctcgagctgtgcgcggaagtccggcgcggccgcctcctcgttcccctccgcgacgagccgctcgtacacctggttgcagatgttaagccctcccgcgccaccgccaccgccaccgccgctcccgcccgacgccgcgggcgccgccgcggggtcacgcggcgggg

SEQ ID NO: 28567 - DNA, 17112 bp, Oryza sativa
aaatacgaggcgagacgaggggcaaaagcgtcgtttcgtaggcggtgagcgtgtcccacgtggccacctcctcgggtgcgcgtagcgaggcgtggtgcccacctgccgggacggccgcgtgcgcctcgtccacgtggtgtgacctgcatggggcccacgtgtcggtgacggtggtccagtggacgcggtgcgggtaggcagggtttgcgagacgtggatagggttttccgtgcacggggtgctgctagtagtacacgacgcatgttccctgcaggtttggtgacgctcactggcatgtgggcccgtgttaatgctggacagtaggagtggttagacagcgctcgagagaacgacgatggttcaaaaaatacttaagtattttcacgcgcacgctttttaaatgattaagggcctgtttagatcccttttaaatgattaagggcctgtttagatccctgtcacatcgaatgtttagacacaaaaatattaaatatagaaaaaaaaactaattacacagattgcgtgtaaattgcgagacaaatcttttaagcctaattacttcatgatttgacaatgtggtgctacagtaaatatctgctaatgatagattaattaggtttaataaattggtctcgcagtttacaggaggaatttgtaatttgttttgttattatattacgtttaatagtgtccgtatatacgatgtgacacggcaaaaattttcacccttggatctaaacacagcctaaatagtatgttcattttctaaaataaaatctatagaacagttatttcaaatattatattaatcgatttttcaaagtttaaaataattaatactttctctaatgacttagtaccttgtaagctcaaattagatatagtgtaagttcaattttttttcttaaagaaaggtagtgcaccaatacgagaatagcacttacgagatagatcaagcgaaattaatctttaatcatgatatttcatatgggcgtagttcgcaaatggtatttttatatgatttatatattccgccaaccaactataacaaacaaagagggtattacaatcacttcaattagtgtgacaaacaactttgatgaatcagaacaaccacagctagaccaaagggatatccatcaaaatgtgcccccataaactcgtcaacatgactagtaggtcatgatagataaacactccaatcggttgaagtatgaagtaagcacttatgccataactattattaaaagaagtagtgaggctccaagagggtccaacttgttttagaataacacgtgaaaagaataggacacagtaccttgaaatttcaaaaactttagcctattaggtgattcttgtttttttttctctacaagtattatgcacagtcttgtactgactgttgatgtatttccaacattttattggatggaagtctaactcatcaaacatacaatcaaacaaagcaataataaaaatgattgtttctcattcaaggtttattctaagaatcaccctgatccaacatatatataatgatataacatgtgtaaaaaaacaagtatcaacaacatatatagaggcaccaaccaattcctaactttagctggtttagtttggttctattatcatgtcctcctagtatattcctttctttttagcatgttcatcccccatcactccataacactattaaacaaagacaactaaactaaaactataagatgaagtccttaactggtctatgtgtatgtcataatgagggaatgacaaaggtgcccttgatgtggactgctgtaaccttgctgcttgctttatccaaaatgtggattagaaccaaggcatagtagtgcgggctggaatctgcttaaagtagaaggaaggggagaacctaagatgatgaatccttcccatggggtccatgcatgtttattccccatgtaagcatgtcacatcctaatccccttcctagcattgacatcccaaatgagtgcacatactcactccattcttaaatattcattttttttaaaaaaaatgtgcgtaggaaaacctagaaatcttatcgttaatatataaaaagtattcagatttcatatatgaaaattatatcaatagattttaaatactttcatgtagttatagttatgataacattacaaacttattattaaaagaaacaattatcaaatatgtgcatcaaaagttgtatcgatatcctaaatgacaagtgaagaagaaaaaatagagggagtaataaatatctagaaatattctccaaaccatgcatgaataaatctttacatatgtacaaatgctccattttgtttttaagccatagaaggactactggatttagcatatttatttcctttgaactgttataccttttttaagaaagtagaactatactaacaaaaatgttgtaattttgacacatcaatgaagtttttaaaatgtaattttgaccactcatctctattgtaaaaatattcataaattctgctaaattgtattattataaaattttaaaaaacgtgaatattaggtaataacctaatatcaaataattataagggatgagacttcgaactcagatcgtctagcccaccaccttgtggagctagccggaagactcctgagcgtttctctcattataaaattacttttgacgcaaaaaaatatcgatttctcatagttttgaaagtttgaatggatgtttgtccagaaaggagtaataaaattcatgaaagtgttagtggaaatcgttactacacaaataggaggtttgattcccaccaaagtagagttagttatagggtatattaattataactggtttattattcttgcagttccatgcgatttgatctgatctcttggtcctaattaagtcatgtttagtattcttagaaattagtattttgtgacatcatgaaaagcatatatactccttattggcactacaacaagatcgatctccttttgacatatcgcataaaagcaaggatactttaatttcggaacattcttagcccattactgaaaatgactgttagtgttcgacgtgtaacagtgtgttaattaaactacatgactacccgcatgttgctgcaaaagaaatatatgataaaataatatacatatgagttgtaaaaaaatcttatttactatacgattttttttcatgtacttatattttgtaccttgatcaattatccaaatgttatatatggttgggttttatggtgtgactttttttttggggggatgcaatttgcatccttaatgaatcatccaaaggctaaaacaattgagatgatgtgattttatgagagaggagagaattatcattaactacacttagtgggaatgaactttatagatatgtatatatagattaaacgtatccatgtgttacacaagagtagtggaggcgggcatctagcgtaaacacataatggtatactaattaatagtattagctagaatctctatatataggatgttaaaataaattcctccatcttccttggcaatattttagcgaagatccggaccaattccatacaagttgaatactgatgataaataagatcgaaattatagtaaatcattataattgaagataattttagatcgtattttttgacgtacgtatgtccaggcatagctccatgagcaccaatcgagaagatcggatctagagctctatcagtcgacaatccaattttggatgtgtgaatgtaacgctgcacgtcaaatagctagcttcatctcatggctgatgggcaggcaacgtaagcttggagctgaaagagcactagtgtcggccattacactgtctctgtttcttttttttttcaactccaaacttcaactttttcattttttggttagcacatttttcaaactgttaaatgatgcggattttttttaaaaaaatttctatataaaagtagttaaaaaatcaaataaatccatttttcaagtttatatataataattagtacttaattaattatgtgctaatagattttctcgtttcgcgtgaactggaaatatttcttcctaaccacaaaacgaacgaagccggatccatttggcaacaaaagggatgccactttgtgtacgttggcgtcacacttgcattggaggtcctgatgagtcattttcttggaaaagattttctagagagaggaagtgaagaaagtcgcacagttccatccacttctttctccaaggattgggtagtacatatgttatgctatgcttctcattatttgcaacggtactatgtcatacgacacgcgtgtataccaaaagatattaaaggagaaatggttgtgcatctgtggcctctatttttagcgagttttttcaaataaaaaaaaacttactttggtgttccaagtataaggcattttaggcctacatatactcaagaaataagaaaatacctcaaatgtgttggttacccttcatttgtacgacgttggaagagataagttttgtgagaagagttcaacttatttgacaaacatatcaaacatggaaatgaaaaaaaagggtgaaaaacacctacaagttctaaaacaatatagatttaggaaagactagataacacgatatgtttataatcgatgtgataagtcatgagcacaaataagagttgaacaagcaaaacctacaagaaggttggccaataatttctttacaagcaatatatttaaaaaaacttaactggcaaggaaaatatatggttatataaagcttatccacatagtttgtgcaatgcctactttggtctttgagtaatcatcaaagaacaccccaaaagtctgaattctggcttagacactagcagtggccatggtgccgtgggtaccaggcacacttgagatccagaggcagaagcaatgaaagctgcttgctgaaaatgctagtagaaaatttaaaagtgtcctgatctttcccttctattgctaaggtgaaaaaaaaagttggagcatatgcatgtgattggttaggcactggttattggaagaagcaacaaacacattgtagtggtggatggcaggccctacctaagtcagattgaacagagaaatgtgcagtagtttatccatttcttcttcaggagaggaagaagaggaggttgcattgcattgcagcaatggattgaggaagtagctttcagagttgaggtgtaaggcctgtcaacttgctcaatcatatatggttgggcagccttttgatcatccatccccatgctggtcttatcttggccccaattaattaattaatcaatttcctttttagtgcaaagttaattgtgatggtacacttttgccactcaactttgtcgtctctccctctactcttgtttcaggctagtttgcacgtgtgaattaggatcgagttttcatgattcataaaccgttggttttagaggtttgagtgagtaaacgtttggcttactgatgaaaatactctattagcatatgattaactaagtaataacttaaaaataaatttgtttaaattttaaagaaactattttattgaatttgtttttcaaaaaccatacatttgttaggatatataggaagcatgcccgtaatgatctacgaagtagtagctagtactaactgaagaacatgatttacatgtatggaactttatgtatgcttcttctagaacgtgccggttatcgagttctacacaattataagaactcatgtaaaaatcttgagttccaagttccaacctttcacataggcttaaaagttcaacacaaactggattacaagtgcagtgacaacttcaaatttcctaattttctttgccatgagtcatggtcactgctgagagttgctgattcatcaagctactagacaaagctttgccctggatggctccgaccagtgacgtttgatggatacacaaaagtaatgcatgattaggtgacctaataggctaataagaggggtcaaacttaaatattgggcacaaaatttccccaggagaaaggatgccacattgggtggacagtgattggcaaaccaaccgaccgagaaacctaattggctatggtctacatggtgggctatgatatgttccaaagtgaactagtatgccattgccgaggataatcaaaaatttttctcttaatcaacttgatcaaactcttgttagatacctcggcttgcccattggcttgcgcataatatggtgaagaattcaacaacttgatgcccatgctatcggcaaactgaacaaactcatcagacacaaagattgatccctggtcagttgtaatagtctggggaataccaaatcggtagattatatgctccttgacaaattgaattgcatctcctggatcaaccttcttcaaaggaatagcctctacccacttggtgaaataatcagttgcaactaatataaatttatgccccttgctgaaaggtggattaatctggccgatcatgtccataccccatcctctgaatggccacagtttgataataggattcatagctgatgctggtgctctttgaatcgctccaaacttctgacagtcttgacatcctttgtagtatctgaagcaatcttccaacattgttggccaaaaatacccagcacgttgaagcaaccatttcatcttatgagccgattaatgagtaccacaaattccttcatgtacctcacctatcgcaaccttggcttgatcggcacttaaacatttaagcaacaccccatcaatcgtccgttaatatagctcatcatccaacaaggtgtactttaaagccttataatgtaatttcctcgaagccgattgagatggattttgcaaatattgaaatacatcatacctctaattatcggctgtgatcgcagcaacttctatttcaacatctctcaacatcggcttatatcctgatgcaccctgagccaagtcgttagcttctacattctgctctcgagacacatgctttaaagtgactagccgaaattcattcatcaattctcggcactttttattgtaaaccatcaatgtatcattcttgcattcatactttccaacccttcctttcaaaatcggagccgatagcatgtacttaaccacattggctttacataccacagtgcattcattggacaatagataataccttaacttggtgcaagagaaatacaaatacaagcacaacttttccacaggagaataccttgtttctgcatccaagagccgacgacttaaataaaacacaaccctttcttttccttcaagctcctgaatcaacaccgaaccaatcgacttgtcaccagccgatagatataatctgaaaggtatcccttttttggaggaattaaaactggtgggggaactaagatattccttgatattttccaaagctttctgctgttctgccccccaagtaaacttttgatcggctttcaacctcaacaaaggtataaaaggttctaatcttcctgataaattagagataaacctccgaacaaaatttatcttgctgatcaactcttgcaactttgccttgtcctccggaggttgaatcttttgaattgcattaatactcctttgagtcacctcaatccccttctcgtgaacaagaaatcccaaaaattggccagccaatacgccaaaagcacactttatcgggttcatcttcaagccatactttctagtcctctcgaaaaccttcctcaaatcggctatgtggttctctatttcctttggcttgacaaccacgtcatcaatataaacttcaaccaaccagccgatcagatcatggaatatgtaattcatggctctctgatatgtagctccaatgctcttcaagccaaaaggcatcacaacccactcaaacaagctgattgcacccgtacatctgaaagctgtcttatgaatatcttcttctgccataaagatttgattataacccgcattaccatccataaaactcaatattttgtgtcctgaagcagcatctaccaactgatcggctaccggcattgggtacttatcctttggggtagctttgtttaagtcccaaaaatcaatgcacaccctgactttgccatttttcttgatgactggaactatattagaaacccactcagcatatcggcacgggcggataaaaccaacatcatataaacgtgtaacctcagccttgacagcctcaagcatatcggctttacatctccttggtggctgctgatatggtctaaccccatgtttgataggaagccgatgttcgactatcgatcggctaagtcctggcatctcataatactcccaagcaaagcaatctctgtattcctttaagagctctatcaacttggttctaaattctggagacaaattcttactgatgaatgtcggccatggtctatctcctggacctatgtcaatttcttccaaatcattagccgacatgaaaccttgtccttgcttgtcatcgagatcatctaccgtgtccttggtgtagacatttgaaccctccacgatgccctcaaaacaataatttgggttctccatcttcaattggctgtatatcacaatcggacacttttagaaaatctccatcccaaacctttccagacaggcaatcaataccatccatctcccaaagagctaaatcggcactagcaacattaactgacctgtcagctggcatgatctcaatcttgtcaccttgccattgaattaagcactgatgcatggtcgaaggaatatagcaatttgcatgaatccaatctcttccaagtaacagactataggaacccttcccatcgatgacaaaaaatgtcgtaggaacagttttactaccaactgttagctccacattcaaaactcctttggtttctcaagggttgccaccgaaatctttgagaaccatgttagtcttgataagatcatctgaatttctgcctaactttttgaatgtagcatatggcattaaattcacagcagctcctccatcaaccatcatcttggacatcaacttcccattgacaaatccattgatatacaacggcttgagatgccgattctctgtcccttctggcttctcaaagactgcctgctccggtgacaaaactaatctagccgaggcctcttcaacatcatcaacatcggcttgcctagcttcaaattcggctggtagcgtgaaaaccatatttaccgatgcagatgcagtaccttgcctttaagcaacctttttgccttgtcggcttcaacttcatcggctgttgtaaccgtgctcttaacacgccactcttgcttggtctttattttcctcagccgatggctaatttcctgttgcacctcctgaaaacgttccctgttcctcaatctttgaacccttctcttctggttcttggtgaaaataactgtagagcaccattgtgctttcctactttcatcctcatcatggtaataatcttgatttactgggcccaatctctgatggacaggtactctcttctgagtcagccgattgcctctattataggatcggcttgaactccctgtatcttcactgcatccagggtaatcctcaatcgatggcagcctcatacccttattccaacaaaatctgaaaaagtcacagttccaatgaggatcaaaaccaccatcattttcttcttcataatacctctcctgctgcttctcatatcttctctggtatttattaataattctagccgagttcatctgaaaatttcgattctttcccccatcggctgtcctcccagatgtatgcgtcatattaacagggaaaggattaccatcaaccatcatcggcttctttgaatcatcaaacttgatctttcccccctcaatggccacttggatttgttgcctaaaaactttgcaatcattagtagaatgagaaccagaattgtgccacttgcaatacctccttttgcctagctcttcagccgatgggattacatgaccagcaggaagttgaatctatttttcccgaagtaacaaatcaaaaatcttgtcagccttggtgatgtcaaagtcaaacttctcttcttttccagaacttctcacccattgacatggtatgacttttttgcttctgacccactcggctgctgctacttcagaatcatcatattcttcagaatcatacatataaggatatacatgattgattttcttgaaattctttttagcttcagcaaatctttgctcatgtaaaatcaccttctgcgcaagatgggatagactctcaaagtctgggatgaaaatttctccttaattggtgctatcaacccttaaaaagccaggtcagctagctgggaatctgttaaagacaagctatagcacctattcctcatctccctgaacctctggatgtaatcctgcacagactcatcatgcctttgtttgattgctgttaaatcggacagtttcatctcatgaattccactgtaaaaatagctatgaaactgcttctccagatcagcccaactattgacagaattatatggcaaagatgaaaaccatgtgaataccgatcctgacaaagataaaggaaacaacctaaccctcaaggcgtcaacagccgatgccttgccacattgagccaagaatcggctgacatattcataagttgaaacattgtcctaccctgagaattttgagaaatctggtaccttgtattggctagggtaaggatgccgatacatgtttccagtgtcctttggcttaagcccaaactgctccctcatcatatctgcaatcatatcagcccatggcctttgctaagataccccttgtgtctgctgctgtaccggctcgaactgattaaattgaggagcaaattgaggctaacgcgatcctgtctgctgatattgaacatgaggtgacggaggctggtattgatagttcaaattacctccttgataattctggaaattcggctgaatattacgcaccaaatgttcaagaataatttggggtacaactgattgatcggcctgtacacctggccgattgttaggtgttctcaacctagccgatgcgtgttgcacgttttgctgttgaattggctgaatcgtctgttgtctttgcggtgtctgctaggtcagcaatggctgtgctgagtcggctgtcatcggttttgttagaaacattgtagcaacctgttcctgagtcagccgattgtcatttttcccagcatgttgtggttgttttctggtcaataacctaggattaaccacctgtcttggtgccgatgatgacgcagctggtgcagtagttgaaactggtgccatcggctgaaccggcagtgtagcattctgctggtttgctgtcaccaaaggcctgtagtttggaaaaacaccacctggtagatatactggccctgaggtttggtgctcggctattgaaccatcgacaacagtctacactatgtttgttaaggtattaaccaacactccagattggttgatcagagcatgctgcacagcgtagtcgatccgatcttgaaagttattgaactgtaatggctcctggttgtcatctgcgccaaggtcttcgactgtaccatcttgagggacatcacctttatcgcctgagccagctgcagcacccttgtcaccttgagatgaacttgagccaacttcatcggctgcaactaccttcagcttgtacttctagacgatggtttctatgcgggtttcttgaaaagaattcatgaactgatccttcacgttgctcatcatctgttcaagttcgcccctttgttcagccgtcagtctatctagtgtgattggaacaatgttggaggggtccacttcagctgatggatttttggctctcgttttatttatgggaggtttgactcctgtccccggagacggtggtaatttttcggccatcgtgaagaagtcgttgaaaactcgtgtcccactgggcgtgccaaaagcgtgttgattcgaaaaacacgaggcctaggagatctgcttaactccagtgcaggtccaaaatcttgccttttaggttcatgagcgtgccagctgatttgatcctgcaatcaacaagaaataaagacaaaaagattgtagtttaatccacaaatgatagccgatcggctagttgccgatgacatatcatttacctttgagccgatgtcatatgtgaatcgatcggcaattgtgaataagtaaattaaaactaaatctactcgatcagctgtagatgttaatagtagataatctttatgtcgatatatacttaaatcaagtgattgggatagatcggtcgccatgccgagacagtataaatcacttagatcgaaatatatattaacaagaagattatagatgtttacagcatagccgatcagatagatctagcttgtatcggctaatactttgatactgctctacatcaagatattaaggcaagtaaaatatatcaaacagaaagcttaatacatctaaatgcaataggatcttaacataaagggcagatttagcataacaattaagcatataaatcataaggctaaatcaggtaagatcggctgaaaccccgatactacctgttgtcgaaatgacaactgcatacgtcgaaggacgtgttactcaacagtggttggaaagcagtaaaaatgtattaaattgagagtttttcttcgaaaaatcctccctttacgtggccctaggggtctatttataaccctattacaggccccctatttgggtttaggttttacaggggaatttacatggttgcccttatgaaagggacatttacttgggcatacagtgtaattgaggtgcatgggcctctaatgggccaaattggcgatcgctggcccaatggccaacgggccgaagcggctgggatgtccccttgggccttcccggagctggcctcgatatggcgaagtcatcctccttcggcgtatacccttcgcccttcgaccttcgcctaggatgcacggtattcgccatgaggcttcatcctttgccgtcttcgccgcatagtcttcgccatggagcttcgccctgataagcttgacgccttgagcctgaaccctagctggttgcatggtttcgacaggtctggtcgaagggtctcgtgacatactgccaacaagcccctcacgggcaagggtgagataggagcttcggccgagaccgtgcaaaccatgtggtatggtatgaggcgccctctttcgaccgatgctcctgccgaaactaacattggaatcctgcaaagaacgcgtgcagtgcatgtatctgtatttctgttgttagtaatgttttgcagctttcgccttctgtgaacggcggagctgttcttattctttcactgggccgaaatgagcagtgatgggcttttcttcgtgggctcgtcactgtgcggctcggtcaatgggaatttaccgtttcgcctacccttatgatacgtggcgggttgtgattgggtgggaaggcgaactgtcgcctaggtgggctatatatccccctcttcccctttttcaccaccgcacccccatcattttcaccgcgagcgctccctcctccgtccttttcttccgcggcgccctttgagttgctagatctttcgctgttctccctcttcgccacagcgcacgcttttcgccatggctcctcgtaagccaaacccagcctcagcgacgggccctgatcccggccggatcaatgatgacaccaccacctttttaggggcttcgctcgtggatgacaacgagctggcgaagttggtcagctccggcgtggtggtggaggggcaggccttcaccccggggaaggccgtggtgccgaagcccagtgacaattggacggtggtattcgccgtcttctttgaggcgggtcttcgatttccatgcaacgtgttgttgccggagatccttcgcctcttccaggtggagctcccccagctgagtccgtcagcgctcgtccggatcgccatcttcgactgggcatgctggaccgccgggttcgaaccgagcgccgagctcttcggtgccgtattctttgccaccatgaactcgaagacggtggtcactccggctaggacgaagaagatggcgttcgggagtgtgaacttcaatgttcgccccgaacgctccgatctctggccggtgaaccccgccatgtcgaagtgggatcgccattggatggtgaagtggttctaccactccatccccttcgaggctgggtccgaagtggcgaaagccctacgatgtcggtgcagggtgattgcaccgaacaggaagcccaagttcgctgttgacggcgccatggaagcccagttcgccctgctgcgcaagatctgttcccgccttagttgtcgcgacttggtagaggagttctgcatgcttcgcattaccccctctcccagtcgtggcaagttgcagtcgatcaagacgaggaggtcgacggcttgccgaagctggttctgcctgcaggggcgaatagtgagtccatgcttttcttatgtgcatctgtgcttcgccctttttccccggttcgacgcttgatatggttacaccttttgttttcgtagtgttgactcttgatcaggcgacgtgtcggtcactgagttcagccagctgctcacacggcaggcggccggtcgggtgaaccgggtttatgacggtgaactgcctcctcggacgaaccccctcaaggccgatgacgccgcgggtccttcgcgaaagcggatgcgtgggcaagtgaagtcggcccctcgaaagcgaagggcccctgcctccactgactccgacgctgatgacgaagacaccgttgaagacaacgacgacggagaggagggggaggatgtgggggagacggaggttgcggccgaaaaggccgcggaagaggctgtcgacaaccgcgccgggacgcccggctacactccaacttcaagccccgagcacgtcaagaccggggtggagtcgaactgctccccccttcgccgaaaggatgtggagggggcgaaggcactggtcgctatcgcgtcagccaaggtggcaaaggggggtccggtcaagaagacctccaagaagatagggctcgtcaaggtcggtcgcgcttttagcgatgactagtcctccgacgaaacccctacttcgcctactagccgaagcttagggctttcaaccgttcctagcgccacgatcgatgcgggcggagcgggagggagtgttgccgggacctcggcttcgtccgatcaggttgtcaagaccgcgactagggtttttcagtagcccagttcgccagccggtcgtttcgccgctcggccttgggaaggggaggaagacggcggtcgaaacatccgtttcggattactcccttgcggcgccccatttcgcccctgccaatttcgagactcgggcggagcttatcccttttgttgagggggtgagcaacctcgtcttcccggctggtagctcgagcctgttcatggagctaaacgagttcgatgagggctgctctgccattaagagcttggcggttcgggtacgtagcttgactgtgttgtgttttttttaatcgtcgtttttcgacagcttgtcttaacattcgtcctatctctcttatcttcgaaccagatcctcgcggcccactgttcgaccgaatgaaccatgcgggctcgtcttgacagtttgaagaatcgtcttcgagccaaggacgacgaacttggctacaagagcttggaaatggaaggcctcgcccacacccttaaagagacaaaggccgagaacaagcggctccaggctgaactggaaaaagggagtgaggcgaaggcggagattgagcgcctcaaggccgagctcaaaaaagagcaaactcattccgccgctctgaccgactactacaacctcaccgagccgaagatggaggctcttcggcaagaggttagccaagcggaggcaaacgccgagaaggaggcggaacggttcgcgcgggagatggcgaaggccaccgagtctgcgaagaccgcgtgccaaacgctctgccttgccctttccgacatgggggcgagggtgcgtggagtccctggcgaatatgcttccgcctttgacttctcggagtggactcagcaggccggcggtgcggtctcggactgcgccagtgcatacggtgattgctgtgcacgcgtgtcggcggccttcactatgggccttctgcagcagttcggctgcgagaacgttgccgagttccctaactttgcgaagggggactgggaagttagtgcgcaggacgtttcgtgcctggcggaaacagttctggcagagggatggccgatccactgccaaggcgcgtctccttgagcaactagcgaaggtagaggcggcggaccagggcgaaggggaagatgctacggccggagagggtagaggcgatgccgaagatcacccagaggtgtaaggccccctgccctctctttagattttgtagttttcttttggcgtttgccgtggagggcgaacgatgtaaatttggccgatggccttctccccttcttattgtagccggaaacagcctttttgatatatgatgaatggatgactccagtttagtcaactattgcgttatcttcgccttattttcgcgtgcgaaagggagtctactcttttcgcccatttgttcgtgtcttaaccttgcgcttttccatttacctttctagtgctgattttagcagggtattcgctatcatgcctagaaattcacaaaccagaatttctaagctgaatgtgcattaaacccctgtccaggaccagccagggtacacaaatgacaattgttgtcatacagacccacgtcttacaaaaatataaaagattacaaatgcagcggaaaaaggtaaaagcgaactaagcctgaagacttgactcctgcagcgggcgactctattccacaggcaatccttgacggcagcaacaaaaccaacctcaatgagacagctcccactaggaagatcttcaactctagtgtggggaaaagagagcaagattgagtactacccactgtactcagcaagtcataccggaagaggaggtatgatgcaagatataa

SEQ ID NO: 28568 - DNA, 2101 bp, Oryza sativa
catggctatacgaatagttaaactctgatcagaggtgtacaaccgtacccacaagacacaggcccacgacacgtttctgtgcaccgacataccaacacgacataccggaaagaggccgtgacaggacccttcacataaccccctctaaccaatcgcaccacacctcaggtttcacccccactcctcgcaagggagcggacagtcccctctcatgccacggtgaatccggaagccgatgaaccagacaccccggccgacccaactccatcacgcccacccttgcctgggtactttggctagaggaaagctacactacaaacccagccgttgcccacgctggcttgtggtaagtacgataagttcttcgactagcaaaaccatgcacccacaacccaccatgtagtgtattttaattagctaacaccattgcggtggcactattccaaagctatgccaataatcaaagtctatgtattaatgtgattccccctttgtgtacaagttgaactaagcatggctaagtattccctaaaccaacatctaatcattttaatacccaagttatcaatggcgtaagggaaacaatatatagccgagtaataggacccatcccacatgatattgtaaaacaatgcaacatttaatagaaatgcgggacatttgtaagttgggtacaatatgataaattgtaaagcatgacttgccttgctctcgcactgatgagaccacagtaacgtcttcgagaaaccgcggatcgacgaaacggccgaaatctacgcgacaaacaaagcacacaagcaaaacatgctataagtctactgaaacaggaaacaaaactatttttaatggattctaagcatttttatgaatttactgagacttgaatggacttaaacggagctcggatgaattagttatgaattttagaagattcactgtgtttttactataaaaagaaaatccttaattgaattattgcgcattaaaggccctggtgacatcatcaaacgaggaggatggcgccaacagatgggccccacttgtcatcggctcaaggacatcggtccacggtggaccaagtctacgggacaggagaggaggggcgcaccacgtggccggccacgcgggccacgggatggacggccacgatctgctgggaggcagatcgggcggctggggatgggcggggccaaagccggcccggcatggcgcacggcggcggtggctggctaccggcgaccggccggtggcagcggctggcgacgtgggcggcggcgcatcgcggcgacgcgcatgcggggagcggcggcgcgcgcgagaggaaggaaaggggagagagttctcaccgaggggttcggccggccggggaaaggcgacggcgaacggcggcgacgagcgaccgggagatggcgacgagtggcgaacgaactccggatgggcctaaggagcacaatgagggggattagagagagagagagaaggcctgctgtgagcggaaaccatggccgaaggcggcggcaatggtggtactcaccggcacgaggtggacggcgatctccggcgacagattgcgacggacgaggggtggacgaggtggccctcaggcttgcgaacctgacggcggcgacggcttggttcggtggcggccctagcagcggctagaggcggccggagcagtagaagaggcggcggcgggtgggtgcgcggtgcgagggcgatagggagctcgagagcgggcggcgaaagagggaaaaaggtggagagaggtgtggtggtcgattatatagaggtggggaggccggacgtggccgggagcggcggttccgcggcgacgacgtggagaggtggaggaggagagagaggcgggattcaaaaattgaatcccggccatctcgcgggcgctggcgtgtgcgggagtggggcgtgggtgcgggaaaagcgggggcgcgcaggggagtgggtgacatggcccgggacggcgggagggcgtggcggcggttgaggagggaggccgcccctccggctggagggtaggggcgaacccgacaggtgggccccacctatcggcgctcgggaggggagggggagctggatggacttc

SEQ ID NO: 28569 - DNA, 11449 bp, Oryza sativa
ggaaggaaaaagggaaaaaggaaaggaaaaggatttccagggaattctttaatgattgtgctgaattttaattggttaaaattatttcttgggctctgaaaattccactaaaaatcatgttagcatattttgatatgtagaacccaagaaaaattccacatgccattccgattattatttgcatttattaatttagggaataagctcaaggttaaataaacaatttcttcggtcgatttaattagacaaaatttttaaagcaagaaaggggaacttcagggcgtgacattcgccggaaattgtgtgttcggcctccctttgggaatcggcgaagtaagaacgagaagttcgtggcggtgaagggtttgccgaaggtgcgatgtccgtttcggccagtttaccgcgagatgataataaacggcaaaagctacaaggttttgaaggttgtcggctggatgcgggcgcaccccgggcgaaccctggaggactacgatcgtgtccatatagaacgccgggaggacatggctcgcttttggcgaaaccatcagaggaccgatcgtcaggaagcgatcgcccagcgtcgttatagtctagtttgtgttccacccccctccctccttaggatagtgtatgacattagtagtgatgacgaaccatgttcgtcgaatcgttccttagggagtggggattgctttgggggcggagacgtaatttatttgtaagctaggctgtaaagccggtgctatttgtacttgtatcatgttgtgtgactgcatcctccgattattttttgaaattaataaagatgtgttttatttccttttcgctgtttttcgcattgtcacctttcgtgcttttgttaggtcgaaccgtgtcaaccccattgcgtatactagcgaaataggtatgctgaattttcagctttcgtcttccgtttttggtctgtggtattccaagctgaaggaagcgcttatgttttcacatggatcgagtgtaatggcgttcggttagttatttcccgaaacaagctgtcgtggtttcaacgctcggcgagcgttgcttcggccgattcgtttcgtccccctggcgttttcgctgatcaggcgtttgccttggggtttttccacgaattatcattcagacaagtgcgaaagacacaaggattttttactggttcgggccgccaaggtggataatagccctacatccagttttttttccttttttcattttcctctttttttttgtatttttgtgctgaaaggcttacataatgagagatgccgaaaggcctatacaaaaatatgtacatttttacaagttggcgatttgggtgccacccattctagacatagaaacgcttaagggaagtggcgttccaggaatggtcgaactcttcgccttccagcgttgctaggcgaaaggagcctgtcctggacccgtgtttgatgaggtatggcccttcccacttcgattcaagcttcccggccgccaccgggttcgtcttcttccttaggacgagatggccaagcaatagctctatcagtcgaacctttttgttgtaagttgccgaagtgcttgtggcatatttgcgcatgtgttacagtgcttcgactctcacccactctaggagttcgagcgacacctcgcgcccatcttcgcctccagagaacatcacccttggtgaattagcccctagctcagttggggtcattgcttcatcaccatagagaaggatgaacgggctgaacttggttggccttgtgggggtcgttcgaatggcccagagaacagatagcatttcgtctggccatttacccttcgctaccccctcaagccttttctttagcgcctcaaggatcttaccatttgttcgttcggccgccctatttgactgtgggtgcgcgaccgaagtgaacctgatttccaggtttaacccttcacacatctctctgaacttgtcagaatcgaattgcttgccgttgtcggtgatgaattcttttggcactccgaaacggcaaacaatgttttttccatacaaacttctgtactgctgccgaagtgatcgcgccaagtggttcggcctcgatccaacgggagaagtattcaacggctgcaattgcaaacttgtacctatttcgtgccataggaaaagggccaataatgtctagcccccacctggcgaaaggccagactggtgcgataggttgcagctcgtattggggtgcagtttggcttcggccatgccgctgacaactttcgcacctcttggtttgctcgacacaaactttcagcatggttggccaatacaccccctggtgaaacactttagaggcaaccgtccttgcggcctggtgtgcaccacacagctcctggtgtatttctatcaccatttcttctccttcggcaaagaagatgcagcgaagcaagggttggagcaccccggagcgatacaactgccctgagaccagcttgtattttgtggctctgagctgtaagcgcttcgcttctgcttcatcttctgggagccagtcattcttgaggtacttgacgaatggagttcgccaatcttctgggtcttcgcccagctctgcctagtcgattgccatgatgtccaggctttctgtgggcacacttggtgcatacaagacttcaaaaaagatgcctgatgaatgcgggcctccacaggtagcagattttgcaagggtatctgcttcctcattctggcctctaggtaagtgttcgaccgttatgccggcgaagcacttttccatagatcgaactgcctccagatatctcttcattccttcttcttttgcctcaaaggacttgtcaacatgacttgccaccagcttggagtccgttcgaatgagcaagtgccgaacccccaatgcttttgcctttcttaggcctaatagtacagcttcgtattctgccatgttgttggtcgtgtcgaactacagccttgcggcataccgaatcggcacacctcctggcgaagtgagtactgtcgcggcgcctgcccccttgtgcgaccacgagccgtcggagtacattacccatggctgttcgacgggctcgggttcaggggcgaatgctggtgtccattcggccacgaagtcagctaggacttgggacttgatggcggtgcaggcgacaaaacgcaggtcgaagggggataattctgccgcccacttgcagagtcggccagtgatttctttgccccgtagcacttcgcctaaaggatactgcgatggcacagtgactttgtgggcctgaaagtagtgcttaagctttcacaaagccatcactagggcgtaggcaatcttctccatttcaatgtatcttgtcttcgccccttgtaacgctttggagatgaaatacactggtttctggcctgactccgtctcttgaacgagagctgcactgatcgccaccggcgaagctgctagataaagtcgtagttcgcttctcggcgctggactaactagggtaggtgggctttgcagattctactttagctcgttgaacgctacttggcattcgggtgtccagctaaattttcccgtgccccggagggtcttgaagaagggaaaacctttttcggctgccttcgagagaaatcgactgactgccgcaattcggcctgcgagcttttgtacttcgcgtacgctcgacgaaggcttcatttgctgaattgcgtcgattttctcgggattcgcctcgatacccctttcagaaacaagaaagcccaacagcttgcctgcacgaacaccaaaaacacacttctcagggtttagtttcataccagccgcacgcaagttgtcgaaggtctcctgtaagtcagacgcatggtcgaaagccttgcggctttttacgatgatatcatcgacataggcctccacatttcgccccaactgtttgtaaaggaccttatacaccagcctggggaatgttgctccaacattcctcaggccgaaaggcattctgaggtggcaaaacgtgccgaacggcgtgatgaaggctgtcttggggatgtcagccggattcatgtggatatggtgatagctggagtacgcatccaaaaagctcatgagttcgcagccagctgacgagtcgacaagttggtcgatccgcggcagggggaagtcatctttcgggcacaccttgttgaggtctgtgaagtcgacgcacatgcgccacttgccgttcgacttcttcaccaaaaccgggttcgccaaccactctgggtggtcgatctcttcgatcaccccagccttgagcagcttctgcacttcggcctttgctgcctcttggcgatcggcggacattttgcgcagcttctatttccttggcttggcatccggtttgaccgctagatgatgcatgatgaggtctgtcgaaacacctcccacttcgtcggggctccatgcgaagatgtcagtgttcttcttgagcacctccaggatattcttggcttcctcttcgcctagatcgccctctagcaggacaaacttcgtgggatcggcgtcatcgacttgcatcttgatcaccttgccatgaggggcgggcttcggcatgcgtttagcatggtcatgtggttcggcctcgatattgtgcactgccctgttgattgcggccaaatcgccctttgatgcggtcaaaggttgaagcctcttgatgacgatcacgcctgttgggcccggcatcttgagcttgaggtagttgtggtgggagatggcttcgaacttgttcaaggttgcacggccgaagatggcgttgtagttgtatgggatgtcgatgacatcgaacagtatttgctcttcgcgcctgttttcacttgtgccgaaagctaccaccagttgtacttggcccaaaacttgaactgcttcgccaccaaaaccacgaagtgaggctggtgcttgggtgagggctagggttggcaaccccatcttgacgtatgcttcggcaaagatgacatcggccgagcttcccccgtcaaccaggattcgccggacttcgaagccaactacctcggccgagatcaccaaggggtcttgatgtgggaatagcaccccttcagcgtcttctggcccgaaagagatttgctggttcaagtacctcggagccccttcgcctgccgcggtgatgttgtgcaccgttcgcagctgcatcttcttctaccgcttcgactgttggactggcggatcgtcccttgtaatcatttgaattactctgcgctggacatcctggcgctgttcggatgggggagcttgttcttgagcggcttcgcgaggtgcttcgacagcagccccttgctgcggccttgggtcttgagcgttgccacgccgccgaatgtttcggcattgctcggtagtgtgcgaggatcacccgtggaatgcgcaatagacgttcttcctgaccttcttgcgaataggctactgatggctgcctgcttgctgagcatcgaactctttgcggagggcttggacctctttgacagccatcacagccttgcccgtgcggtcatttctgaattttctccacgtcatgggagcttgacttggccttggcggctgtccctgattcgccagctgaggttggcgaacggtgagaggagtcggttcggcgacctgtgcttgtacttgggcttgggcagtggcgatggaggctttatcgtactcggcttggattgcttgccatcgcttggaatcctcttcgcctcttgcgtacccgtcgatgatgcgaagcaggtgctcgagtgtctgcggctccttgttggcgattttccttgtgagttcgccttcgagcagcccggccgaagcggcgttgatgatagacgcttcggttatatcttgaacttggcatcgggcttgcgagaaacgacgcatgtattctcgtattgattcccccgggctctggcgaatgccgagtagatgctgctgcgtcttcggctcctcataggtgcctcgaaagttaaggacaaagacgtcgcgcaattgctcccatgagtaaatgctattagctggtaaattgaaataccaagaacgggcgatgccatctaaagcgagatggattacctttgccttggtgttttcgtcgctgtgagcgacttcaatcgcggactcgtagatggacagaaactattttggttccgtttcgcccgagtaccgcgggacaggtgggaacttgaactgggttggtattggatggatcttgattcccccactcagcggcagccccttttcgccccccgatttgccatgacaccttgctgcgaaggcctgtttgtctgtggatatggcgtggcgaagggcgaagtcatggcttgcgtgtgtggttgcaccacagtgttcggctgtccggccccaaacagcgatgcctggggtgccgccatggatggatcgaacgaaggctgggtccaagccatagcggcctggttcggcgcctgatttgtttcgaagcctagtgtcagtgcctgtggttgaatggttggtgcttgagcagcgttgctggagtcgaactgcggtcttgactccaaggcgaagcccccggaccaggctggttcgacgtctgccaactgggtgcaccttgacttgtgttcccctccggtcgggccgaagggcttgtacttgagatgttgtggggttagttgagttgctgaaggaaagcttgaagctgtgcctgcaaagccgaggcccctttcgccattgcttgtgacatttggcctaggtgtacttgggcaacgaccggccgaacctgcggttgtacatgaggggtcgggtgtacattgcggccgaaggctgcccaacgaagtacactggcgcttgtatggcttgtggtggaaaggcctgagttgatgcttacgggtagacttagggtggaatgtagcctgctgaatactggaggattggggccgaagcgaccttagcttgccgtgctacctcctacgcctgctgctattcttgcatctggcgaagcatgtcttggagtcgggtcatgttttggcgcatggcctccatgtcggcttcggcttgtgtttcgaggttggggttgacttgcgtagcggcgagcgcagtcgaagccgttgccgactgtgacgaagcagcttggggcaccagcagctggcttgtcgaaaggatctccgccctggtctggagcgcccttgctgccacagctgccttcgccgtgtcgaccgtgttcggcaccagccccgacgaagcggcaggagccgaaggtggcggttgcggtgcaggtgccgaagccgacggtgcccccccggcttcgatgatgggcgccgaaggatcggctccctcttcggcggccatctcctctcctgcttcgctcccctttcgcttcgcaaccttctccttcacgaccctcttgggtggcattcgccctcagtggtttcgctcggaggtccccacggtcggtgcaagctgttgtcgaaatgataactgcatacatcgaaggacgtggttactcaacagtggttggaaagcagtaaaaatgtattaaattgagagtttttcttcgaaaaatccccctttacatggccctagggatctatttataaccctattacaggcccccccccctatttgggtttaggttttacaggggaatttacatggttccccttataaaagggacatttacatgggcatacagtgcaattgaggtgcatgggcctctaatgggccaaattggcgatcgctggcccaatggccaacgggccgaagcggctgggatggccccttgggccttcccggagctggcctcgatatggcgaagtcatcctccttcggcgttcgcccttcgaccttcgcccaggatgcacggtcttcgccatgaggcttcatcctttgtcgtcttcgctgcatagtcttcgccatggagcttcgccctgataagcttgacgccttgagcctgaaccctagttggttgcatggtttcggcaagtctggtcgaagagtctcgtgacataccgccaagactaccctaatcgacaaccaagaagcaggctaaagattatagttctaagcacgacttatgagatcaaacttaactgatgcagccataagtatgaaaagaaagacaatatctagacaatcaagccattggcagcttcatagagtggtagatatcctatataatctaagttaacgttggtacttaacctaatcggctgccttctagcgatagatgttagccgactggagattagataacaatattaccagagattatatagaatatataataactcgacaacttacataaacaagattagagtatcataaagatggaagcactaatcccgagaacgcaagccgccataacaagttttacctctagttgaagatcaaaaccgatgcagctcaacccgaaagcaagaactcgtcgaaacaaaacgaaagtaaagggtggcgatgcgccgagattgtatttgagcgtgtgttgtttattacatggggctcggggtctatttatacctgagattacaaaatatgtccttgtcggacacgactcctatctctaacaaactctaagataccataagtctttgcgacagacttttgcccaaacttatctctaagtaaattacataaaatatcgtaattaatagatacaattgccttcttaggactcaatccgtgtgtggcaatccatatgaagcacttcaacctaacccgatgacgtataccgagtcgtattgtcggaatcggctcaatcggctaaccttatccgactcgaactctgccgatcacggtcgcagccgattcggacttagccgtttcacgctctgtttccggaacgatcttcgtcctcgattccgcttcgatttgatcttcatctccgatgcttagattaccaaatttggtcattaacatttatatatccgattcaaatttgaatttgaattcaaatattttttatatatagtatttctatacatctaaagtttatatacctaaagtttgtagacccaaagtttataagtcaaaagtttacatacccgtttcaaatttgaatttgaattaaaatgttagtttatagacccaaagtttataagtcaaaagtttacatacccgtttaaatttgaatttgaattcaaatatcagtttatagacccaaagtttataagtcaaaagtttacatacccgtttaaatttgaatttgaattcaaatattagtttatagacccaaagtttataagtcaaaagtttacatacccatttcaaatttgaatttgaattcaatttttttatatatatagtatttgtatttctatacatattttttccaactttgtttttttattttttaaaattgtattgtgtactgtagtataggggagggatgggagcgtatagggggagggatgggccggtgatcgctaagagcgatcacccgcccattagccgtccccgttttggattgctaccaaaacttagccctaccaatattttggtagtttaaataggacatgtgcttggtttggattgaaaccaatttattggtgatgcccatgctagattcggcatcaatctacactagaattcatatgttggctttattttggtagcaaaccaaatacatctttgccctacccaaaaaattgatattgccaacattagcctaagtttcagcactaccaaaaacttggcatggtagcactccaaatagacctgctaatgtctgcaacgactcctgccgtcccctgatacaagtaattttgggtggatctgacgcttccggacatgtctccctcccacccaaaatcccttatattatgggacggagggagtataaaatataagcccatgtacaatcctaatgttgaagttgctgaatcatacaagaatcgatgagcctttgatgttataaaatttgattattaaaaatattgttggtcaaaactagcaccttaaagtaaagaaaaaagtattttatgaaggtcaggaatatttttttatggtatattatatttacatgtgttttatgatagtttaaaatatcaatttttaatatcttttttaaaaaaataattttaattcattttttttttgtcctcgaataattatcactatctcagtttcatttatcatccatcagctagacatgtgttcatagttttctttttctttttcatgatagaaataaatccggcctcttctttgagacatataatgcgtgaccttaattattacaatcacagcatacagttattttcatgccccccaacattgaaaacaataaatattatcatatatataatttttattcgatgttcttcaagaggtgtacatataaattaaattttcaatgtatagctaatcgtgttgctctcatgtcctattcccaattcaatgcatgactggaacttgtgcggaatgtggataaaattcacaattcaatgcacgaccaaaaccaaacatattgttagcaggtaaaataaaagatagcaaacaaaatatattgaggtgcaatccttttgcgcacttgcgaaagaaagatagcaaacaaatcagaatactgaaaaaaatccttattgtcggagggtgaactcctcaagcgggggatggagaggccccccctttgttagttcggttgggggcagcaggtgaaattcgagaactcggtggaaagcgtgatgtagagggggtcgggcccctcaagaacagtaagacaaaatgggtttatataggttcgggtcactaggaagcgtaataccctactcctgtgtttggttgagcgattaagaattgcaggtgcttgagtcatcgagaaacaagcgtgagcttgccaaaggatcgatccctccttctctcactaggcttggacttccttttatatctcaaggggctgccacatggacctagagctctctctaggggacagggaggataatcgcattaaaaacatgtcttgttccttgactcggaagccacccacgagcgccttgatcgtggggcctatcaaatcgtgccacctgacacgagggacgctcgtgtcattcgtcatttaatgggtgaagacttctgtgtccccattcgcgcaacggagatcttgttctaaccgtagcgggcgaatcgactccagctatgatgatgaggggacagggcgggccgcacgccgcctatcacacgcgctagtgcacctgacacccctggtcccatcggtcattcaaccggtcactggcccgtcatacaccggtcaggcgcgctccacgcagcattaaatgcggcgtggcgtgcctgctcaagccgccataaatgcgggtaggtgggcgttttggagacagccacccagcccatcgtacgtggcgacccacggagggggtcgggggagttacaaagggggcatccgccgccctacctcgggtccgacccccgtcgggggagggccacgtggcattggggggcagcctcctcccttttgtctt

SEQ ID NO: 28570 - DNA, 18359 bp, Oryza sativa
  unsure (1)..(18359): unsure at all n locations
aatgtgtgtgtgtgtatatatatatgtatatatatatatatatatatacatatatgtatatatatatatatatatatatatatatatgagttggattttttaccacgcgagttcacatgtacccacgatctacaccctatatgtagcttgcacgaatcttagggcaagtgtgtgtctatatatatatatatatatatatatatatatgtatgtatgtatatgaaaaatccagatttgcactcgggttcacatgtacctacaatctacatcgttgatgtgttccaagattcgtactgcaaaatgtacctaatcttaaccaaatgaatgcttactatagggagaaaagattagcattaggttggttcacaatatgtataacatgtgtgttgcattttttaccaaatatttttttcaataataatcatatatgacatttatatatctagtgcattgtatttctctaacccttattttgtttataacatgatatttagtcaaaatgagaaaaacaatatctactatatcaccaaattatcatctcgcaaaaatgatacttccaaaatggtatatatcctaccataaaaactatataaacaaggtaatttatataaaaaaggtaaactacataaacaagttttgcatacaagaaatataaaaattacataaacaaggtattttacacttgtaaaaaatatagtataacgtaaacataatgcatgttacattttgttagcaccatatatatatacatatatacatatatgtatatataatatacatatatgtatatatgtatatatacatatatatatatgtatgtatatatacatatatatgtatgtatgtatatatatacatatatatgtatatatgtatatatatacatatatatgtatatatacatgtatatacatatacatgtatatatacatgtatatatacatgtatatatacatatatacatgtatatatacatatatacgtatatatacacatacatatatacgtatatatacacatacatatatacatatatatacacatacatatatacatatatacatatatatatatatatacatatatatatatatatatatatatatatatatatatatatatatatatatatatatatatatatatatatatatataacacaacacttaaacgcttatactgaacataaccaaataattaaattccaaattgaattgatttggtgtgggggctgaaaaaagcagctaggggggacaacagtatcatacatatatacagaccagtccttgcgtgaggtgagaacaggaagaacagattgtactgtgaaatatatttcgatacttatacatcttgagaatgactcgccaacctaaagtgggtgaaaataattgacaatctacctgaactaatatttggtgaatgtatccccatcgtatgggtgtgatctatgaaacataaggtttaagacaagagagaatctattctataccacttagtgtgttcgagttcaatgatttactatagacattgtctctttttataatatatcaacgacttttattaattgttctacagtacaccattggctgaaacttctattcaaaaatacccaaaatacccttagagacatacaagattaacaattgatttatctcatcagaagttttaaaaaaatatgaaaatttttatgtggcctctttacacaatttggaagtttgtatacaagtttcaagctttttcaagtatatttagtttttagaaaaaaaacatttttaagtggtatatgagggagaatttgcttatacaagaggtaatagcataaaaatatcttatatagtgaatgaaagatgatttatattgaaaacaacaataaaaaagtattttatatagcatataacaaacaagttatattttgttaaaaaaataaaaatttagtaaaaaacttgaaacttctatataaatttccacgttgtgtaagaaagccacataaaaattttcatatttttttaaacttataatgagataaatcaattgttaaccttgtatgtccataagggtattttgagtatttttgaaaagaagacccaacataatggcgtattgtagaataattgataaagtcaccggtatattatagaaagcaacaatgtcgatggtaaattattgaactcgaagaaactcaatggtataaaatagattctttaagagacaatccatacacttatatagtcagttaaacattatttatggcagtgttatggtaaccaaacgtacgaagagtaatatctttactattataaaaaataaatatgtttttgtcagtactttgttacgtcatccgtatataagtcgattttgaagttcgttcgtttttggaaatatatatctgtatttgagtttgttcgcttttgaaaataaagagggagtcatataaggaatattttaaaaaaacctgcatgctaacttggaatgatcggactcctaattatagctcatgatttttttacaaaaatatatatatccaagcgaattctcacaataaaactattataaaaactgaggatgtttttactgctactttggtacgtcatccatatatgagtcggtttttaaattcgttcgcttttgaaaatacagatctgtattttggtcgggttctaaattcgttcacttttgaaaatacaggagcaattgtataagaaatctctttaaaaaaaacttacatgctgatgattagactcctaattgtagctcatgattttctagaaaaaaaatatatctaagcaaattctcacagtgaatctcaccttcactaaaccatataacaatagtcttcccccgttgcaatatatgagtattttttctagtaatatagaatattacgattattgcaccaggctcttaagatgaatcgggaagaaaccttttctgctgcagtggaatccttaatcatgtccagaggtaaatcaattcacagttgcatttataatttattttagaattgttcatgctcattcaaagtgcaaatgaaatattggcataaatagagctcctgtcattgtgtactcactttattttccaatcaatatgtgaagtagctttttctacgggtatcatgattttgctacaaaatcaaccatgttggcatatttactaagcataattttgatgaacacctacctgtgaaaaggaacatcatagtgtattatctatactaatactaatataaaaagggatagctgttaccagtgaattttagtaagccccgaagttatcatcggtctagagtcgctttagagtctatggaatcggtcgatgggaattatcaagtcaccaatagttagattcttgatatatttactaaaggaagtttatcaagaagagaccgagttcaaaaaggatacggcataacagtttatctattaattaggaataatctgttagtttccttttatctttaagaatgtttctttcttgcctaacaagaactagtatctatccatggatataaatatgtacacccggggtcattgtaaactatctcatagatcaatacaactactctcggcgtatcaccaccctcttttccgaggtttttacttatcatcggcggaacttggcacctgacgtggggctgcatcggctttcaatctccggcgaaggggtaagtcatacattctgtcggtcctaacaatcgtatcagttacgttgttgttgtttaaggttgcatcgttctcgacctcttggatctctctagtttggttggtatgtttctctacctactcccttcgtcccattttaagtgtaaccatgagttttcacgacccattttaatcattcatcttatttgaaaactttttataattagtatttttgttgttatgagatgataaacataaatagtacttttctcgtgacttatggtttgaaatttttttaaaaaaaattcaaataaaacggacgattaaagttggacgcggaaaatcatggttgcacttaaaataggacggagggagtacttatcatatatcttagttaatctagtcttagaatctcaatttagttatatcggccatttttcgctttggggtttatgctggtattggctaaatcgttttactagattagattagctaaggtattcaccaccctcaaaggcttgattgtttaaactttatgcttctttgcatactttgtgatgtatcatccctagtcgtgtttcggcacggccacggccacccgtgggttcctgtgagttcaccgtaggaatgctagtagggaaaaaatgaaatggagggagcagcatatagggcctatatagctggccaaaaattttgtcctacatatcacatcagatatacagacacatatttgaagtattaaatgtagtctaataacaaaaacaaattacagatttcaatagaaaactgcgagttgaatttattaagcctaattaatccgtcattagcaaatgtttactgcagtataacattgttaaattatggcgcaattaggcttaaaaattcgtcaggtaattttctgaattacctggcgaactgtgtactttatttatttttttctatattaatactctatatatatatctatatatatgtctaaatatttgaggtgacagagtgaaaaatttcgtttgtgaactaaacaagacccatagatgaaacgccttgcgattttccgtaaaagattccgatgttttgggcttgcgtcagtttgggggctcaatattttcggtagctctctccgaaacagacaccgcccagcccaagccaaaccgactaggaaaacacgggatcggttttataagggaagcctatccgtatcgtcgtcgctagtcgcaaactcgcaatcccactcccacagcaggacaggccacaggtcctcccaaatcagagaaatcttgaatctcgctattcacgcggctaggcaagcgagtccggtctttcctcccgtcgccggcgagcggctgaggcggccatccctttctggataggatacgacggctcgcgatcccctcccgcaggcaccgagcgcagtcggtgcccggtgaggtgagttgtctgataccagtgaaaagttttttattattattattttcggtagctttctcattgataattttgggtaaatttcatcgctgcctcaacaagattcgattcaccccttcctcgaaagaaagaaagaaagaaacgttattcccctttgatagagttttagcaatccgtctgtaaattgtttgctctgcatcttttgctaacccaacggatataagaaatcatggtttgatttctattgaaaccaccgctgcctgataagtccgaacccgatttaataaaatgtctagtccgaaactaaataggatcgaagtcgagtttcccgattagtacagacaccgaatactccattattatattatgatgtgcaaagccataactgattatgcttaattattttctgcagtttgatattgttggcatgatggcgaaacgatgcacggacatcttgctagctccccggccacgaaagacgaagcggattgatatcaattcttgcagatcgaggttcttgctcccttacatcccggatgaggtgatgttcgacgttctgttacgactgccatccaagtctctcatgcggtttaagtccgtgtgcaaggcttggcacgccatgatatcaagcccaattttcatcaacgctcacctcgagtggtcaaagctaaagccatcatcactgctcatggctcctggcttttaccagaagcagaagaacggtcagaatattgcctttctgatgggcctctataagtaccagggtggtaataataatgtagtgcatctgcatgattttccacgtgattttccgcaggtattggatacatggactcgccctgtgcactgcgatggtttgctccttgtttccaacatgagcaaaaaaatgattatctacaacccatcaacaagagagattgtttccctgccaaaagggagccgtaaccttcataagggcacagggattggatttgggtttgaccctcgcagcagcaagtataaagtggcgagagttttttatcaaagggatgacaaaacatcaatgttggtctgtaagtttgaagtgcttaccctgggcactattaatgtatggaggcaaactgaagacccaccttatccaattggtaagtcgactccagttcatgtgaaaggcgctatctactggatggtttctcgaacatcactttgcccagatccacccaacacacttgttcgattctgtttgactgatgagaagtttagtctgtttccatgcccatgcaatgtaaagccttcctgtttgaccggattgggggatgaattgtactgtggctattttttcagtcaaccactccaactggagatttggggttgtagtgttgttgggcagaaacctgaatggactcgacgctgcgctttacagattccacctgatgttattaagcggcctgtagcaagtcctttggttgtctttcatggaaaaatgttgctgttggcgttgaaaaaggtctacaagtatgacatccaagcctgtaaattggagaaaatacctttagtggttgaagacttcatgtgctatgaccgcgaaaataatatgtaccagacatattcaaagaaggaagtaatggatttccatctatttaattatgttgagagtctagtttcgattagagaattttgagaaatcattcttctcgtgttgtgttgaggagtgatctaaggttacagtagatgcctttctttctgagtagtgtcaaccatagacaattcttaatgagttggatgtatgctttctttttcgaagctaagtggtttaacagtaacaatgtattgttcattctagtattatgaattttcctttactctcatagtcctgttcattttgctgctgacatttgtgacattcttctcttatttttgccaacgttttattaggtacttacaagttggaagacttacatctgtcatgcaaatactcttggccatgtttttcttcttgtcaattgaggtatatattaacatgttaacatatcctgtcagttgagatatatactgcaacgaaataactatctgcttctgctactactaaaactgcggaaggtgctgacaaagaaatgtgctaccgtcctcctactctttcagacgatgatttttcagaggatgagaaccctgcagaccagcagcctagaagagagactgaaccaagctcgctcctccaaattattgattcttggcacaatagtaaggatgtctctagcaaaaaaaactcgagacattgatgggcttgttgattgttcaaggagtgagacttgctgcttccatccccaaattgcagcagttagcctggtaactttctgaaagcacaagtgctcgttgtttttgatcaatcatacatgaaacaaaatggcactcctatggttatctgtctactcaaaatgtatgttcggctatatatactggcaggagtcgtctaacaaagtagcattcttttgtttttctcagttgaagagggcacgtttatgatgtcatatggttaacaaagtctagagttctagagttataatgaggaggaattctggaacctgaaagcttggtagtttttagccaagatgttattatcatttgctctggtgagggtacatatcaataaggtggatcagtctgattctttttttgaaactttcctcgcatttgatgccatctattgttctccttttatgtttgtctatcgttattcataaattgttgttttccacacttaaccacccccaatggaagctataaaattattcaagctccagaaggggtagtagttggactccaatctgtaggcaacatcaaaatttgcctggcacgtacgaatagtggattaatgttttatcactttatttctttcctttcttcttnnnnnnnnnnnnnnnnnnnnnntggtttatcactttgggtgttgaacataggagcaccaggaggggcagtagttagaatccaaactgctgctgtgctctaagattcctgcgactctcagagtagtttataatccatcttggatttgttgcattactacacgcacacgcatactggatcaatggtctattactgtttttcttttctttttttcctcaaagaatggtttatcagtttgggtgtttaacatttgatgagctagtaaacttgatttggttaatgaaatctgcagtatctatgtactgcaggagccacacagagtgtttatttggcttgctctgccaccaatcggatttggatagtctcacatttatttgaagctaagtaacaagatgtcgattgatgtattgaaacatttatgtcgatgaggatataaatccaaaacaataaatgctagattgaaaaaaaaaatgatctaataattatagagagcagatcatctgaattatgtagtgctacaatcatttgaaaaatctatgccaaacattaattgatgggaagacaaatccatatcaagaaatatcatactgaataaaaatccaatggatagagtatataaaataacacaagatcgccgatttggatgtcgacgtcatttctatctcaatccaatccgcaagatatcaaaacatcaatggacacaaatctaaatgccaggattaatgcaggattaatgcaggagagaacatatataaattcagaaacagattgattattcattaccttttttttagaacagattattcattactaggattgcttaacgtctatgcctgaatacaaacaccagcaaagaaccatatatataatgccaatgagcaagacgaaggagaaaaggtaaagagaaattcagaaatactcgattgatctgcaacttcttgccatggcacccatcaagatcaataagattatcgctgctactttcttcatggttcttgtgatcatgtcctgcgccctcacatccacacttgcttgccgtaagttgctagtctatccgttccaaaacataaccatctttctaatttaaactgcaaatgtagctaatttaaactaaaaagttaactatattttgaaagatggagcattcattactcttctgtgtttttaattgttttcacgattacataaaagacaaaacacaccaccaccacatacgcacatataatatcatttctttagcagcgagagataatccataaactctcatagaatactaactctctccgtttaatattataagtcgtttgacttttttctttgtcaaaattatttaggttcgatcaagtttatagagaaaattacaacatctacgacacaaaattagttttaataaatttaatattgaatatattttaataatgtgtttgttttgtattgaaaatatcagtatatttttctacaaacttgatcaaacttaaaaaaaaattgactaagaaaaaaatcaaatgatttataatataaacggagggaatattaattaatggattggtattgttatgtgcagggggtgggacggagtgcaccgttgaaacgccacactgcacaatggattcatgcaatgcaaaatgcaaggcagaggccagcagccgcaagtgcaacaggatgactgctagttgccacaaatatgctagacttgagaagtgctgctgcacttttcacgcaaagtaatatcgacagtgacatcaaaataataataataataataataataataataataataataataataataataataataataataataatagtatcgacggttgatgacaggattattgcatatggttagattaatctcatggaacctcttatcgctttccgcgtataaattgatccaataaacatggttggctttatgaatcattatcatgtgtcctgcctggagttctctttctgttttctcatgtttcaaatataggtacgtgtgtgcgtagtgtgtttgtattgatatcggagtatatgttttggcaaaatgtgctgccagagaagtgggaaccaaagtcccccgtcctcggttatttgggcacatgagggcccgccaccgctatgatgaggcccgccacgaagcgaccaccgattgcctcaaggtctgaaggaaggtcgtccacgtgtgctggctcagaggttgccccgatgtaggaagggtgcctcaagaacagtgccaactcgagcgtgctttgactgccagtcaatgggccagggccttgaggtcggccttggggctagaagcctttctcagccacgccaccacaattaaggggatatgacccggccgcatgtgctctattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatcatgtcatccgacattaatggtggaatgacgtggttcctgtggagaatcgtgggccatcgtgtacaacggaatagggcgtatgatcttccacttgcccatgtcgcccctaaaaaagggtgatgaacgggttgccaggtggcacggctttataccatgctgcctgtcctggtccgctagtttatggtcttctacctagtctcagtgcttgacagttgggccctatgacacccaggacaccctcctccatcacgtgccatgcgtcagaagggagtaggtgttcacatcaaacagggccctccagaagggccaatgcaagaccaaggttaccggctcctgtacgtaggtgtgtgtccaggcactatggtatccccttaccttaataaaaggaggactaatgcctccaaaaagtggttcaaaacctaagataaagagagactcccctctagtggtcacaaaaaagcttgaagaacattatgtaaactaagtaactaagcaagaacataaaagcagggtgttacgctcccaagcgacctaaacctgtcaatatcacttgtccattgcttgtacatgcgattcacatccaacctcgaacacttgcaccctaaccaaatctcaagagggggggtatctttccttcctgctagaggagctcgtgcttcaacaactagtgcgccaggttgggatgaacatgtttgagcttgcgttctcacatcctccattatcgccaaagggccaaagggatgccatggttggagggcatcgtcatgtcgattatgagggtgaagccagggataaggaagcggctagcgagcctttcagtgtcgcccaaactccgtcttgcctgtcgcattcttcgtcgagacgcgttgtgtgccctcgacagaccaaccatcatcatcacctcattgcacgagcggtgacggtcctctcgctcgccaaggggctagggagtgcccaactagctcggcgacgaccgcttccatcgtcccaagtgaaaggacacaacgcatttcggtgtagtgctacctcaactttgattctaccacactggggtgtgctccttgcagcgaaggcactccttcgtcatccgccacatcgggccggcagtggcactcctggggggccaatggatcaaggatgtggccaacctagtgggtgtcactcactgccaaattgctgtgcggaacccctgctccggctccatgtcgacgtcccatgtggcgccgagagttgcacagtcgcccattctatcaaaattaatttatgagaagacataaatccaaatcaagaaattcatgctgaataaaaatccaatggatagagtataaaaatacacaatatcaccgatttggatggcgacgtcatttctatctaaatccaatctgcaagatatcaaaacatcaatgagtacaaatccaaatgccaagactaatgtaggatagaacatatataaattagaataaatttagaaacataccgattattcattactaggatagcatggcgtctatgcctctatataaacaccagcaaagaaccatatatataatgccaatgagcaagacgaaggagagaaaaggtaaagagaaattcagaaatactcgatcgatttgcagcctcctgtcatggcacctgtcaagatcaacaagtttatcactgctactttcttcatggttcttgtgatcatgtcttgcgccctcacatccacacttgcttgtcgtaagttgctagtctatccgttccaaaacataactatcttgctaatttaaactgaaaatgtagctaatttaaactagaaagttaactatattttgagagatggggtactctttactcttctatgtttttaattgttttctcgatcacataaaagatgcaaaacacaccaccactagatgtgcacacatataatatcatctctttactagcgagagataaatctgcaaacccttatagaatacttatttaattaatggggttgctattgttatgtgcagagggtgggacggagtgcaccgttgaaacgccacactgcacgatggattcgtgcaatgcaaaatgcaaggcagaggccaccagccgcaagtgcaacagtctgactgttagttgccacaaatatgctacacttgagaagtgttgctgcacttttcatgcaaattaatatcaacaatgacatcaacatagtaaaatagtactagtggttgatgataggattattgccgatgtttagattaatctcatgtaaccccttatctatctttattgcttccctctataaattgatccaataaacatggctagttttatcaatcgtatcatgtattcatgtgtaagtgttcgcatcaagcagggccctccagatgggccaatgcaagaccaaggttaccagctcctatacgttgggtcctacttgtgtatatccaggcactattgtatccccttaactttataaaaagaggatcaatgcctccaaaaagcagttcaaaacgtaagacaaagagagactccctctggtagtcacaaaaaagcttcaagaacattatgtaaacactaagcaagaacacataaataaggtgttacgctcccaagtagtccaagcctatcaatatcacttgtccattgcttgtacatacgattcacatccaagctcgaacaccgcaccctagccgaatctcaaaggggggtatcttaccatcccgctagagaagctcgtgctccgacagctagtgcgccaggtagaggtgcacctgtttgagcttgttttcccgcatcctccattatcgccaaagggaggccatggctggagggcatcgtcatgtcgattccaaggggaaggctggtgctgaggaggtgactggcaagtctttcagtgccattctatcttgcctgccgcgttctccgttgaggcacgttgtgcgccctcgacgagctaaccatcatcatcactaggccgcgcgagcggcggcgaccctctcgcttgccaagggcactgggaagtgcccaggtggctcgatggttgttcccaccatttggagggagcaggcacaacgcgttccagtgtagtgctgcctcaacttcaattttgccacaccgggggtgcgctctttgtagtggaggcactccttcgtcatcactcacttcgggccggcggtggcactcctaggggttgatggatcaaggatgtggccgatctggtgaggtgttgctcaccgccaggttgccgttgggaaccctgctccggctccatgttgacatcccatgtggtgcccgagctccgcacagtcatctattctatctaaattaatttataagaaaatataaattcaaatcaaggaatatcatacttaataaaaatccaatggatagagtataaaatacacaagatcgccgatttggatagcgacgtcatttctatctgaatccaatccacaagatatcaaaacatcaatgaatacaaatccaaatgccagaattaatgtaggagaacacatacaaatttgaataaattcagaaacagatcaattattcattactaggattgcttgacgtctatgcctctatataaacaccagcaaagaaccatatattccagtgagcaagaggaaggagaaaaggtaaagagaaattcaggaatactcgatcaatttgcagcttcttatcatggcacccttcaagatcaacaagactatcgctgctactttcttcatggttcttattatgtcctgcgccctcacatccacatctgcttgccgtatgttgctactcttgctctttgttttttttgggagccgttttggattaaatctcaaaatatatcctatcaattctaacgcatgtactcaatttggcacaattataaatccttctttatcataatataaatttagcttccaattatcatcaatccggacacactcatctataatgctaccctatcaaaacattgataagtcctagtactatgagtgtctttaggtattaaaccaaacaaaccattaattattttctcaattatataaaaggcacgtaacataacatgcgcataccacatacacatgtattatcactgatttagcaactagagataaatccgcaaaccctcataaaatacttactaattaatggagttgttgttgtcatgtgcagagggtggtacggagtgcaccgttgaagaaccacactgcacaatggattcgtgcagagaaaaatgcaaagacataggccaccaaccgcaagtgcaaccgaatgacagctagttgccacaagtatgctagacctgagaagtgttgctgctatttttatccaaagtaatattgaccgtgatatcaaaataataataatctgcggttgatgacaggattattaccgattgttagattaatctcatgtaaccccttatctatctttgttgcttcccccatataaattcatccaataaacatggttagttttatcaaactatatcatatgcgctgcttggagttctctttctcccgtttcgaatagtacatgtggatttacttgtgtgcctgtataactatattgatgtcgatctttttaaaagatctatttatatcttagacttaaaaatataccatagattcgtatcacttactagatttgtattacacgactgcaacataatttgttttcttgttttgcctagtcaaaaggctccttgattcatgttcgataaagcgaataacattgtgtttcatctccaaacttccacgtttggacttatcttataatacaaattcgatgcaaaaaatcgcaatgagaatggtgccacgtggcaacaccggtttcgtggaagaggctcgacgaaaagatcttgcgtgtgcgcgtgcaacgatctgctcttgcgtgcgtgcgtgcaccggccaccagatggagtttcttccagaagcttcttcacgaatgtatcaaggagcaattaggtccatggaccatggctcagcaggcagtgcaatggcacacaagaagatgctggatgaaacgagatattaaccatacatgtaggatgtaggagtaacatataaatatccggtgctgcggtgcatgctgatcaatgcaaacatccagtgcatgttgatcgatgcatgaattggtgcatgctgatcaatgcaaacatccagtgcatgttgatcgatgcatgaattggcacattcagtagtccgtactccctattttgtacgcacagctttgattaattttcactttctttgtactctcttcgtctcagaatatagcaatctagtacttaatgggacatatcgtagtataatgaatatggacataaactacacaaggatatttttaagctcttcaatctcccgtctagattcactaatgttcatataaatttcgacatatatatgaaacacatatattgatccatgtataaatttattcaaaacccaaaacatcttatactatgaaatataaatttattcaaaacctcaaacattttatacacatacattgatccatctatgaatttattcaaaatccaatcattttataatgtgaaatagaaatttatttaaaacccaaaacatcagagaaaataagcccataattaagtggaagtatatactcatttgttgtataccgcgttttttctagtatactaccaaagtatacgaaataggcagcatctcttccatgagagaaaagaaatgcttccggaaaggaagcagcaaaaacgggacggaaacgttagaatacgacttctccgtgacagctcagcagctcattctccctcttctggtaggattccccgtcagcatgtgggccccaccgcacgccggtgcgccacgtcagcggatgacagttgcaactgacataactgcccccacctgccgtcttctcctccccccccggcccgtcctctccacggtgggccccacgtcgggacagggtcaaagtcccgctctccctcgtgtgtgatctgacggaaatgccccctggtgtttctcgaaggagtaggggtagtaccgtaattttccgtggacgctgtcttggtctggggaacgtgggctgctcgccgtcgcagactcgcgccggggtcagccagggtgggacccacctgtcagagtcccgcgttcccagcgcgtcgcggccgcgtggggtccctctcttccccccgttagccatttgttcccattcggttttgggcttttggctaatgcgtgattagtcagactaattcgtgattagtgtgtgtattatgtagctgatgttaccattagtgtttttggatctaagcgtgcaattaatctctgtgccttgctttgtagagcaaaaatgcaactctttgagaagccttacacattaatgttctttgtctaattattgactagaggaatatggttttttttccctcaacgattgcaagacttactacttcaaaaagaataaaacagttgcgggtttaggattttctattccaatctgttagagaattggatagcaaaagtggtatttggagtaatcagatgatcagctacaaagcaccacacttgtaccttacatggctcatgtgtaattgatctgtttgatgggctactataattagtagcagaaaatgcaatgtacttttatatgaaagatttcttcaatcctttcctcaattggtccattgggaatcctcatggccctttagcagttgggacaaacccacaaacccataataatggaaacatgtcaattgtcaaagctcacaactactaatcacatcccccacaaaaagcaaaagcatcattaatcataacaaagaaaaaacctccaataagttgagagcaactaactagtgacaagtactaattaattacccacatctcccaaggacccaaatgcaaaacaactcaacccctccacacacacacacagaaaaacgtgtaccaaaaaaacattccaaaaccaaaaataattatcagcctataaatttattattatttatgtcctccacacacacacaccacccaaaatcatccgattaattaatttgatttaatgtaatgtaattagggtggtaatctaaaattaatcacccctccccctcctaatctcacgccctcatataaaactccccacccgctgttgcttccgcatcacccattccctttttcctttcttgcgccatttcccaccgccgccgccgccgcccgcgcgcgcgcgagatctcgccggcgatctcgccggaggcgatgccggtgacggaacaccagggctcgtcgtcgtccccgtcgaccttctccttcggccgctccctcctctctctgcgccgcgaccacgtggccatgccgtcgggcgaggaggccgacctggaggcgttccagcgccatttcgcggcgagcctcggcgagctcctgcctggggaggtggaggggggaggcggcggtggtggtggtggtggtggtggtggaggggaggagatcttgtccgtggcgtggatccggcggcttcttgaggcgtttattctgtgccaggaggagttccgggtgttcgtggcgcaggcgcgacgccgcggcgcgctcccggcggccggggagaagctggtggtggagttccatgagagggcggtcaaggcgctcgatgtgtgcaacgcggcgaggg

SEQ ID NO: 28571 - DNA, 24168 bp, Oryza sativa
gtggtcgcgtcgcggcagctgcaggcgatcggggccggcctggccgcgccgcgcgcgcacgaggcgggcctcgcggcgcccgtctacgccatgggctgcgtgctccacctcgtcgcgtgggcgctcgtcgccgccgtcccgtgccccgaccgctccaccgcgctccaggcgcaccacctccccgcggcgccggcccgcgccgcgttcccgtgggcgccgccgctcctcaccctgcaagaacgcctcgccgaggagggaaagcgcaaggacaggcgcaactcctgcggcctcctcaaggaaatccatgtcctcgagaagtccacgcagaagcttaccgacgccatcgacgcggcgccgatcccgctcttcggcgacagggaggccgacgtgcgggaggccgcggcggagctcgccgccgtgtgcgccgccatgagagacgggctcgagccgctcgagaggcaggtgcgcgaggtgttccaccgcatcgtgcgcagccgcgtcgagggcctcgactcctccatgcgcaatgccgattgatccatccatcgatcgatcgatcgatcagaatttctcgttttgattgggcaacgtgttggtcctaggtagatttcttgttcttgatctgctttgtttgagttccaatcgtaatcgagtataaatgtgtactttcgtgtaaagaaaaggggattagagagggccatcataatgtaaagatggctgctttgttcctgtgctcttttttgttctcctgcatttggtatatatatctcatcaattttttgttcgtcattgcgtcttcggctaaactttgatgattcaatttatgttctagagctcatcaaagtaattttttttggaaatttagtccttgtcatggtttcctgactgttgctggatggtggtgttgtatgttcatatgattttgctttcagaagattgcatgccgacattagcctgaggtgtcattctgaaagggaggtgttgatggaaatgctgtcaaatatgaatatgtttttattgttcttgacagatttagtactggtgttgaggtacatgtcatgtgatccatgttcaatcttggaaagggtacatgtcatgtgatctatgttcaatcttgtaaaaatctgtcttttcatgaataggaagaaacctgaacaagaaagagatgacaattttttttttcagttttgtgaattcaattgagtcttttatgttgtggagcatgaaaatttgtggagtattggagattatcatccagttctgtcaccaaggtgtaggtggctagcattagtttgattgtttctacagccatgtgatcctgtcctgtttttttaagacaaacctgttcaattagttagttagctgtccatttctccacttttatactcttacctgtttcgaagcatgtcttgccataccggtaatagtcctctagatagtcaatgccatgaaaatcacagcggcaaaactgttcctgctttgaaggcatcactaaactgggaggaatgtcttcatcttcaagcaaaaggttgtggatttcagctgaattagtactgcagcaaaacggtatcaattgggttgcgcaattcttcgttccagttatatcttctgaaaatctattttctgcaatgtttagactacttgatggtctccgtctctttgagcgtgtgttaaagactcgcacctacaagtgcgtgcgtatgttgtgcttttgtggtggtgcattttgtgtggggtcttccatgtgattaattttttttagaaaaatgaatggtattttcagaagcttctgttttgtttgagcatgcatgacaattcagcagccacagatccctgtggtcacacagcattgtgggtgctgttatacctgtgacacagagttgttgataactgatacctactgcttatgctgagaacctgtctgtctccaatgtggtggtaggctcctcctccagttgttgctgcaataacagcaacagatcacactgaaactcccctatcagcaacaggaggaagaagaagaagatgcttcaaggaggtctcccccctgtcttcgtcggcggcgatggtcccggctcaccggcggtgtcacgtcgctggaggtcggcacggcgactcggctcatccatggtgtgaccttgaaaggccttgacccagtagtggtagtggtggtgatggagatggaaatggcagctgagctgagctgatgattcaacggtccaactgaattgttccacacgttggtcatcaggacagggttcagacgtgcagccaacacggcagcatgtcttgcccacaagggacattgcccatgagagggacaggataggatcatacagctttcaagtttgtgcataataagtgcatccagcaattgacctggtaccaggaaaaaaaaaagagtgatttcactcgttcactcatcaacttgatgtttggaacttggaagggagaaaaataaggaattccattttcaccaaccaaacagtatcatctaccatggatatttgtcagtttcaccatgggatgatgagtgaaaaaaaaacaaacacatatcatgcttattttgacataagctctggctggctggctggctggccatcctaaactgcagtgttacatacaccaagaaggattataactgacggcaaaaatctacaggaactatatggttgaaatgaaatgaagaaatcaggactatttatacaatcaaatctaacaggctggaaaaatcgttactgctaggaactttacagtgctaccaatcttggtgtcgaattgcggtgaaaactttccgctagggtaatctttcttgcttggtcagtagtgcactattggtttgataagggccaaaagtgcaaagaggaaaacccagtcatcgaaaaagttcagggaaggaccacatgataaacttggcgtagatgtcagtctccaggaactctatgtgcgctgctctgccaatcatggtgtttaggttccgtccttgcgcggactgatcaaagttcacatcacagcgcatgaagatccgggtttcagatgtgggtgcgcgcatctgatctaagcaattgttgagcatttctgtaaagacttggcccttccttgagttatctgatgatgcagccgggcagagctcgattcttgctgaatgatatggtacataaccatcctggtatggcaagaaaatgttacaaactcatgatttcgaaataaagatcattagaaatgctgaaagattcagagcagccacaactctgattcacatgtaaattaaagctgttaatcacgtggaaaggggataacctgtggtgaagatagaagtataatatttttgaagttctccagtgtcttcaactgaaaaggattataaaagggaacagcttatggccaattctaagatctgatataaattcgcaacagataggattactgaatgcactacagaacgaagcagagggtgataccataccttacaaagtttataaaagaatgtattctgggggtcttgatcatcactgaaagtgagttgatggatgcactgtgctcccttgagcttttttagaagccagaggccagagttgaataaagagtttgagctgtaccagtagcccaagtgtgggcctgatattgacatgtacgtgtacaggttcttcaagtatggttgtaatgcgggttctattcaacatgcaaagattgagttagcaccatcgagatgaacttgcctggaaggaatttattgagtaagttggataatacctgcaagtgcagttctgatgataacgttcccaatggaatggccaacaaaactaagcttcaattctttgcagcctccgtactttgcaagcttatcaactttctttttcaggaatgcaacaacttccccagcaagcctaccacccatttctttaaaatccccagatgttttatcttcgttagcctcagacattaagcactcagctccaggatccaacagaagccattgatttcgtacaagacgtaaatccagatggtgtccctgctttttgtacaccataataagtttcacccgaactgcattgtgactctagtgaagctttaatgaaataaagagtacttgcctgaaacccatgcacaaaaatgacagctcgcaatatccgtccttttttaccagcactgcttttcagtgccaaagaatctccttgtagtttaggtagtacaatcgtatccttttgttctgaagaatttgttgccaaatccttgctagagccatgttgcggaacaaccatgacatgttgttctataagaacaacaggaacacgtgaaggatctgcatatatttgcatatcttgaacggacagcgtgttgatctgcaggatgctttaaatcagtaaacgattctaaattaacaagtttttcactcataaagttattccaaaaaaataacaagccgaaccttcatttgtgctatacttttcctgtgcagttcagcccgtgaggcagaattttgtacaggctgcacgcaaatgcaaaatatcaagtatatagaaaaggagggaacaccgttttcctattgaaaatggttgttatttaattttaagaattcaagagaagaaaattacatcatcatggaacttccttgagccagaaactctcagaagggaatgacggtgagatgactcatcgtccgtactacgtaaatagcggtgtgggatctcaatttttgagtgaacagtccatattgaccattctgatttccggtcaagagcccaaatatcacgcaagtagtccaatatcttggttttatttatcctgtagatgcaataaatacattgttggacaaatagtagataaaactcataagtcaacatggacaaaccaagcggacagtccctaggcccactgaagatatgtatgaagtgaaaataagagaaacagtgaacttaacctatgaaatttcaagaaagcattccatagaagtgaaagttggctgctcacagttagaaacaattctaacaactcttccttaggaagtgtatatagcatagcatcgttggcaccatcaaccgcactgttgggtttctgtagaagttgtacaaaaaaatatcaacaatcagcaagtctcgtacaataaacacattcatagatcacttaagacggataaagatagcatacctccagaaagtcatgtaaaatgccagccaagtgcccaacacccttggtagttgccgggaaaactttatttgaattaggtagacctgattttgcaggctgaactgcctcatatttaccaagacttaagtcagcaacatctaaatcttctactgttttaccaatagcatcactgattttctttagttcttcgagtagcatttccctagaggttaataatgccttcacaatgtgatgcgatgttggtcctaaaccttggtctggtatctgcatattaaatgccattattactttgcagtcaccaaatggagaaagaaatcaccatgataaagcatactacattatccttcatgctgcaagaaccaattgattgaggagtaaatgttggctatttcgtgatagtaaaaaaaaaacctctatatgatcattgatgcagcttaaataaatttacagacaagaatccattagtatgctttgtgagtgatgaacccttagaaccctatagttaatctaccctgccgaaatctcaagaaaatattattttccaaagcaatgctaggggttgtgccaggaattggagtaaaaacattcttattttctgaagttaaatttcaggtgctggttcaggaattcaccatcaatgaacaccgccacatataaaacttcaccagatatgaatacagtctgcagttacctagttctatgcttgcgtccaaaggtgtttaaaaacattcagttataaacttagacatgcttccatagaagcaccgattttttttcccaaatgccaattaagctaaagttccacaaacctgtgtaccttcaatgatgatttagttgcaccagctttgaggtacacgatatgtaaagtcagatcaacaagcacggagtggaatgcgtcaaagtgaactggacaatatgagtgtgaaccaaggagtgctcgacgtgggactctaaattcatgaacagcagccgaagaagtggcactagaagcttgaatatcagacctacagaagatagcagcattagtattgatgacttaaaatccaaatttcataatatgaaattatgaatgcgaactcgacaatgtgcactgtatcgaaagcactatatatagggttacaaagtatctgctcacccatctccagcgttggggcatatatcagctcaaatttcaatataacagatgaagctgctgggcccttaaataaataaagcagatccgctgattaggcaacagcaaaattgattgagaaaggaaagggggtattaaagtgcccaacctcttcttcactgttgaatatgttaaaagacaccataactgatagataaatgtcttgtctagcatatttgattcgaaatggctgcgtgtagaagctgttatcggcatcatctattttccaaatgcccaatgcatcgtccgcaccaacatcagaagctgcacaatccacctagcatgtcattacctatcagctaatgattggaaattttacactttaaaatatgtatgtactttttttggactaaaaatttcttcagcttttgagtgtgttttattccctttgtaatctgtaaatatttctttaattctataaaatcacactgttgggcaaatgcctgacagtaatttacttcaaaaaaaaaagcatagacaatttttgttgagtgagaacacatattttacagtattataccgtgttaaacactgtagcacacagtttgtcatggtcaggggctaacgatcatcctttagttgtaccctcattgcccatcattgttttgcaccaaaaagggcaattatcataaagctaggtgccaaacacaatttgaccaatgagctcatccataaggactatatgtatttctctacagacattctgcatgacatcgtaattaatagaaacaagaaaaatgatgtatgacaagtctgtatggtaactttccgtatacagctcaacaacctctttgatgttatattaagcatgattcaatggtaacaaaacaggcttggtaatttaataccaacgagatagcactgaaaattgtaacaaataccctcccccgttttaccagttagaattattctcttttcaccatcatatggtatatgatacacacagtcaattattggcagtgatcaagcggttcacttttatcaatatggcagtggctgttactactcatcaagcacatcggttgtaaaggtccaagtttcaccatacatttccatcacaaagcatcttgaaatcatgaaagtagtagaagtagatgatgaagccttcatattcaacatcagaaatgatggacgcaccttcatattgcacgacccttgcaggtgaagctggcgtcttggaaccaccttcctcccacgttgcactaatcttcatttggtaccacctgaacataacacaaaactacccgttagagaatgaagcgacaaaacaccttggcataatcaacaattccatacaattacacacaaacattcaacagaagccaacatttgcagtaaactgtaaaaaaaaatgtgggcgatgtcaaaattcagcagctcgggcacaatgtccacagttcaaaggagtgaaggagtacaagaaagaactccaaaacagcgagctgaactgaaagaagactgcaaatcagcaagaaatgttcgaacaagcggagcccaaacatttagttaaaaatgcagtgtgatataatgaaaaacagaaggaagaattcacctaaaactgcatgcattttctcgattcgtcactctaaaaatgtgaccctttagcacaagccgctcgaactttccattctcaaccaaaaaggaacagaacccaagaacacattcacggaaaagagaaacccaaagaaaggccaaaaagcgaaaaaaaggatttcacgcggccgtacccttgctggaacagatcgaggttgtggaagcggtggatgtaaatggccacctcgtgcaccgtctccatcacgtccggcgaacggaaggggagcccgctctttccctccgctccggcggcggcggcggcggaggcgttggcgttgtgcacccgcctcaaagccggcgagaccctcctgaccgccccgcgcgggctgtcctcgacgccgccgccgacgaggcacctcatgcggccgaacatggcgcgacgtccccgcgccgcctcgcccgccccgatccgcgcatccctgcctcgatcccctctcgcctctcgcctcttcctccaactctagtctctagaatctccaaaccccctactccagacgacggcggcgacggcggcggcggcggctagatgccaacgcgtagacccttcgcttcagcggcggaggagtggcccccactcctcagtggggttggcaaaattcgcagatcgggaggcgacggctgcggctgcggctgcggcggcggccagtggaagcccaagccagaggcggcaggagcaggccacgcggaggctgtcacgtggggcccagctcaccggcggcggcggcggcggcggtcgggatcggaggcggcggagttgggagggaagcgcgcggtggccggcggtgggggggagctggtgagaaagcaaggagacgtcacgggggtggattttaatagcccgccgcactcactgacatgtgggccccggtggaatcccgccacagtggagcccacgtgtcagtgggccatggaccagtatctgacacgtggagcctagcgagtggacaggcgattatggccgtagctggacggggtacagcaggtgggtgtattagggcgcgcgctcctcggccccactcgtcagtggctcccctggcgccatcaagcgcgttcccggaaagcgccgtcgtaacgagcacgcgcgcgcgaaacccgtttcctccgcgtggaagcgggttttacaaatacgccttcgctttatttttagtacgggtgggccccaggggacgaggtgacagcatgattggcatgtgcgtatttttgcagcctgacagcgacacatctctcgtcgtccagacaagagaagatgagaagatgagatgagaacgaagacggacacggaataaacaaaagaaaagaattttcgcgctggtacttggagcttacagtacggtaccaatctttcgagtttcgatcaaaaagaaaagaaaacgatgaaaaatcctgccacccaatagatgagaatagtgcgtgtacgccgtacctttttttttccctggtgtagtgtcactgtcactagggactttgaacgggaaaattcagcgtccgattgatgacaggatgaatctttccaaattttgataatattaactttttggtaaattgacaacattatcaagtttaataggatttgctcaatataatattgtcaaaatttcatagacattaccaaaatttggtaacaaactaaatataactatataattaacaattttactaaataatggtatgatttgaaataacatcaatctgaacaagtcctgcgctactcgaatcatgtggagaacacggagaaaggattctcgcgtaccaaacatgggcgccgaaaaacgaaccacaaaatgtgccgtttcagaaaagtaaaataaaaagcacacggagccacctgtcatccatagcggtcccgcatgtcagaccgtggccattaccgcaggatagacggacggaaggattggatgcttcggcagcctacttggaaaaagcgaagcaagctcgttttaccacagtaagacaggctataagtaaactacaaacatattttaataagataaaagagtaaagagaacgggctacagatctgtaaccagctacagcacgaactccgagatgtaatgtgtgtataccaggtgagaccatatattaatagtatagtaaacattattgtatgaattggctagaaccgataatgggttataatattaaacttgctctaacagcacaagtacgggaaagcatggtcgagtgaagtggatactattgctgcgtactccactggactgaggagtgcagggagatcgatccacaagggaagggggaatctagggaaaagcagtaggcatagccgtggggatcatccatgatcgcgtcgcgcgcgtccggttggttgctgtcggctgcttttctcttcacggcatcgcatcgcatcgcatcgatcggggcctcacctcacatgcgaagcggcgcttgcacaactggacatcacgtagtactagtactacctccgtcgcttacttgtctttttaagtttttatttgttaatgtttgatcattcgtcttattaaaaaaaattagaattattatttattttgtttgtcatttgctttattatcaaaagtactttacatatgacttatctttttctatatttgcactaatttttcaaataaaacgaatggtcaaacgttgcaaatataaagtaaaaaacgtcacctattatagtaccagggagtaatacacatggttacttctgcgccatactatgttccaagagagaacacaaccgcaatttctgctccaacgcagcatcagtcgatcacattcacagaccagccaaacatgacacaacaaaggtcaccgctcacggctcacgggctacgttgtgcgtgtacaacaaatcgctgcagggaagtgacacataatgataagggaacatgtcaacattacagttataaaaatactactacactagtggtagcacattctgatccaaatcttttgtcaccttgcgctctcaacagaaacagagagctcttctctttttaaaacagaatccacagcaccaaaacccgccacttcttgcgggcaaatcaaaataaactacacgcataacaacagcccgatggcgaacataccggttccccaaatcctcaaatttgggaccatgcacactacaacacaggcaagcaagtaatcattctagaaccattcctttattttaagctttcacttcttgcaaggcatgggtcaataaggatttaggggactcccaaaacaatgcaaaacagcaagtaacagtccaagatcaggatcaaacagcaaatcgctgcacggtttgataccttccttacaaatcttatatgtgtaaacacaaaaaaagagaaggggaaattatatcccatttaaagtttatttaagcaccccaaatccctaaatttacaagcttggtagccagaagagatcattacacctgtgctatgggacacctcactagagggcctggtggtagttcaacattcacagagaactttacagaggtagaatttttgcggtttcgctaaggaggcacacaagggcgaaacgcttctgtctctagcgtgatgatagttttctctctaggtcgtatggttatcttcaacaagacctgctccgcactgatttcctcagctcctagggtgaacattcgtttcaagttgcaatcatcttgactggaccactttgtagttaagaatcaaatcctctggcttcttccagacataagcccgcactgtggccaagctcatttcgggtgccaaaacctgcttcatattagtaatatttatcacagaggtataagaacctaatgcaagaaaagcataatgatctccaaattgaaataaacaggattcagcatttgaccttttactgactgctataaggaaaactcaatcatacttgctaacaatttatagcaaatttatcttgaaacatcattattacttgttagtcagataatgtgaaaaagaaaatatccatgaatcaagcagaacaggttaaaaaaggtaaatttaccgcacatagtcacaacaaaaacttattgaagactataataacaattaagcatggctagttaatgttgtataatttccccttcagtacacatgttgtaaactgcatataaatattacaatttattgatatagcacagtaggaacctctcctgatattttaaatcagaaaaaaaaagccataataacaattgatcagaggctaaaactctgttgagaatgtgagaaaaatacatggtgtccataggtgcactagacttcaaaacattcggagcaacaacaaatatatgcagggttatagaattaaatgcatggttatagaattaaatctgaattcaaatccattattgaggattattggggatcacaatggacaaaacaggaaaacagtgggtattagtgatgccttttttgttagtggtaacattggccctcagcaaaggggaacagtacatagaaagaaagaaacaacagttgaatttagaaatacttgcctggctgttacacaatatctctacagaaggtttcaatttttgccatggttttagtccaagccgtgaagaactatctagcgctgaaaattgtgattggccagaagtcaatcccattccaaatgtgctgtcagcattgccatccagtggtctatcaagtttctcgaccacatagttagctacctgtacaaagaaatatagcttcaatagacataacacgatagtctagcaataacaaaacaaaattgctataaaaaatggtaacatttttcctactcaatctcagttgacttcttgtaccaatgtggcccttctctgttctttcggtttttgtattgattaactctctgcttgtttgttggtttgcatttgcactagaatctccttactaggaatcaagaatcatgttatgacctgtccagagcttagcatgtttttgctagtagatttttttcattcatgatagtagccttctgtgatttcacttctactccctgtaccaaaatttagctaccttagtacttcaaatttgaattacaaaggtagctatattttgggaaggagggaagtaatttgtgaaatttgcgaatcagatttgctaaagagggcggcgtcatatcaatctgcatggtattttttggggggaattgagtaggtaatcaatcttgttaagtcttgtatattgagtgctagacaaactaaaatccaggttcctgaagcataactacctaatattatctaggtagtaagttcgcaacaatgaatcaggaagctagctaccagcacaaaaaaaaaaagcatggttaggtagctattttcactcttctgtccatgcatgcaagatgcaacagactaatgtccatttagctattttcactcaattgttatgcatggatcgccagcaaacggctaaataaattcttttcgtagaagaaattcagcgtttgttaaggcccaggttacggagcagagatcatggataacatattctcagtttcccaaaaacctttcttttccgttttgagagaggggggggtttctatttatggatttcctaaactagtttcagggcttatacgtttcaaaggaattgtaaaggactgtcatttgtttcaaaggaatgcaccaaaggaaaatttcctatccctccactttttagggggaaacgaaggaaaaacataatccactccaacacaatgttttcaatactttggattatttgctacacaaccataggaaagtttcctatgtttttcaatccttaggtttgcacatgtattccaatactattcctacgttttgaaaatcctacaaaccgaacgagccctcatattacacgagttttcttttctttccccaaacaaacaatcagtgcagtcaaaataaacagaataacctaaaacctaatttattagaaaaactcctaaaaccaattatcctaaaacatatcaataattcttcgcatccaagcacctactaccttatactccctccgtcccaatatgtagcaacctaggatgggattaatcctaggactacgaatctggacataaggtatggtcagattcgtagtcctaggatgggttcttatgtccagattcgttgtcctaggaatcccatcctaggttgctacatattgggagtgtgtatcaagaaatttcaaagcaatcttactttgtgaatccgcaatatccgtggagcactaagtttcccttgtgttatgttcggtgcaggtgacccttcagcaggatgcaagtagaatccacacctacattaaagaaaagaaaataacatcagtgactagtttgttccatgacagttatgtctatgcaaaggcaccctgtgtataacatcaacttttgcagaaaacatcaatccaaatctcacttgctcgtactttcattattttcagtaaataccctaataagatccactattaacatgaaaatgggtcaaatccaaaaaggatatgcagaatctattgttttacaccctcaggaatttagcactgtgcagaccttaataaatagcagataatttgatgccttgcagagatcttaatcaaaccttgtggaaaaaaattactggtggttcaaatataggaaattgaatatatttaaatcctttaaaaagaaagaatagattatgccagtatctaatcatcattgtatagaactattagcactggaactttcaaagagggatatcagctaaccaagctatgccacaaaatcgtggcagaaaccaaatactcccccagtcccaaaatagaacaacttgtagcattcaaaatttgtcccaaaatataacttctcaacctacattctcttctcaaccaaccacaatcttccgctattcaaactcttcacctattgccttttctcaaccaatcgcaaccctccctcatttaattccacctactttcttaattcccatgtccaaccctaaaattccttatactttggaacggaggtagtatatatataatcacaatatgttcaacgaaagaggcaaaatagatgttataaacaggctttgagtaaattagtatcacagaggggacatttcatatcaagtccaaattgctagagagcacaaattttgaatttctgcaaagcgaatctccaaattaaggtataatgcatcacgatatatgttcaccaaaattcgaggaggaatattgaataatccactcaaacagccatccctgtgtgccctctagcaaacaacatacctaacgctcatatgttatacagttcacaaacaacagcatcaacgaaatttgggcttactattgcaactaaaatgccttgaccttctaaaagcccgagattccacgaaatactaccttccaagatagtgcagcatctcgaaagaactcaagcaatggtccaaagatataaagaaaaataccatcttaggagaataggaagtagaaatgagcaattactttgtattctcttttggaaatcgattatgctcaacacagtccacaatccaccatgggatatcgctctcggttccatctaaatctgtaattctctttctccaaggccctccacttgaaccttctgtgatgattgatggaggcgaaactgtggaaaactcaaatgagggaagcatctgacttgcatgattttcagccccatcatcaacctcagatcttggatggggcaaatttttcaaggatacatcttttcctgttgaagtgtcaccatttgacaagccgtgtgagccagatctctgcttttttttactccaatgaactaacaaaccacggagagtctcctgagccaaattaatctgcatttttttaagagggaattgttaagaagttgaatcaggtatgaatcagatctcacttgcaagtggcaatcatatcaggtgaatttcatcattaggtgtcatggatggtttgaaccaagaatacaaactaaaatatatcaacaaaagaaagaactttctgtcttagtaacagaatgattgaactactggtgcatcaaaagtttgaagaatgataagcaaaacaaccagttgacaacatatgattctgtgcaaaccttaagatcttcctgtgctcctgcaacgtttaagtcaactgcatatatttctgcagaaaagcattgaggtgtatccaggtggacagacaggcatcccaatcgagcatccatggtaaaccaggcaggtatgctaacctaaaagtaaagacacaaattacatactagtaagcagcagatttttactacacagagatcatgagtttatcagtaataccatctcaaacaactcttttttcttatcctcaaaagaaacctgcacgaacaaagtggagtggcttaacattctatcaaatatcaaattcattcaaaaaaaaatcaaaagacacacagtatgaactacagagtgcccgaaattgggactgaaactagaattgctgctgactctcaacatacttaaggatcttttcagggaaagagctattcgctaaattgagcaaaaataagaaccttgccaaagtcttcaataacagctcctcgagtaatctcccacaatttgacagaaccagcagtatcctatgaaataggagcaaggcatataagtgaactctttgtaatctgctaatggtagagcacatgatggaaataacacttgtaatcaccttcgtcaatacatgtcttctattattcaggatctcatgctgagttattgctggaactccaggaataattgaagatggttctttgtgtatagggacctaaagtggtataatcatgatataagcactcattaagcaccaataaaaatgttgcccatagttaaacaaactttctatgtttactcaggcaacagataatctgtcaaagaaattgcctgcttcagtgtggcaaagcatggaatgaatttgtgtctatgacatgctgggtcactatactaagacttgtatcacgccaaatatgtagcagcaaaccaaacaacagcctccatgttgtggcttgtgtgttacttttaaagatcagtcaatctcaaagttaagttcacaaggtttatactgcagaatcccttataccctattttatcttcaatgtgcgcaagtatgacaatcgctatggcatgtgaaactgttattactgacttaaaagtgtgtctgcgaagaaatacaaaattattgttcatgatacaattaatgaaagatggcaaatgtcatgcttacaggtgctgatccttctaaagaagcccttgccctggagaatgacaaattgccagctaagaatgaagaacctttttggaaaagctttaggggttcatgcgcttcagctttccatccattcacagaagaatcagttgttgcaacccaaatcatatcatcctgcaaggacaattgtagaatcgggtgctcgtttgtgcagagcaagacactctctcgattgcttaaatctgtcaagtacacctgccatccaagaaaacaggaaggttcagaattcagaaaagaagcaattatgcaacatttgaaacttgactcaccgactgatctcttccaccactataaacatgactaaacgaaggagtgcttgcaagcgcccagactgaatcagtatgcacagcataagaatgaatacatcgctgctgtcccagatcccataatctgcaaaatccagaaacatgtgcagacaagatgttacatgacttcatgatcagtgtgaaagtacagatattttagtgtgcatacacacatacacaagatctggagtgggcaagactagaactgtgaattaccttatcattgaatcagatgagcctgaaagacaatacctgtaaacattttacagaccaaattaaattactagctcaacaaattaaataaccccaaataataatattaataataataaaataaaaggaaaaaacattttgtgttaaccatttgcaaccaaatattgctgtcaaacatgacatgtaagctaccacaaccacaccacaccatcttagtcaccagtcagctgacctcacacgatgaaatgaacccctctaaaatcatcaagctgctagtaaattatacatgaaaatgggttgcatggcacataatatgactacgatggtaactaggacaatcaccagcagttaatgtcaaatccaacaggaatccattcacgtaaatactgctgaaatttaatgggggctaattgataaaaaaaaatgttccacagggcaagcttatcaaataatacatggtccattgctaagatcaaccatctcaaatttaaaaagagtcagagggtaaggggtaaaatctgatggtcaaaaaaagtacttttaagaagcatgcagatgcaactatatcaggaatatatttcacattccagaagatctaacaccatgacaatcactccttagcactcaatggattgtatacaatacaacgaaaatcttcaatataagccctaaaactaatactctgtgcaatcaaacccaaaattccaattattgatttgaacccctgaaatattgaatttgatgtaattaaaccattcaggtttaggcctgttaatttgaatcccactgtgcacctttactactaaaactgtaaactatatcattcctactaatctacaagcaagatgagcaactgaagttcgataactaaacaattgtgtagccttattcaagttatctacacaaaagcccaacagcaaattgttgaacatgagttgcagaaaattgatctctaaggtcctgttcttttcagcttattcaccggattgctgaaacatattgtttgttctatgcttcgaaaaatacttttttttctagaaaaaaagtttctgctactgtgttgcttcgaccacttattttaagctatttattaagtttatttcttcaaatatttaatttatcactataacctggtagataatctgtggcaataatccacaataatctaaatcaaatcgggaagcacgctagacagtttcagtaatagtttgtgactgtgtccctattcaggttgcccatgttgacacatatctgtagttacatcaccagtctgttaatcatgtgagaaaagggtactaactaaatatatccagataacaaagagctaaaatgaacaaacagaatagttgagagctcaaaccaacagaatagagcttaaagaacttgattgcacagatttgaatagttggggacttcaaatcaacaaaactggagttggactttagggtcttgatcatacacttgtagtgctattttcccataatatatcaacaatattgtgtgctgaactaattctgagtttcaaaaaaaaatagcactgctgacctagagctctttcatggatgatgaatgcgatagaagaccaaaatacttgacaaacactaaatttagcgagcgaagtaataccatatccaactaccaatgcgaaagccatcaatttgggcatgaacaatggtgtgatgtcagtctgggagaagatgctacataggatggtgtggaagagaaagaaagcggagagagaaggatgttgtatcttgattagcagagaggatagcttaataaaatacaatcgctatgtataccatctatagagtcaaatcattaattatgcaaatctattacagataactactaagtagacaacctattgtagaagttgtctacatataatctattatgacgtagaacgataatatagacagcggctgtctaaactacagttcatgctccgaagaacatttggatatctcagaattatgacagatttagaattacagatactaaaaacaaatgcagagcacaagtaactgcaggagattgaaagaaagaacacccataacttattatcgtggaataagaggctaggatagatttagatgacagtattgaagtggggcagcaatacgggaacagaagtcaattttaagggatattgtcaaggaaaagaaacatcattgtctagatgaatctacaagaacatttcacacaaacctgccagtaggatcaagaagtaaagccctgatattgtcagtgtgccctctcaatttcattttctttgaaccagtcctgggatcccaaacgcgaacaacctacactaaacaggtacatataaggaaatatcacaggagaggtctctcaaaagcagtccaaagaaattcgcacattatggtgcctcctaaccccaaggaaacttgcatactcattctcaaagatgaagaacataataccttttcagtaccaccagagacaagtgtgtttcctgtgtcactcatggccaatgcataaactgaatctttgtgacctttggcagtgattggactgtacccatgtgattgcccattggtggaagcaaggttgctgctagaatttacattgcacaaggttgtcaaagcaggcccagagtttccattaggagcttcatcctcttttgcatctacagatttggccacaggagcaagagaagaatcaaggtcccatataaagacctcaccgccaaggccaccagaggcaacaatattgctctacattgcagagaataaaaaaaaacatgtaaaacaaaagggataaaatgagtagttccacagaaaagcatagtgctggataatatacatttttttcagatgcagcaagacaaatcacataatcggaatgctggcggagagtcctggtacaagcaccatctgataaacaattccacacctgtgaaacaattaggaattaaaaaacatgtggatccaaaatgaatatataaaaactgctgaaacaacagacctttagagtggtgtctgaggaacaggaaacaagattttggccaacaataatggcatcattaacctgcatgataaatatatcagcttaaatcatagaaagtacttcagagataatgaaagcgtccatgttacaaaattaagctcaaatctcctcaaggatgagtttctccatcaatgatagaattccatccgaaactataatacttggatattgaaaactatgtagtcttctttccatctgatcctcttttgttttggggcaagatgcttatacatctttattcaaataaaagtggcaatggatcatcaaaaaacacgataatggataaatgttgctatggtatgcgtcatcatgtaactttgggctagtaaaatttcaaaacgtaatggtcaaataacaatattaaatcgactggagtaaaaacagagaaacgcatacccaatcaacatgtgactcaaaagttgctgagaagcttgcgactccattttttggttcccacctcttcaaggtaccatcccgactcccggtaaaaagataatcactcgtaccagaagtagaggcatttaggtatgacaagcagttgatcccagcacaatgctgaaaaatagacacaatggaatgcatgatgagacatttgcactgaaaatgaattcttttgaatcaactggatgcatccgcgattctgaggatagctagttctggaagtggaactgacctttttgttatcagcgtcattcagcacatatgtaaagcgcttctcctttctcggtcgacttgaacctgccgtgttaccagcacttccaacacgatgcattgaaagatgcctaatttatctaaaaccggagcagcttatagcctacaaatcagtggcatagaacttcaattttactatagatgaatatatatcaagccaagctgcaaatattcagctattgaaaaattcagcctgtatagttcacatgctgataaaattcaaaatattaaggtagaaataatcctgccatcattttacacaaggtacccccaatcagggccgaacctaacgtggggcatgggggttcagccaaactttttttggaaacaaacctaacctgcagctagtagtactactaaggttaataaggcaaagagaaaagcctccggatccaaaaaagaagctaggattaagtctacgagaaaaaggatgcgggtagtggacgagtaaagaggacgtgtcgtcccaccggcgaggatgcgacagacgaacggacgccggcgacgctgctcgccggacgagatcggagttggtgggcgcaggcggaggggccgaactcgtcgcaaagggggagatcgactagggcgcagtgccagttacgcttgccgctatacggagatggaggcttggattcgattccccgatatcaaatcaaacccccccgaaaaaaaatcctcgcaatccgagcagcaaagtcaagagcaatcggcagcagtccccggctcgagatggatctcaactccacggcgaggtcggcagcacgaggaaggggaaggatgggggaggagaggagagtaccgtaccttcgattcgacggcgaggtggcgcgcggcggcgaggcagggaggcggagggatcaagcaatcgccggcagccgcgcctggtaggggaaggggttgaggcttgaggggaggaagacgaactgacgagacgagagagagggctgaggggtgtggttatatgcgcacgataaatttacagtgaacgtgctatcaacgggtgacatggcaaatagcaatgttatactcatatctattgctattgatctctttgttgtccacgaaatttattgatctctctttttctaataatttaattagataatataaactactatgtgttaggcttggtaattgctgacatcatataatggatggataatatagccgtccatgatgtcaaagctaattgaatatctttttttttcttagtctatttggcttgagctctttgattgttcttgggagtttcatacaattttagctccaatataaaagtcaaaaatcttttttccaagaaatgtcaaaagtctatttaaactacaaatttgtctcatcaaaaaacgttaataagctagagtggcctttataactaaagcgagtgaaaaccacaatgtttgttttatttgttcaaggaaaaaacccagctttataatataaccaatgtaatatacggacttgtaattcttcttttagttagactcttaatgggtaagttttcaactaaaatgatccaaatggtattattaattcataatatataaatgatttctaagccaaaaacatacataagtccactgaccacctcctccttcctctttcctctgttctgaataggtcggctagagtgtttcatttcactagctaccgtatttcttaactttttcaagtttctaaataggtcggttacagtgtttcgtttcactagtttactatatttcttaacctttttctagcttgtaattttgtatcaggactcacttctatattggtgtagaccaagtatgcatcccttcctctgtatataaaagacgcagtgtgaatatattgagtatattcatatcactagcactcggatatgcacactgtaaacactgcttctagttactatagcttctaccagaatcagaacctcccataaacagtacagcttttgatccagattctgataagctaatccagaaaaataaactataaaccaaaagattctcaccagctgtttcttggaatcttaatctcccctaagcagggccgcagtctaggactccaggtacaccgaacagcccaataggggcacatgcatatacttgtgttgctcaggctgaaatactatcaatcacacgaaaaatccgttttacacagcacaacaatacgccaccaagaaacgaacgcgtaaagcacacaaaagacgcctaacacgtcacacaattacgtcatgttcgcgtcgccgaactccggcgaccgagcggagcaacaccggcgtcagtcacttcactgcccgcccgccccgcgctgctgccgccgcctcctggccgccgccgcggcgagcgcgagcaggatcaccgcgggccccaccaccatccccagcgggaacccgccgcgcctcctgcgccgccgccgccgcggcccctgccccctgggccggcgacggccaccgccccggttcgcgccgtctccttcttcccccgacgtgctgtaatcctcgctgtcactggaccgtggttttggctgctcctccggttcgccggcggctggtgtctcgtccgccgccggtggctcttgcaccggcgcctgttcttccgccggcgtctctgattctactggcggcgtctccggttgaggctcttgctccggctcggcggcgggtggttcctccgccgccggtggctctggctctggctctgtcgccgtcggcgtctcttcagctggtggttcttgcaccggtggttctacggcggccggtggcttcggctgctcgggctcgtcc

SEQ ID NO: 28572 - DNA, 232 bp, Oryza sativa
gggaggcctacgccccatagaaactgtctacctgagactgtcccttggcccgcgggtctgacacaaggttagaatccgagctcttccagagtggtatctcactgatggctcgggcccccttccgattagagtaggacaggcgaatattcttattcttatgggattccacggtcatcaaatgaattagtaataatttacattaattcacgagaagtgtgataagctttgaatg

SEQ ID NO: 28573 - DNA, 1114 bp, Oryza sativa
tatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggcggagataattcaggtgtcagataaatacaatagttctcttgtttattaaatgtaggagctggtgaatgggattacaatttcccgcagaatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctagggttctgaa

SEQ ID NO: 28574 - DNA, 975 bp, Oryza sativa
tcatttgttccttcctttagataaatactcaaaatccccttacaataatgcaatttcgaagggaccttttccctcgtgttgagaaaacttttcttcttccaattcttcttcattcaattcatttcaaaaaattcaattggtactcaaaatacttccattggtatgcgcaagaaataagccaattcggcagctttttgttcaatttctcgtggagtaaaaaacttctcatcagtacgagtcaagggaatggccccctggccccggatttccatataaaggatacgacgaggaaaaagaccttctttaacctgaattctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaagaatttgttgagatggaagtacagatataatattcttaccaagataactggaagccccaaccgctaagaatcctagtgaacctagaaaaagaatacaggcccagaaaaaattacctctttttcgagaaccttttagaagttctatccatatgtgttctgatcgccaattcatattagatatactaacagcggtcgattgaaattgagagaataagctaaatgatttttgtcacgtcctgataaattcatcccgaattaaaaatcattctctaaaaggaataatagaattaattaaaattcgaaaagaaattggcaaacactaaaatacgtacaagaaaaattccaatgtgacccggagaatttttgttaaattaaaccttggtctaaaaggagccctcaaattttagtggaattttcagagcacaaataataattgagaagaaata

SEQ ID NO: 28575 - DNA, 727 bp, Oryza sativa
gacgggttaatgtgagcttatccatgcggttaggcactcttcaaataggaatccattttctaactgtctttcgtgctttggtgagtcgtccgagatcctttcgatgacctatgttgtgttgaagggatattatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagactatgacaaaaaatcgattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgggtattgataagacccgtcacaatttcttgaagctcgatc

SEQ ID NO: 28576 - DNA, 926 bp, Oryza sativa
  unsure (1)..(926): unsure at all n locations
tatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcgaactgaaacatctgagttgcttaaggaaggaaaatcaaccgagaccccgttagtagcaacgagcgagagcggaacaagggttttcatcaaaagaaatccgaagcggtttcattcgatttgttgtggattggatgatggaaaaaccagcaagcagcaagcgtaggctgtgttgccgtagtgcgccctacggagttgtacaaagtcagcaaccgttttggggcgcaagcataggcaacacaggactgatgacggggtggggcgcgcagtgaactggttttctaaaaagattggaagatccggccaaagaaggtgatagccctgttcattcgttcccatggttcgatccttcccagtaaaacgcggcgtgttcgaatgatgatcgcttttacgcgagaaagggggaccaccctataagcttaagttannnnnnnnnnnnnnnnnnnnnnnnnnnnnnnnnnnnnnnnnnnnnnnnnnnnnnaatcggggagtgcaatagagaacctgagatccgatgcgaacaatcagtcgaaggagcggagcgcgggcgcactcactctaacggcgtacctttcgcatgatgggtcagcgaggaaatgggaacagcggcttaagccattaggtgtaggcgctttccagaggtggaagatttacgttcttcctattt

SEQ ID NO: 28577 - DNA, 7515 bp, Oryza sativa
  unsure (1)..(7515): unsure at all n locations
aggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatatcacattagatagatatcatattcatggaatatgattcactttcaagaaatatagtgaaatcgtctttcccattctaaccaaggatatatgtatcaaaatcgctctaatacggtcccgaatatgcaacggatcggcgtttttatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaattgtatggaacaaaaatccatcttggctagctattcgggaggacttctccatcggatcagaacatgaattgaagggcatacttagtagatgcagatctaggtactcattcttcctcagatggggaatgggccaagccgatccgttgttggcactgaaagtgcatttgctagtttgaaagaagctgaatccgggtgggattcaaaatgattcttatgtttcgtagcatgcagcgcagactcacttggtaaatagccttccctaaaagaggcaaggtgctcacacatgaaattccctttcttcgtgcactcatttactagatagtcaggaaccttcttttgacttgaccagcttacttgtatagtatagtagtaggcctttgcttctgaacgaccttacgaatggatcaactagaaatgaatcggtgtcataaacgaatttagctaaccgtagtagtaaattgcgtgacaccaagcaatcgatcaaagccaactcaaaagaaagcccatcccttcatccaacgtgaaaatattctcaagaagaagccaaaagaaagagaggtgaaacagagtagagagaatcgggtgcttccagtgattagttatcagaaagcactgttttccagatcggattcgatcacagtcccataagcagtagggaccacgagtgagcatgagcctatttcgtgatcggctagttgctcaaaaaatcgtataaaaatcaagcaagaaaacgtatgcgctttagcaacaaagcgctcatcccttgttctttcgcgctagttgctcaatccgttgcttgcttctcttctgtcttggaaaagtgaggatttcctatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcnnnnnnnnnnnnnnnnnnnnnnnnnnnnnnnnnnnnnnnnnnnnnnnnnnnnnnnnnnnnnnnnnnngagcggaacaagggttttcatcaaaagaaatccgaagcggtttcattcgatttgttgtggattggatgatggaaaaaccagcaagcagcaagcgtaggctgtgttgccgtagtgcgccctacggagttgtacaaagtcagcaaccgttttggggcgcaagcataggcaacacaggactgatgacggggtggggcgcgcagtgaactggttttctaaaaagattggaagatccggccaaagaaggtgatagccctgttcattcgttcccatggttcgatccttcccagtaaaacgcggcgtgttcgaatgatgatcgcttttacgcgagaaannnnnnnnnnnnnnnnnnnnnnnnnnnnnnnnnnnnnnnnnnnnnnnnnnnnnnnnnnnnnnnnnnnnnnnnnnnnnnnnnaatcggggagtgcaatagagaacctgagatccgatgcgaacaatcagtcgaaggagcggagcgcgggcgcactcactctaacggcgtacctttcgcatgatgggtcagcgaggaaatgggaacagcggcttaagccattaggtgtaggcgctttccagaggtggaagatttacgttcttcctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagttcattaaagcaggaaaatgaaaatggaaaatgttttaatgtttgatgaccagcgtactacttgccacggtcctttgtttgaaagtcagtgagtgagcccatccgtattgtcttcatgccagaatgggaactaagagctgcggcttttgatcccgggaggagcagaatggctatgtgccttttgtccgtcctcacctgtacacttgtgtgattagactcccctactttcctgccagaatcggttgcctgaatacctttatcctcaccggaaaatagagtctacctttttcagttatcaaatcgactagggatagcctattgatgtgaagattaacttatagcatcagtacttttattaatcctcgaggggcgaatggcggatggtcggcaatgaaaaaaatagcacttcataggtgatccgagaatagctagagtgaaagttttcctaaagacgcaagagcttgatcgctaggcgggtcggtagaatctatggaccgaaggttccacgctacacttacgaaggacaaggctattcgaaatatgtaagtcggcgaagtcaaagagtccttttgaaggggttgtgcagaacacttacttttggtttatgagcaactgttatccgctgaggccccccatggtatgcggatattttccattatttggtcactaatgagctacctgcaggtttgtcaaaggctaaaagggaaaaggcgcgcagcggtgaagcccattactctgtatgggatgatccttacctttggtggcattgtgcggatcaggtgagaagaaagaacttccgataatgaaagaaggccttttagcaggcaactgatcaaaagctattcctcttagccctagtagccctagctatctaatgcatactttccaactggccctggcctataacggcaaatcactggcgcatgacttgaaattgagttagttagagagcattaattacatcacaaattccacctagggattcctctataaaaaagagtaatctttttctttatgtaactagagatgtagcgacgagccagcttggatgtgacgagcaagtatttataattacgcatgaaagctagtgtacagaaatatcccgggggaaaagaataagtatgcttcacctatctttcaaagggcatgccaggtaataagctagaaagcaagtagcccaggaggaaagcttctaaaaaagagttgtcagaaaagttagcccgatattgaatagttgcttggttaaaaacaaccaacactatacagagcatacagccggcatttgaaggaaactaaagaagcaagaagaaggacctttctggcgcttgtagtatggccctttcttcacatctaattggtctgggataggtgcttgacttaattacttccagcctgatagatggcgttcattttcttataagcacctctctattcaagatgcattcaacatgggcagcagattaagtgatttattattgtcccttcttctagaggaggtgatacatcatattgtgacagtccatattccatgctttgctggtgagaaagataaactacttaggatccccgacaaccatgacatcttctcaacgagatccgcttttgatgttatcagaaggccaacgggtgattccactctcctcgctagcgtcgatcggtattctattacgaaagagcctcttcttccccccaggaagatgggcataatcatattcatttcattttcaggcgagctctttgcctatcgactacgcttgccgtattgcttaacggcgtactctattccgcctacagacaagtcctatacttagcttccttatttgattattggtcttgttgttctcggaacttgtgcctaaggctctcactcgcgatactcaccgggcgatagatagtcacctgagccaagaaagtagatgaaattgagaatagaatgagaatgggctttcagctttcatagatctttcctctcaaaagaggtgttacctaatccactatgtcctttgtttaatactgcggtaacctggaatttcaaaccttttttctaccctcgccacttctttcgctgaccctatccacctcctttgcggaataccagatcaagagatgaattagcggatcacagggctaagtcgaagcatgccagaaccttctttagtagtgagccgtaccgactagctcctagcaagggcttcaagatcacagtaatgcttgccaaaactttccttgggtacgaatgtcatgttcaaagcaggtttctctagacaccttggaaaagatcactgacgagctcaatctcaaagtgtgaatgaaattatcagtttcatcctctttatgagcctgagatcatatgggtcaacaattctcatttcttagttatagaaagcccttctcaaggaagtgagccactcaatctgagccagcggattctcattcagctgtgccggtgcgcaaagcaagcacgcttagacaacgatgtccaatctttggtctgcccattaagggctgactccgctaggcaagaggactactactgggattattctattactaattgatgacctgggctcttctttctccactacagatattgactgacctgttgatagtatagcgggggcagtaaagaggaaaggaggaaaaagaagtagagttaggttctgttcttgtgtgtaagccctcggtcgattcgtctgctcattcgcagcgtatgattcttatccaattgcttcttctgaaaacgcggcgtcggttaatctttcttattctcccttcggggctcctcatgttgctactaatagaaacagttcggaccttgctcatacaatcctcgggactactattggttaatctttgtcctccctagggaaagtaaacaagacgagactttttgggaaagacagggttagcgccctttggttggcggaagcgagaatcatcttttgattttttgaagttcaatttctatcagaggacaatatgaatattataccatgttccattaaaacactcaaggggttatacgatatatcgggtgtagaagtaggccaacacttctattgacaaataggaggtttccaaattcatgcccaagtactcatcacttcttgggtcgtaattactatcttgctaggttcagttatcatagctgttcgtaatccacaaaccatcccgaccgacggtcagaatttcttcgaatatgtccttgagttcattccactaaaatacctttgaatagcgctgaagatatcattgctataaattgaaagaatagagtgagatttgtatttgaactagctaaggcatacttcactgaactcctgctttccagtctgcgcttcgcttcctctcggtcgagtaagattcccttagctttgatttgcttccatctttctaaactctgttgtctcggaaaagaaagtatcatgttgctcctcggaaaacgcgtatagtagtctcattggccaaagtaaagtcgatgggacgctccagtgtatgcgttactgtactgggaagctagcattttattttgtcatggcgcaaaagcagatatggtccggtattcccttgttccccgtattggttatgttctttattcctcgtctagcagaaactaatcgagctccgtctgatctccctgttccgcatggcatgaaaaaaccaatcaaatcttcgtttccttggaaaaaccgaggccagttgagatcagtctccctttctaggagcagagcttaaaaagatgggaaattccaatgaatttcgatcacaatcatgtggtaataatgggtttgaatcagagagactcgatctggaaactcctcaatgattataacgtgaactcgttgaagagaaggagacaagcagaaatagacgctttttttgaaccatttgagagggcgcagcgtatccgtttcaataactggcagaacggaatagagttgttagatggggctgaatggaggaacggcgatatagttatccctggaggcggcggaccagtaatttcaagccccttggatcaatttttcattgatccattatttggtcttgatatgggtaacttttatttatcattcacaaatgaatccttgtctatggcggtaactgtcgttttggtgccatctttatttggagttgttacgaaaaagggcgggggaaagtcagtgccaaatgcatggcaatccttggtagagcttatttatgatttcgtgctgaacctggtaaacgaacaaataggtggaaatgttaaacaaaagtttttccctcgcatctcggtcacttttactttttcgttatttcgtaatccccagggtatgataccctttagcttcacagtgacaagtcattttctcattactttggctctttcattttccatttttataggcattacgatcgttggatttcaaagacatgggcttcatttttttagcttcttattaccagcgggagtcccactgccattagcaccttttttagtactccttgagctaatctctcattgttttcgtgcattaagctcaggaatacgtttatttgctaatatgatggccggtcatagttcagtaaagattttaagtgggttcgcttggactatgctatttctgaataatattttctatttcataggagatcttggtcccttatttatagttctagcattaaccggtctggaattaggtgtagctatattacaagctcatgtttctacgatctcaatttgtatttacttgaatgatgctataaatctccatcaaaatgagtaatttcataattgaataaaaacgaggagccgaagattttagggggcgggagaaaaggtcaagtctaagcgacatatggcacgaaaaggaaatccaatttcggtaatccgaagcccaccttaccttaatccattttcttgaggatcttgcatttgttcgttctctgccgacctattgtttccatcactcctgttgcttcttcctttctctatccaacccgagctctatcgcccatggctgaactcttctctg

SEQ ID NO: 28578 - DNA, 5265 bp, Oryza sativa
gaaggaagtaaataacaacacttcagcgtttaggtctaccttcagtaaaccaatagttttgcagcattggaatttgagttggccaggtaaggtcctctaaaaagaaaagaagaaactacttagaatagataaatgccattggttttctcgtactatacgatctttttttgttttgttttttggccatgattgtgctgctcctgtgaaggctagtgggaaagctcaccgttcgttgtgatgagtgggggccttgtatctgtattcggatcagctccttaacagagtttcctgcttgaaccctggctgggagctgggagaggtgtcccactacaggtgcaaataaaccatttgaccttacaggggaaaggaaacaaaccactcaataatcggtagaaattcctcctactgaacagctttccttttctcgccttaactactacttcaaagcaaggcggaatatcacgggataggaatgaaagaacttcttactcaactttctagctatataaaaatagttagcaatatgaaacgagtaacttaagccctagtaaaaggctactctttgaatcccctctttaaggcatataaaattagtactcttcctgagctagcttaagcatatcttgagcgagtgagttgtatttccctccatcaagttctaagcgatcaaataaggtccttgctctcgagccaatgccaataccaatagagagggtctaaacgaaggattcaaaggaggttaccggttaagggcaaatgcaatctctaagccagttggagaagaaaggtaatcaaagaaagtttcagttggacttaccctgccaaccctaccctaatttcataccctgcggttttcgttcctctattgatatttcgttcctctccttacgtcgagcgacctggattattctgagcacttcgcacttctgaaaatcgtataaaaatgtgtggttccgaatgagataacgcgcaacggctttcgcgctagttgctcaaaaaatcgtataaaaataaagcaatcaaaaggtgaaggcagggcagtgggcgtgggactgtaaatcctttttcgttcgctgggcctgggccctttggactctaaatccaaacggagtgagtggttcgattccactttagaacgaaagcaaatgcaagtgaaacgagacgagaatcaaagatttttcagtgccgctaaaaccagatctggaaaagtgttcagtgcatcctaatctgaatctgcgaaacctttctattctaagacggctaagtcgagggcagacacaacaggtcccgaagaggttcgaaaaggcgtacatgagttcctcctacataaggggctcattggttgtcaaccaagtgagaggggtctaataaagctgaaggatgagtatagataccttcagccgagatcgcttgggaggcatagccgcctctaccaggagattctctcttatttcttaagaaagtatgaattgccatagaattcttcgaggcctgattcaagatctgaagtatgaattgaacattggttaaaaagaagagagagagatggcgatggcagtctctctctctcttctttttaagggatattattgacaggcaaaaaccgtttttgagaatgataatacttcatggtgtatgtagaactcaacatctcagtaatttgcttctcaatttcatctttaagggctggattatgccggtaattacttacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagtccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgttcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagctttttccctgacttgctgcatcaaaaactaaatcacaagcttctgataaaaaacgggtggttctagcgagatttgtaatatgagtacctttacgctttgccgagatgtaaggggccattttaggattccatttcttaataccatgaccaaaatgaactcccgcttctatcatctctttcaaattgatgttccaatatcttcttgtcattttttccacacttccttttgattttttcttttttttcatcctacctttccattacgaaatttctttcttttcgaagattaagaaagagccgaaatagcttgaaataaataataattgttccgatggaaccttctacatggtataagcataaccttaatgaattaactaaacttctttttaaattaaaataaaaatagaaaatctaacctcttagcgttctaaggtcaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagttttttttttttgaatttcgaaataaaggttcttgtcttgtgggtaacggtgcacaaatttttggaatccggtaccaacaggtataatcccccccagaactacgttttctttcaggcctttcaaccaatcaatacgacctcgtaaggcagcttttgctaaaactcgagcagtttcttgaaaacttgcttcagatatgaaactttgggtattcagggaaacccttgttattcccaataagattgcccgataatagatcgattcatccaaagcccgccctgctcgctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagagatacgactttgggctatggttaactcagctccaatcaagaatccccaaggacccccaagaattcttggtatacgctcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacatacattttcgcaaataaattgtccaagtgat

SEQ ID NO: 28579 - DNA, 3114 bp, Oryza sativa
actatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagccccaaaaattttggaataggaattctaggattcgattcttttaccccattgggattttttgaattcttaaaaaaaccaattcgagaacagttggatgccgacaaaaccatcaaagattggtattctttatttcgattcaacaaggtaccaatagcttcttgatgttggctaagtgattgaatcttcgccttggaataaaaggaattggtattggtgcgatctaacctattatggagaatcagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttttactataataaaccgaggtaaaaagatacaaattcttcctgttcccggtaagaaatatagtgaaatcgtctttcccattctttcccccgaccctgctatgaagaaagacgtcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtattgtatcgaaatatgaatcttttttcttcctattcggcaaagattactatttcttctttatttgggtctgtctcttgaacctcttttgcttaggttcaggcgatgtagtggacaaaaagagggaaagaaaatatggcgggggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgattctaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaagaccgtttcagcacttttagctccggttcgtgaaggaccagagaagctttctagttatgaatcgggtatagaacccatggggggggcttggttacaattccgaatacgctattacatgtttgcgctagtttttgttgtttt

SEQ ID NO: 28580 - DNA, 1295 bp, Oryza sativa
aatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactaggaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggt

SEQ ID NO: 28581 - DNA, 1724 bp, Oryza sativa
gcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaacaaaatatctcaaaaaatgtctataatgatggactgaaaatacaagaaattcgcatgttctctttattatgttttcgtatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaattttttgtggtacttttagtagattttactctgtttatcctttactttaattcagttttaatttcgatgtattctgtaatgtaaatacaatgaaattaattgtgtaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagcttaacatggtggttaaccgtattatgaaagacggaaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggactttttggagattggatgcagttactaattcatgatctggcatgtacagaatgaaaac

SEQ ID NO: 28582 - DNA, 10801 bp, Oryza sativa
  unsure (1)..(10801): unsure at all n locations
gctcctacggaaccaaggtcgaaaggattgaaaaagtcagtcattctcaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatagcattaatagttgagtctgaaatgaattttctcaatgtatttcatttacacaaaattacttaacattaaagacactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttagtttttttcagaatcctatttttgttcttatacccatgcaatagagagcgagtgggaaaagagaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtttggcctaatgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccggaggagaagttctagatacttttccgaactttgtatctggagtacttcatctaatttcctccgcagtcttaggcttcgggggcatttatcacgcgcttctgggaccggagactcttgaagaatcttttccattctttggttatgtgtggaaagataganataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttagccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggggccttgagagttcctcttgtggtagcaagttacttcgcaacctgctcaatttggccttatagggtcgggaactaatgaataaaaagggttggataccgcccaaccacccagccctctaccatatctagacaaatagaatagtccttttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgagaaaagaattgggtttccaccgagctgaaacaatatgctgatggttctagtaaaccaaaactaccgttttttagctatttggcttccatttccttttttaacaaaagaagatttagttacgattggaaataaatttttttgtatctttatccatagatcctttactcatattttaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagagcatataggcccgagaccattaccaaaagttcttcccaataatcatattgggtatctgttcccttccttttcctattaggatggggcatgttggattttccatatccatataccattacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggacagctatagaatctggacccatcgtagagacgttcaaaaggctcctgatgataagaatcatactttcacggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcagaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggtgcattcgactaggtcgtactttgaatccaatttcaagttcgattagaaggatagaaaggccgcgaggatcggaaaagaaaaatcaaatctttttaattgcttctccttttttgctattttcttattatttatataatccattcgattcttttttttttagaatactaaagtattctaaaaaaaagtattctatactataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatatggatcttttgtagtgtaagtaatataatatggtatgttatgtggctctttctacacacaaatgcaaacccgctatggatggggattatggatgcggatataggctacaagcataaatgcatgcatatgcggaaccgggtatagcgagtttttttaagtggatcaacaaatactttttgaatagaaagtcaatgtattctaaccaattattttacaggagtatctagttggcgaaggcgatttcagaatcaaaaaaagtaaagtcaaaattgtcgcgaccgggaaaattgccttttcccgaacgctagtgtattaatccccgtcccaggaaaagccggggtacaccatacaaacatgatataaaagacacatctttattacatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggcagatgcatgattaatgcaagggggtacaaggggataataatataggggttaagttttgcagtaaacagcatttaaaagtcacttagttgcccaaagccattttataaagacgatcctagagctatacagtattattaatcacggccatgaaccctcacgaacctgccttaacccaaggcctatgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaacccatcctagccataaacaagagtaccgacccaatcctcctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattctaccataaaccaacaattccatagtgtccaaaagatatgagaattcccaaagtctaaagttataaaaccacctaatgttgtcctattaatcagcgaagcatctacctaaattcatactagtggaaccataaatagagtgtccactagttggggttttgtttattctagggtgaacaaggtaataataacaataacaataatagtatggtcataacaaaggtaaataggcatagctaaataaaacagtgataacgcgggaatttaaataaagcgataatgcattaatttaaattaaaaaaaataattttgtaaactgggattcaatatgctcaaggatgatgtgacttgccttgctcgctttcccaaacgacggcttcgacttccacgaagagcggatcttccgaagctgcagcgtctacacgaccaacggaaaagaaaagggcttttactctactaaactccacataacagcagaaacaaagcacaaaaatgggttcttgacttcttaaggaaaaaattagagacttgaacggtccaattccgagttcaaatggccaagatatggccatttgaagtttatatgctctttaaatggatatttgcgaatttcttcatttaaattttaattacaaa

SEQ ID NO: 28583 - DNA, 1230 bp, Oryza sativa
gtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaagccgaatacgcatgtacaaaccccccctataggaatacgcaaggaaataattacaattggccaaaatagataatgagggtcatctccatatcattttgcatttctcgacaaatataatctgtttggctattctaagtggttctttttttctgggtaaagaggaacttgttattttgattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgtgcgagagtctccgcccttcttccactccgtcccgaagaataactaagaccaattgagtcacgttttcatgttctaattgaacactttccatttatgattaaagaagaagattgttcttttac

SEQ ID NO: 28584 - DNA, 2356 bp, Oryza sativa
gatctgtttatcataaagagattcgttgttcctgaccctgcttcaccttaattgttatcgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctagggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctggatttatttctattcctatttagctgggcaattctagtttttgttatgatgatctcatggatagtagtatttagttcttcttttacattcagattggtagtaggttttcagatagcttagcccttgatatgatgaaatttctattggagaagacgggcgccaacccgaaggggaatgtagctatgctggacttctttctactagctacggtgctacacctgctcctagctacgatgctgctcctgtccgccccttgatttatcacccctttggtcttttattggtcattgatttatagacgggaggataagtaccctggctcgagcccagatatcgatttaccattcctttatcggatctccgaaacgggaaacaagaaaagtaatagaaatcgtgtgccagcgggagatacgaaattcactggtttttactctcaatccacaggtggagatacctggggtgggttttcatggcctatagtcccctgccgccgaagcacgaactacttgaaatcgcggatcggcagcttcctgcgacattccttcaatgcaaacgtggtatttttctaccctttgatagatagcaagcagctcctataacttgatcgacaggacccaaccaactaaactattgattttggcaaagctagaccttttgaggaaagcagatgcagataacgaaaggaagctattagtttttcttgtactcgactcggcttttctttactgaccgcttgcgtaaggaaagttgacaataggaaaaccaggtgagaagttttagagcaaccgatgcctaccgtccggcgatgtccctaggtggagctggcttaccacattccgatacctcggaaccttcccttcgtaaatttggaataacgaaagtctcaaccgcttgctggcatgccaaaacacttattatgtttatgtgaagtggattcatcggaagagagaggtaaagcattttaatttcttcgcttttgagcagtaagtatttcgcaaggcggcccaggggtcttcttcgtttaaggggcagttgagc

SEQ ID NO: 28585 - DNA, 2887 bp, Oryza sativa
tgtagatcttgccttgaagcctcttcacagttgatagcatcacctgcgaggtatcagccttgcccctcatcattctttgagaatcataaggacccattccggtagtgcgaaaatctgctgcactgtcttcactgccaagctctagtaatagaaaatcaaatcaactatctaatcgagcatcaatcctaggaattttctcctcacggagagagatcagaaagcttggcaccggattccgaagtaccagtaccgaagaaagcaaaagctttcgagcgagcagcgactccaatgtttggtaaagggaatgaccctagatactcagtggctggaaaaacacatccatttgctcgatttaacgaaaaagcgcacaagtcacgctcgcctgttagaagtgattttaggaggaagttggattggtattttctactggatttgtgcctatagaccaaggataaagtctctctcgcatagccggaaaagtaagtacatagtgtagagggaaagaaatagaatctcgtgtcgacttggaaatcaatagtaaatcacaggcagtatgccctattttaaaacatgcaatgagggtacgagcaacactccccaaacttggcatgactcatcgccatcttgtattcatgatcttacctcgccttggtcacaaatgcatagcataggatcgagtggatcggcacccaataggccagattttcctatctttgatggtggaagaagaattgcgataaatattttcttatgttccacactccttacactacttggaaagattactccaccatgtatttcacgggtcaagctaaaatgtggttacaatctgtagaaaataaggtagagagtatgaattgggatgagttctgtgactttgtgtgtcttaggtttggtaaaagatgcagtatcaggcactgatccggcgcttaactcatgtgaagcagactggatcggttcaggactacattgagaatttcaagaccctaatgcaccaaatgctagcacacaacctcaacattgatcctgaaatattcactactacttttgttttgtggatgggttaaaataagaaattaggagagtagtgcttattcaacgccctgccgacttggatactgctggctctcttgcattacgtgatagaaatgaaatgacagcagccctcgctgaataccgttcaatatccgttattagacaaatcaagactttgagtgtatcggtatcgataagttcccgtcccgatatccctgggttccttactattaatggacaagttggtaacattcaattgagaggacaagttggtagacgcatcccactctctttgggaaaagcaggattctagcttgctcccttaagtctaagaaaaaagacaagccctccgaaagtaaaatgagctgactagaccagtaaccatatcttatcggtcatcctattgttgatgaatcaaagcgagatcagattgctcttgatgacgagggttgaagaggctttctattgatccacctactttcaactgaacagtagttagttaaggagtgccgggtttgcttgataagggattcttgttttgactgctacattaagggcaacgcaactacctctcctgctttcaattgctaaggcagtagagatctgtttaagcgagtgctatgatggttgtccaactctagaccttacgacaaagaaagagccagaaaccatgttttctcgacttctaatgagcgctttctagcagaactatctatcaaggcgggagaacgtagtatctgccatttctgtagcgccctgaccttacctcgaaaccagctacctcttatagctacctaacctaatccctagtacaccatctatctctgcatccgggctcgcctccactcttgttccgggttgatgaatccaactcaagaaaccatacctacttcctgctttcgaaagtgcttgctttcccttcgagggtggcctccactcgggctagacctcgttccggtcttaccctccctcgagtccgatctcgggagggcgcttgggcagggcctattcccaggtgcttgatgacctataccactaatcacaactactttacttattcgtcaaaaacctattccccaccaaccaagattattattcacgcacctacgatccctttcttaaagaaaagaattattactaccttcacatggagtgaaagggacgcagttcagaaagcaggcaagaaacgccttcctacatctgcgccccgctaaaagctatcgcaccaggtagaacagagacactcgacaaaagacgagcagcagcccgtgactgctgcctctgttccctctcgtactcgatcttctggcgttctccctggatccagggatgacgggatcgatggaacccggggtgggttcaaaatggcagggacttgcactgcaggagcaaggggtgcatccgcgggttgagcctgatcccctgctggatttggtaaaacattctctccgtcatctaaaaaaacagtctctaaacaaaatttataggtaaacaaaaataaaaaaaaatgaaaatccaattcgttgggggaacgggttccacgatgaatcatccccctattaagaaaccaaagtaataataatgatacgaaaatcaaaaggagaaggaaaaaacagaaaggcaattctaggacgctgggaaaatgaaaaaagattttcccgaaaaaccgtgaaataaatagtacaaaaaggtgattcatcttacaactttacaaattcgcttgatcgggcctgacctggtcgaccagatcaaactatttcacttatgatctggcctggttgacccaatcatgatattgaaggatgggaccttttctcaaaggttggaaagttccattcgtttagtacgagat

SEQ ID NO: 28586 - DNA, 5180 bp, Oryza sativa
caagtgcgaagaggataactgctaaaagcatataagtagtcagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcctgaatttggtggttaaactctactgcggtgacgatactgtaggggaggtcctacggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtaggatctgaccgtaccaccagtcagttagcagccgcccgttctacctctgagctactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaattactactctaaaaccaatatagaatcttattaagattactattaatcttaaacttaaaccaatatagaataagtagtactgaagcctcttgggcgatgtagggcaaatcttactctccaagacgtccaccttcgtgctcagttcctgaaatgcagctcccaattcatccaccttcttctccacaactggaatgcgcgcttccacagtccgcttgagatccagatactccgcccgagtgcgctcatccgcctccacgcgcttcttctcattcccctctacgagttgcagcaggagatccagcttcttatcagtatccatggtttactacttgggaatcggaaccaattcgttctcactccgaattccgcaaacctggggtggcaagtttccttttcgcggtgtcgatccaaagatcaactccaatccgccccaaggaattttaccgcagaatcaagaggattgagagaacaagagaggctctgataccagattgttaggatccaaagagcaagaacaagaacacacacgcaatgatagggatttgacaactaattggtagtctattgctctaatccgacaggattaagccttccgccgccttcgccgcctagttgccagttcataccatttcatcttgggttcccctgttttatacaagtatcaggtacattacccactctctctctctctcgaattcgcatcacacacgcaacagccagctgtacagtgccaactggattacacagcccattcaggcccatggtaacgggggttgggcttcatcgttcttgatggcctaactggcacttgagtattggtctgaatgtcctcctcctcatcttggcgccttatgccctcagagtcttgatcatcagtaggttcttcatcagcttcaggttctccttccttctcctcctcttcagctggaacagccatgtcaggtaggcacctgacaatttcgtagagacgcgctgcatcgatgcacgcattgcacacacatatacctggcggtacatgacacgtaggttgtgatcaacctgttggttgtcggtgaaccgtggctccctcccattgtagtccagatcgatcagcttcggcggcacgtgccgcccgttccgccggggatcgaacaacggtgaggactggtcggtgtacatcgccggcattctcatcccgtccggtgcatcccagttccagaacggtatggcgaaggtgggatcaccgatcaagctccccaggatccgctcgaagaagtagagatagcacctatggaacggcatgaacagccaggagttgtgcacctggagatccagccccgggaacccgtcggggctgtacgacccgtcgcagtaggcgcagtggacgctcgcctgcgccgcgaagctccgggggtcgtccgccggcagcgccttcatggccgcgatcgcgcggttgaacttggcgacgtagtccgcgccggcggagtgcgcggcggggcgcgtgcggagcggcgaggacgacgcgtcggcgggcggggcgaagtccaccggcgaggcgctggagggcggcgggcagcacgtcagcacgttggcggacggagggagctggtcgggcgggccgcaggaggagatgtcgggcgtcgcgacagggtcggcgccggcgcggcgcgggaacgacaggaggatgcccgccgccgtggcgcttgcaccggccgcgccgagaccgaggaggacgtcccggcggtcgagcctagaggcgtcgggctccgcgggagacgatgtgcacgagacccgtccgacggcgccgcggcgaggcttaaggcaaaagctcgctcctggagaggaggggctcggtgatgatagagagcaggtgattagctgggagagtgatgccatggccgcgcgcttgggtcaaccgagcgcgatggtgatcggtatagctctcttgcaaatcacgatttgccatggtacggtatatataaggcgagcgcacgtctgtgccaccgtgccacgcgagcgcacgtgagcgaatgcatgcgcgacagcgcgttgtagggagatgcgacgcgcacgtgagagcgaacgagaaattgaagacggggatcacagcgtagcccgtagcagggagcgcacgcatatatccctcggaaaatgctccgcatgggggagtagctgggattcgtcggtgtgcacgttgaagatttgttatcagctgtcactaattttatgcatatcatataataatagattaagagcttatatgtaagagtgaggataatagtaagtcaactataaatttatatggaagagagataaataaaaatgaaaaatattggttctcatgcaaatattacaagacattttcactaaatttatagagagaaagatgaaggagaaatatagtcaaccttatagttaatttattatacatattagttagctatactattaaacttgttctaattgtctctaatttataatctctaataactctaacactctataacactctcatatttttattgaagtttgtgtagggattatccctttcatgaggaatgtcaatttctctctctttcactcttcttttctccatctcaccattcatgaaattaaaataaaccccaatgataatcatatttgatttttaaaatcgcaatgataataaaaatgagaggcagcgggcgggtcgtacatgagtacaatggcagagccgccgatgattggtgtgacttctagaaagtaaaaaaaaaattccaacgatagttatgttcgatttttagaaccctaatgtccccacgttctcatttgttctcttgttctcataggtttactggtgattccattcgcaatggtaggagtcccttgttttttttgtttttttttaaaagtaggagcacaaaggtacttgtagggtgccacgatagagggattttggactatttgttattctcttcaatagtaccttcttaaataccgtctttcctaataattttgattatttatcatcgtgattaccaaattgtttatattttaccactttacactaaaagaaaaaaaaacctcactcccctcccatctttcttctctctctttctctccgctcttcttcctctctgacgtgggaatcacaggtactgttgcaattggatgtatggcgtgagccttcgggatttggtagtgaggtcatcgatgagcgaagatacgccgagtccaccctgaccatgagcgagatacctgtgttggtgagggagcatacaacttgacccatgccggctccaacgcctcccccgccacacctccgtttgcgtcgcttctctcaagttcacaggatctatacgagatagagagcctgcaaccaagatgtattgctttcaccccaacgacccatccgacgaaccatcaagcattgttgcgtcgtatatctcgcccgtttagctgcccagttcatcctgacactagccattcctactacttggcccatgctagagactggtttcatgtcatatcgcagagaaagaaggtataaagaagatgaatgacaggggtaataaaggttatttccttgttgtttcgctgaattgtcagtcaaaagtaatactacctccgttttttaatagatgacgtcgttgacttt

SEQ ID NO: 28587 - DNA, 16368 bp, Oryza sativa
cttccccgatgcgtactccgtcaagcccaacactgacaccttcaacgccattatcaagtccttcgccgagtccggcaccacaaggtccttctactcggtgctcgatgaaatgtgccagaagggtgtgaagcccaacgccactacgtttactacggcgattgctggtttttacaaggaggagcggtttgatgatgtagggaaggtgattgagctcatgaagaagcacggttgtggtgagtcgctgccagtgttcaatgttagggtccaggggctgtgcaaacttggtcggagtggcgacgcaaaggcattgctgaatgagatggtgaagaaagggacaaagccgagctggctcacttataatcatttgattcatggattctgcaaggagggggatttggaggaagctaagcggctatacaaggagatggcaaagaaagggcttgttggggatagtagcttctattatatgcttatttattacctttgtaagggtggtgattttgatactgccgttggggtgtacaatgagatagcagccaggaattgggtgccgtgtttttcgaccatgaagatgcttgtgaatgggcttgctggaagctcaagggtcgatgaggcaaaaggtatcattgagaagatgaaggaaaaattcccagataaggctgaagggtggaaggaagtagaggatgctttgcctcaatagaatagcagatggacgaacttgcaggtatttttcagccatctatacatacaaaaaagatagttaggtgaaacatttgctttgctttaatttggctgcatattctgttaggtttcacaagatttcctgtttcacttgtcctttgtttcattgtattgtcgttccatgtgtcacacaagctactgtacatctgaaatgattcacaatgtcaattccagttcaacttgtggtaaagtgatgtccttctgaattgagatcctctaacttacttcccttcgacgccagtcactgaaatgtgtaccctctaaccaacgggcccacatgtctgtgactcaaagtcaaagggaagtaagtcagaggatcctcttccatttgagagaagtacctgtcgctacggttttctcttttaatccatttagatgaaagataacgcttgaataaaagtatacgtcattgtgccctttttgtttaattcaaaacgatctactcttgataactttgttcctttcatgctccggtgtcgtggattgagcttgttacatgtgactagaatcttctttgcttccatcatgtaaatatattcctggtcataagaatataatgctaacagaatcgttttataatctatacaccagcaagaaccctttatttttctttaatttggtatattcatctatattagagtattgagaccaaagggcattggtgagagcattgcttatgctgacagttattacagtaacaaaatggttttatttaatgatatcattggactgtttaaggactaagcaaatccaagtgcataaatttagcttatgaggtcgattttgttttttttttttttttgttcctagatccaccaaacaaatacatcaactattcaaatacagtataagtctaaatgttgggactttgtagataaactcccaataatgttcaataaataccttgagcattttggctgaactctagtaaaactagtggtttatttgagaagaaaatattgtttcaagtggaagttcaaagagatatattgtatctttaatttgacaatgatgagttgatgccaacacttgtatttgattctatctattatgatttatgaaaagaactattgatacaatttgctaccttcagctaatctatattaaataccctaatgttgtaatccgagatatatatttgaactgatgatgatgaacatgatcatacttatacaataaaatgtggtgcccatacccatcttagctattatttctttggtgctactgttccattctgccaacctttcaatttgtgcatatctttaagttcgtattaactgtagcataggtgtaatttagttttgttttttcttcatgttacatgtttgactacatttggtttgtgatgccaaatggcctgaattagtcaaaccgaaatagtctgtattttccagaaaaaaagcaagcaactttatttttaatctatctatattacttgagaaattactatattggaggatagataataactagtcgcatagttgaaatatggatatgaaatagtgtcaaatctgctggagacgatgaagtcttctgcacttcatccttgacttggtcatacaggatgtgcttttctggttccttgatctcacgaattctttatgcagtaatctggaaacaatgcaccgcaattttttcttgctagggttattttgtttttgtgagtattatatcatttcaacccttgtcaagctatttttcccttgttcctttttcagatgaacagtactggccattgattcaattcaatcgttgaacatgtctttttcagaaatcaggaacttcaccaacatttgatcgattgacttgagcagagatttgttacatatgctagttccagctatggcgacaatattttccgtctgggatagttgaggcgtttgaaagtactgtcttaagtcatctgccgaatatgttctggacattattatctggtatgctgttacaaattagtgtggttcaggagatcgatataataaccatacattcatacttttgtcatttttatatacctttttttagaggaatatcgaattccattataccactggtgcgacagaatcgccagacctggagggataccatccctaacgagactggtaaggtgaggacaattacatccataagcagccagatcataggctactttgttacagctaccaggacagtgattaacatttgaaagcactagaaaagtcctcagtgaacaatttatttcgtggagaagacctcctgttgcagccaaactgtattttgccccctcatagcgtacattaacatcatagaatcagttcccaactttacttgcactatacctttcttcgctgccgcatcaattccagccatgactgctatagtttcggcgtgaaaagcgtccatcagatatggggtttgcccggcttccgctacaatcaccgaccctgaatcatccctatgacataaccccatccaccatttccagtttgtggcatatatgttccatccacattactcttaatcttaagtgtctcctcatcaggtttcctccatttctgagttactgttttgctctgcttcattgcttacttttactcgaatcaccgaacccctctactcgtttcagcacagtcaagcctaggttgttggcttttctgctctcaccttctctaattctgggaaaaaattgcgattatacttatttttcaataatttacatttatatacctgtatgagatggatttgcaaaaatatacccgttccgcgggactgcgatggtcccgcagctccaaaacgcaggaaggaagttggcttgccacgaccgcaagccaatttggcagcgccgctgtcgccagactgttcgacgccctcatggttaggggtggacaaaaagctcgggctcgtgagctcggctcgggcttggctcgagctcgcaaagctcggcttggctcgaaaagaaaacgagccgagcccgagccgcctccagagctcgtttgtaaatcgagccgagcccgagctagctcgcaagccgctcggtaggcttgtcaagctggtgaaaaaatgaccttggcccattaacaattccccatcccaggcccaatgaaaaccctaaccttcccttgctacagaaactattccccttcccacttcctagttcgtcgccgccgccagtccgtcacgccgagaccgagtccctccctctgggcggcgcaaggagttgccggccgctggcccgccgcctccctcccagtccccagcagaagcgccggtgcgccgctcgacgcggcagcctcagttccgccagctagccgcctccctcccctgcgccctgcgcggctgcgctggctccggcctccctccccagccgcccagcgacgctcgaccccagtgccgtcgcggcgccgcctctctaccctgcaccgccttcggcctccctctcctgtgctacccgcgtccctgactcgacggtcgacgccgtccatcacctcgccgagacgccaaccgatcgacgacagttcacacagcgacgagcctaggatgaagaggttcgtgatgtattttctgatttttgagattcatttcttagtagctgtgtatatgcgtgatgaattgatgtgtatgtgtgcagtgtgtgctattatcaatgattcaatcacagaaaggttgaggcaaatagatcaaaattgttatacctacactaatatactatacttaattcgagccatatgttttgtgtagtaaatagaatctgtaacgcacacttgctgttaacttgctgaaaattgattgtactattgttgaagtatttacttgctgttgtgcatcacaagctggctcgagctggctcgagctttgaaacgagccaagccgagctgcattttttgctcgttctctttatcaagccgagccgagccgagcctgttcttgaccaagctttcacgagccgagccgagccgagcttggctcggcttgactcgtttccacccctactcatggtgcagcagctgaaaatgccacacctcgctcgccccaacccgttcgatcgacctcttccagcactgcggcaatgacgaggaggcggatgaaccgacgaagatgacgaggagctccagctacgggcgttgtagtcaccagcgttgcggccctctcacggcggcccggccctcgtagtcttccacggcggcgacgaccaggctcatcttgccccaacgttcttcctgacatcctcgccctcgctgctcacgacggcatcaacctggtacgtacatacatgcataaaccttcatggccaaggcgccaagtgtacgcgcatctccatggccatggtgttctgcacacgcacgtaactaatgtgcttcttttctgttgcgtgggagcagctgggaggtgtcgccgggccggcgcaactcgacgacggcgagcagtgacatcgtggcggtgttcggcaagaagggcgtgagcccgcgcgacatgacggggtcggggagatcgattcattcgaacaggaggattgatccaaaacctaaccattccaatgcgggaatgcgggatagtgagggcaattttgtctctggtttcatagttgcggtaaacaaggcggaactgctataaatcagaacattttaatagagttgtgctttcaaatgggggcctcaattttttgtgctattttctggtaccggtataacagccgtgccaccaatcgaattctctcttcatctttgcatttcttgtttcatgccagtttgtcgatgtggcccaaaggactaacaccgatacacatagttacaatttaaagaaacgttcgcatgaacatcggtttcaacttaaaacacaatataatcaatgtcagtcacatgaaatagaaacatttcatcttcaacacaatataggctttgtttagttcacaaacaaaaacttttcaccctatcacattgaatgtttggacatatgcatgaagtattaaatatagaaaaaataataattacataaattgcttgtaaattacgagatgaatcttttaagtctaattgttccatgatttgacaatgtggtgttacataaaacatttgctaatgatggattaattaggcttaataaatttctttcgcggtttactaacggattttgtaattagtttttttattagtgcccgaacaccctgtacgacactatatataatacccgatgtgacacgccaaaactttacacccctaatctaaacacccccataattagcgtgagtcacgtgaaatagaggcatttcatttcaaaaagaaaggaaaggaagaattatcttccaatcatctatgcgttgtgaagagagccacataatttgctgtaactttatttctctatcatgggcatggcgcataatttccatataatttgtggtggattttaagccctttaggttatagagattcatttgtttcctgtagttcaaatgattttgatttttttaaagaaattagataatatggattattatgttttatccctctacaattatcgaaggtcaaatttgatctagatatgaagaaactaagagtaataaatctacgtgaatgtcattgttattttttaatttgattttctgttttgtttttttatatgtagatcgaatttaaatttatatgtttgtgtatgcctatttatatggcatttttttttacagatgcggcttgtaagcaagccaagatacatcaatggagaaaccgaaaataatattaaagggcacacttttgtcttagctagttcgaaaggcaatcttgagtgatgaatgttgtggaaaagaactccaaattaatattagaatatgcagcaattcagcccaatgttatttttttatgggtgcatgattattcgtattaaataaatgcaactgtcctttatcttacggcgttaaatttggttctattttatcaaattttactatagctccgtgcctccttgccttcttggtaattagtgcttgagcatgacaaatattttgaaacaaagagagtaactactcagtatcaatatatccacaataaaatttctacttgtatatactactccatacttataaagaaaatcgtttaggacaatgtttaaagtaaacattgggaatataaatcatgaataactctcaagttgctgagtttgaaaatgtaaaaattatatgtatagatttgtcttgaaaaatattttcataaaaatatacatatatcacttttcaataaatatttttataaaaataaaaagttaaaattgtattttggagatcatgtcgctgtcctaaacgatttctttttacgagtatggaggaagtatatattttcacattccattgtattctattctcacgcctccgatcctaacctttccatgtcttggcaccaaagtcacagtcacactctcatcttgctcggcacctaggtcctttaagatatcattcagtgccaccctcatggtggtttgtacccctctccgtgtcacattgttttgcgtgttgtgatgccttaaacacacaaagctcccgaccatctcccgtccacatggctcgattttcttgtgctccctagcattgacaaacacatcaaacttgcacacgccatctgtctggatgtgctcgaccaccagcacctcctcttgtgttgccccttttggctgtctccacaacattagcggtcgtctcacctctgcggtcaccacattgccaagggatactggaaacatgacgggcttctcgaccctgtttttcactctgtacttcacgttgggagtagtgggtggccgtgcatccaaccatggtaaaccaacgccacgatacgtgtatcggagcttgtccatgtcgagcacgtcacggacggtgatgcgcacaagacgggcctcctcatcgtagaagagaaacgaggagtcgagccaatcagggtccgtaaagtcttcgcctttgccattgctgcgccatacatcccacagccgatcgatgttagcatgatgcgtgtagaagatcgggtcacgaccagcggcgtagtaagctcccatatcctcggcgttgggataagacaataagtcgccaacccaaacatgcatcaagttatgtggttgtagctccacggttcccgcacctggcttgctagcctcacctgcacgaaaaggttggccgtggaataaggaggccaacggcgcactgctaatcatctgaaaaagaattacagaagttaatcattttgacaccaaatggttactcacaaatatatgcaaaatattaagatctaatatatgatactgatatttgtagtcgttaaaaaatacgaccatattatatattttattatttttagtaatttattattagaaaaaataatgatcaaatatgtgctgcctcaaagatcatgcctatatcctagcgacaacttaaaacataattatatctcgatttttcataactttgcatatattggtaagttaagaatttaatactcctatttgtttatatttttataatacatcattctaggagagtagtttttttaaaacttttaaatataactataatataattagagtgtaattacagtatgatttaacttatatatatgatccgcctataactaatcacaaaacacgcttggtgtggctggctaccaattaatgctcccctcactaaacacaacgtggtttgatggtccataaatcaaaagtttgcgccatgatgtttttttctttcctcctatcacgaatctcaacacaattttgatgtccctcctcactgcacgaatctcaaccggtcaacccgatctgacagttcacaaattggcatccctcctccctgcacgaatctcaactcgatctgacggtacacaaatagtaagtttttttttttgaggggggcttgcaagaaaaatatagcaattccgtttatcaatttttctctcctccactcaccaaacacaacgtggtttgatggtcataaatcaaaagtttacaagtaaatttcataaaactacatatactttgaccaaactatcttaaaaaactaccgatttaaagcattatatcataaaactatagattcagtgtaaaatttatcataaaattacagatttaagatgaaagggtcacaaaactatagattaagttccaatttaattacaaaactgcaacgtttatagcttccacatgattgcagtcttaggtattgtagctctgaaatccgttgttctgtgatatctcgatattaaatactgtatgtagttgtgtgatatttgactttaaatatatagttttctgataaatttagcgttaaatatgattttttatacaacacattaaatctatagctttgttttgtgaaatttatttaaagtgtttttagataattgatagaaatccggcttgtatatacataagtggatacacacaactacaatcaaaatatttacactactacaaaagatgtcgtaggttctggtttgtaagggtccatatgtgttggattttcatccagcaccaatagaagctaccgacacctatgaggaaaatagaaccgacaactttaggttcgcatgagcccaaaaaaaaaaaaagtcagccagctcaaatcgagctgaactcaccaaccatgttgccgtcgttgtcatcctgctctatccgctatcttcaactactatcatcatcctgttgtatccgccatcttcatccggcatcgtctccgtcaaagcccagtcccgccgccaccgtctcccacctatcggatccgaagacaaaaacgaagaggccgaggggcagagggagagaggggcgcactgctgtcgttgcgtcgttgctgccatcattgtgtcgtgccccagccatcgttgcgccgtgccgtgccccgccatcgcaatgtcatgctgtgcgtcgtgccaaggaaacggctgccgcgcgcgccatgccggcgatgggagagcgaaaactgataaggttcggccagtggataggcgacatgttttttttttgtgaggtgagtggataagcacaggctcggctcggcttataatggatgcatttttttttaaaaaaaagcatctatagtttattatatgtgctggttttttttaaaaaactcgtaccattattatgggtgtaatttttttaaaaatcaggtaccaatatataggtgctattttttttaaaaaaatacctatattataagtgtcggttttatctagattttttgttctataaaggtgaagagcggtaataggtgtcgttttaaataaatcgacgcctataactgagtcgatatctatgaggtgttctgtagttgtgttagcaaaataacttacgtaacaaatctatcaattgataaagaaacaaaggcatgcaacaagaggaacggactgccgtatatatagtgcacctgcttgtacatgatccagaggttgtgctttatctgctcatcgtcggtgtagttgttctccacgacgtccatggcgtaatccaggtccacgagcttgggcggcgcgtgccacgggttcctcatttggtcgtacagcggcgacgacgcgttggcaaactgcagcggcatccgcatcccctccggcacgtcccagctccagaacggcaccgcgaacccggggtcaccgagcagcttcccggcgatgcgctcgaagaagtagaggtaggcgcggtggaacgggaagaagagccaggagaagtgcacctggacggccagctccgggtggccgacctgccggtacgcgccggtgcagtaggcgcagtggatgtgcgcctgctggtagaagctgcgcgggtcgctccgcggcagcgccttcatcagcgcgatcgcgcgctcgtacttggccatgtactccgcgccggctacgtgcgccggccgccgcgtccggagcggctcgctcgggtcggggagcgtgaaatcgattggttcggacgtgggcatcggcgggcagcattggaggtcctccgggaaatctggaccctccggttttcggcactgcaggaggtcagtgacaataggcccgcccacgcggccggcgttgatcttgtcgtgaccgccgtcggagagcaggggggtcgagacgccgtcgtcggcggcgcaggagacgacgtacgggtctagcccggtgacggcgaggagggcccttgtcagagtttgggcgcatgggttcacggagactgcaggcgaggaggtgtagacagcggcgtaggcgaaggcgcaaacgatgaggacgaagagcgcaacacgacatcgctcgttggccatggttattgcacgagctgactagcacatgagctcgaaaactgtttgctcaagcaacagctgcatgtagtactttattatcgattaggagtgtgtatatatagaaacatgtatccaatgacgtgaaactgtggacgagagggatcgagcgtcctggtcctggaacttggattgctcatatatacatggccacaaacgaaaccaccaacttggcttaggcctgtttagttcctaaaaactttttctaaaaacatcacatcgaatcttctttggacaaatatatggagcattaaatatagataaaaagaaaaactaattgcacaatttacatgtaaatcgcgagacgaatcttttgagcataattagaccatgattagccataagtgctacagtaaccaacatgtgttaatgacggattaattaggcacaaaagattcgtctcgcggtttccatgcaagttaagaaattagttttttcattcatgtccgaaaaccctttccgacatccgatcaaacatccgatgtgacacctaaaattttttatttcaccaactaaacatgcccagttcgctgctcattctagaagtggggaacgtaggcactgtacatgcactgttacagttactcttgatgggaacctaggcactgtacttttgcaccgttgcacttactcttgatgggaacctaggtattgtacatgcactgttgcacttaccgttgatgcagacggcctgggatggcgtcgaccacgccgtttggctgccaacaaaatccgtcggacgcaggccacggcgcgggttgcgcgaggctgccagccggtgcagcacaagtaaatgcacagcagcaaatgctacacgcacatgcggatgaactcacccgggttataatgcaatgaaaaaaaataagtaatgaaattaaacattgatttaatttcatcgattttatatggcttcaatttcataattgtgcgatgtaaattcttaaaccatttcattagtctgaggtatttgttattaagaaattattttttgataagattcgatgagttctaccaatatattgagaagaaaatgattattttcgttgccggaaatattactagggtaacaattatgaagaaatgatttatcacacaattcacacaaaaataagtgaatcaaatttattgtgaaaccgatgacataaatttataccctcttccggtgctactatgaaaatcagcacacaaaattgacgctgtgctgtaattttgcaaataatatgaaaaaactttgcacagactaatacaataaagttgctaccatgacatttgcaactaatatgaaaaaaatatacacagactaatacaataaaggggctgctatataacagaatcccgttttcgaacgggatgatcccgagtaggtatcaggtgtgatacctatcaggtatcagacgattctacgcaacaggatgatcccgagtaggtatcaggtgtgatacctatcaggtatcagacgattctacacacgtttcaggtgatacctgcaaagtatcatgtgatacttatgaggtatcatgcgattttctaccacgtatcgtgtgatactcgcgaggtatcatgtgaaacctgtcaggtattagatgatttcaaccacatatcgcgtgatactcacgaggtatcatgcgatacctgtcatgtatcagacgatttctaccacgtatcacgtcatactcgcgatgtatcagacgatttctaccatgtatcacgtgatacttgcaaggtatcggatgatacttactaggtatcaggtgattcctactagatatagctgggtatctcgttgtgggaggagcaccccgacacgtgcggtcgccccctgcagccgtcccttgtagacgaggacggcgacgacggcggtagaggacgggcgtggcaacggcggcggtagcgggggacgggcgcggcggtggcggcggcgtcgacgggggacagacgccgcggcggcgggggacagcgacagcggcagtgggggatgggcggcggcggcagcgaccggggacgggcgcggcggtggcggcggcgtctacgggggacagtgatggcggcggtgggggatgggcgtggcggcggcagcggcgtcgatgggcgcggcggcggaggcgacgggggacgggcgcggcagcggcgggggacacgaattgtgttgtggagaggagctatcccgttgagggacggtatcccgtcccttagcattcccatacaacaaaatttgcactgttgctactatgaaaatcacggtacaaaatttggcacgagactagcacgggtccacgagtctcgtcgtgtttcacgctgtctgaaagcatcggaccgcgcgtagtacgtcaagaggcgggcatactactaccttccaacaggcccgtcgctggttggggagagggataaatgcaaagatatggacacacggttcacacgatgcctccgctccggccgttcattaggcgagggggagagagagagggggccatgcaacgccctctagcaggagccccgtgctgcacatggtcattccgacgtactcggtactatgctagacagctggccacgaaattatcagcgtgtgacaggcttagggtctgtttagatcctatcaagctgtttcactgtgtcacatcgaatgttggaaacatatatgaaatattaaatatagacaaaaaaaactaattagatagattgcgtataaattacgagacaaacattttagcctaattgcttcatgatttgacaatgtagtgctacagtaaacatttgctaaatacggattaattaggcttaataaattcgtcttgcagtttacaggcggaatttgtaatttgttttgttattagactacgtttaatactccctccgtcccaaaatatagcaacctttgagcggatggaacagacgtctgtctagattcatagtactaggatgtgccccatctattcaaaggttgctatattttaagacggagggagtacttcaaatgtgtgcccgtatatccaatgtgacggcaaaaatttttacccctgcatctaaacagtcttaattagtttttcttttttaagagagagccttaattagttacattaattagttacatgtacatcttgtgtatttttagacaatagaaactttattaaaactaggtcaattacattaaaataatacaattatactgagcccacttccaacctctacatcaagacacccacagccaaaaaatgacacccacaacaaccaaaaagagatgcggaaatataatgtttaacacctatcaattcacacactagattgtcactcatactcatggctaaagtattcctgtgccatatggtccaactgtccaactattaagagaccatcggaatatgacaatagtgtctcaaagtttcagcttatagaggacagcccaacaaacgaagccattgcgtaactaaggaaataacttaaaaaaaaggagaagatccatttctttttgtaaaaaataacttcattcttgcataattaaagtaaccaacaaagagttgttacaccccattaacaaatttcaaaaaagtttccgaaaagccggtgaacatacacaaaaacggagaaaacaaccatggaaaaaagttgaaacacacttaaaaaaactgaaaacatactataatagagtagaatggaacgtttaatccatcttactagatcccgttgcaacgcacgagcatatttgttagtgagaagaaaattccgaaactaccaaattttggtagaataacattggtaagacaatgttttgtttgttaccctatcaaaatttggtgaatttgataacaccaaaatttggtaggtttgaaattgataataaagtgaacatgcccacttctccatataaaaaagtgaatacaggcagtttccggtccaatctcaccgctgcaaacgatggccataaaattctccatataataaagtgaatacaggcagtttccggtccaatctcacccatgcaaacgatggccataaagcgtaactgctgtgttcatgcagccaggggattatggatcgtgcctcaaatcgttgattagctagcatgagtcattcagtcttttgtttacgatcagatttcaaattttcaatacaacaaagtacatacattttctacatgtatttgtcaattactatatgacgaaagttatgtgaaccctacagcagtgtaacacctgtagcatcaagggtagagatttactgtacattcacgcaatcataatcttccttatttgcggaagttgcttcgtagtaacaacaaagaaaacaattgcatacctacagactacagtgatatgtacagctaaagtacagactaaaagccagcatatatcaaaatgcaaggcgtaataatgtgtaacagatcagcaatttcgcggtctgttataattcggaggcagagaaggacacctttcattcatgtgagggtacggctgcatggtgttgtatccaggcaactccattcgatacctgccctttatttggcagaaggggagcttgacactgtcatctttgttgcaccacacgggaagccgtgtcatattgttctcaaaaaagttgaggctgtaagcatcttttatctgcatggaatttaaggagaacatatttttttaccagaagttggatgcgggcaattaataatgatcaggaaatattcataattcaaatcatttggtagtgcagaatggcaatatgccaactggtagactagccttccactatgagtcaattactgagcatatgatatagttccatcggtgatgtctgaattaccctagatctcatggaagccggaatttaagcataaaccacacaagaaatcaagagtacttacggtgaattcagtaacttctatagagctggcaattgggtcaaagagtccagcctccttgtacatcataaggacgtaagccacacaagaagcagactggccatcagtatagacccacttatcttgctcaggaactgttagcaatttgtcaaatgtcatcccacgcttctctgattccactatgatttcaggtagatcaagaccctgaagaagatagctccattataagtctatccagaaaaactcatagcattgagcacaacggagctataaagcaatgattttctgtgtatatagaaactcatagcatggagcaccttccactgttagaaattggatatgcgacaaaagaactaagagaattactaactaatcaactgttgcaggccaatccccgtatcataaaataggatcccttggtgtgtcataacccttatatatacccaggggacgcttgagtaaatgagaaattctcatgcagactacgtcttatcaaaaataattgagggtagtttta

SEQ ID NO: 28588 - DNA, 5455 bp, Oryza sativa
  unsure (1)..(5455): unsure at all n locations
ggatacttccccctctagcctatgtctcagaaagcagcagtagcaaacaaaaccatgcatttcctccacagcatcagataaaagaactacagatccagattactgtagcttcaaagtgtcccaactggctgctcactctaatcggtatgccagcattcattcccaaacatgatgaagcaactgtttgatttgaactaacagaacaagaggaaaggtaatataacccccaaagactcttcagagagcactgagctgctgatgaaccatgaaaaataaatacaatcaaacaaataacaagcgccaattgaaacaaaccttagttccaagccgtttgttaagggcttctttccacatgttggcagcatactctggttgaagtttgttccacatagtcatcacagaggcaacctaggccaatcgtaagattttgttactacaatcagcaaataaatctcaaatgcatagctcaaccttgcaagcaatccttgctatatctggtattaaaattaatccactaggtatgcagcatataataatctataactctaagcaaccagcctatgaaaatatatggcgataagatatagcacacttaataatataagcgttagcaaaatgctgttggcaaaaagtgatattgatcataccacatgagcatctaatggcggtggatagttgtcgcttatggtatcaatccaactaaaaatcatattgtggtacccataaggttttccatccatgctttttgcatattcccaagctgctgtctcattaaattttgcacgcaaatctggatgcaaaggtagtaatgcaatctgaggattggaatcatccttttttacttcaaagtcccaccattcttcccatggcaagatagcaataatatcttctccctgaaaaattaatgcatgttagcttactgttgctgaaataaatacgcctcacgccaagggaaacatcacattagctttcctacggtatataactagtaaaccagacagaagtatagaacaacatctgacatatcagtggtgtcccatgtttcatcttcaatggttgatgttaatacattctgttagagcaagaatataaaacattgagtgaattgcagtttgggccaccatttattaccaaagtttcactttgatcgccccccatcaatcttttcacttcagaccgggtaatcttgccctttttgcactatgaaccaccccagctctcatttctagcaaaatctagtgtctcctctggcaaagatgtggcccgtgtgtaagtgggggagattaccggcatgcaggtgccgatgtgcttaaggctattgatgcgcttgatatgagactggtggtctaaattgcaacaaagggtgaagggtggcccaaattgaaactttgtcgataaaagctagcccaagctgtaattcactctaaaatatccatgttacatttgaaagaatcattattgggttaaagaaattatcattgtacaaagccacaggtattaacaatgaaagcacgagagcacaattactcctatccaaccgcagaccaaaattacataagactattactatccaaaagtggtctatcatgcatcctgcgaaaaatagttaagatgctggaacttttcttttcttccattcttctatattcacagtctcatgcagtcaatctgtcatattcaaatgagtaaaaaaaattacacagttaatgaccactacctgttcattctcatgaccagattccccaacccaaagctttccttcagaatccctgaggcaaactgcggtatggccagcataagctccagtaacccacttctctagggtttcaaaaccaccccagcgcccacgaatttttgataaaaccaaaaaatctccagagtggatatcgtcaacatttaattctgacacccaaggtttcggacgttcctcgaaggttgcacccatatgcttctttagaaatgcaagatttgaattctcaccccattgagtatttgtaaacagggggaaaacatcccaaagtgctctaagtgttccaattgttccagatggcatcaggaatatggatactcctttgcgttttacctatgttaaggtaaaagatcatgcatatgtgtatcaatgatcagaaatgctgattacaaacaaaagcagctgcagcggggacttacatattcatattcagcctcgctttcccattctttgaaatcaagggtatgctcacgacctacaaagtagtaatcccatgtaacacgatatggtgttgcaaacacataaaggtctatgcaagtccagctatgagctttgtttgtctgcaacaaggaacagtgtcaggatcaatagtgaaataagaagaatattcatgtgtagagaaatgagaaccttcagaaagcaattaacttgtattaagaaatcacaaagctctgaaaaaaggttactgacttcaatccaatcacaaaccacatgcaagacagcagaaaccatactggagtgggcatgtccagttagatgccacatattgatctaactaagattaggcatgagccaagttttgtgaattgtgatatgcctaaatagggaaacgaacatatttgaatgaaccatctactagtaccatctagtacgctgtacaaacaactctggcaccgatcgatctacactaagctacatgactaaatttaaatgtttcactgaactgaacgcaatcgaggtgataatctcaaaattacgatcaagtccagggttgaaactagcagactgcaacaaacaagccacaaatccccaattgcctccctcccttggggaggaagaatggttctaccgcctccggctcagagtaacagagccaacactgggacgcggggcttgggaccggcactcacctcgagatggagcgtaccacctccaaggcccccatcagtcccgttgtggaactccatccacgcccggttatcgtagaagcaggcgccctttcactcggcggcgcgggcgccgccatcacctggctcccgcgcgacgccgacgaaagacgggaagaggtcggcggcgccgcgcagcgcgaggcggcggagcaacggctgggccaccggccacggcangatagggaggaggtctcgcgggaggaccgtggctccganggccnccttcatgaacccccggaggaaggggcgctaggcggccaagaggaggactagcgcggatagggctgccaagagcttgaggttgtaggctcctcccatgaccgccgccaccaccgccggttaggtctggtagccctccgcgagtttcgcgttgccccgcgctggttttcttcccgtgacggagttctttctagtcgatgactcgtttgggtttgttcactcaggggcggacactcgagtaaagataaaatatatctgcattttatttcccaaggttgcttctactaatcggttgtttcttctaataatcccttgttgcttgcaagtttccgactctgcacgattgcacgaattgactagaattggttgtattgtactgcgtatttcgatgggctacaaggagtatcgccaacatattgcttagccagaattaaaacaagatgttgcttagcaatagcaatgttatttttgaacaacgaaattatcttccgtttctatataaatttggtgtgcgctaatataagaatattcatgtactatgttcattatttttttttctgggaccggcgtaaagccagtcgaagtttagtaaagatttagaagagactttaggttacaaatactcctacaacattaaccccacaaaaaagcggccccagaaactccagggttacctgcctccccgtcccgccgtccgggacgagcctgactaccccaatagattactgacgaatggggagcttgggtggcggcagctctaatggcgccaatacagtaaatctatgttcattatttcactgctatagttttcccttttccttttttttccgaggagtgttataagtttagctgacaaatacgatactgttctctaagtgaaaatcttgctctcaagagtagttctcccttctctatgacggtatggccccctgtttcttttcttttagggcccctttaatcataggaatggaaaaacggaggaataggaaaaacataggattctgacaggaatgcaggtataaaacagaggattggaaaatataggaaaaacacatgaatgaccgtttgattggaccacaggaaaaacacagaaatcggatgagagagatagactcaaaggaattttttctaagaggttggacctcttgctaactttcctccaaaatctctataggattagccattccataggaattttaaagaatagtataggattcaattctttgttttaaaggcttttataggaattttttccataggattgaaatcttttaaatttcctacacttttcctatagattaaaggggccttgaaaggagaacggtggcatgtggtccataatttgatttggttgatatttctattccaagatataaatacgtgtcccagtcataagtcactgagttggacacggaagaaggttcggaagcggaagtagctgtggtcaggcgtgcgtgtccttctcttcctgcagcacagccgggatgtgcattgactacagtgacagagaatcgggaaaacaaaaaaagaggcaaattttcccgaagtctgatctcatcgtcttatctcatacacgatctctcttctcgcatcaatgcgacttcggaagaacagcgtatcgaactagccattggtcacttgattagttgttttagcttagcagcatgagccaaaattgcacacagttggtagtttatgccgaaactgaccgtaccttgatgtggagcgtgccgcctccgtacttggagccggagtcgttgtggaggaccagccacgcctcgttctcgtagaagcaggcgcccttccactccagccgcgagccgaccgcgcccggcctgtccgacgccgccccgacgaacaccgggaagatgtccgacacgccgcggagagcgcggagcgccgccatggccgcggtccgcggcaggaggggcaggacgtccatggggctgaacggcagggtggccgcggcagcgcgccgacgaggccgtcgacatcgcgtgggccggcggagtagagcagtgccgcggcgagcgaggctgccactagcagcagcagcgcagccgcgatgagcgtgttgttcttcgccatggtgtgtgggaatgtgggatgcgccgtccaggggactcggggggtttcttctcaggaccttagtttatccggttccgtgtgaaaaacgagcagcacggtgactggaggcgagggtggcggtgtttgggacgcaaatgtgttgcactctgttcttgaattgaggtgtgattatttcacttcaaaattaaaagtttggttaaaattgaaataatgtgatagaaaagttgga

SEQ ID NO: 28589 - DNA, 5590 bp, Oryza sativa
aaagtttggaactaaataaaaccttggtgtggttttggcccgaaggagtagtaggtcctggtttagttcctaactttttctttaaactttcaactttttcatcacatcaaaactttcctacacacataaactttcaactttttcgtcatatcgttccaattttaaccaaacttctaattttgatgtgaactaaacacaccctacaactgaagcttcacacgaatttatcacccaagaacagtaatgctgctgatgcgattaggaaaggtaatctgcaagatttaaagacttgtgtttcttgagaacggggtatataaaactacccaaccgattgaaaccgattgaaacgattttatgcttgtctgaggcacgctgatcatgttatttgcccaaagtttcaatcggtcgtaacataatttcagtttgggactacaaaagccgaacgccatgtacagtttggtcggtggatcggtgcgcacgaagaatagtcgggcaccgtcaatttttcccctcagtataactgtaacccaaaactgattatccaaattggtcatggaatgatggaatcatcgggcatcaaaaatccctcgactggtatatactctatacgacgtcacggctgacgccttaaaggcaataataataatacattgatccgatgatccccatctatcactcacctatacagcccaggcgcatcgtactatcatagtaccacaagtctacaggcagcccaaacagcccaactcccagcacgcgcgcgggagctgcaatgggctaaaggccacaagaccgcaaggcacaggcccatgccccgccccctcgacgccgcttgtccgcttcacgtgcttgtgaacacgagaaagcctgccgcaacaacgatcgtcaggccaggcgagcgcggcgccgaatctatcgaaggcggtgcaacgtacgcttccgcgtccgcagatcgcggggagggaatcatcacgggccccggccctacccagaacacgcacaccgcgcgggatgagccgctcccggccctagctagcgtgcacgccatgagtccaggacgcaggctcaaaaacctggacgtccaactgaacactcccgcagttccgtgcatgtagcacccggcgccaatcggcgatcacgcgatccagtggcgatggtttatgtagcaccttcctacctggaatgtctctgtcggatcaggactcagcgctcgctttttggtgaagccaagacatacggagtacaccctccatcctaaaataaaatataagaaactagaattgaatgcaacatttcctagtcctataaatctggatgatatcacattcaattctatgttcttatattttattttgggatgaagggagtacgttcttatctcaggccatgtttagttgcaatttttttcttcaaacttttaacttttccatcacatcgaaacattcctacacacataaacttctaacttttccgtcacatcgttccaatttcaaccaaacttctaattttgacataagctaaacacaccctcagcctgtttttctcttccttcttttggagtgtgggccacaggcaagtttttgggtgccggtcgcgttcagctgtatcctgtagaaaatgcggtgcatgcagatcatctcgtgaagaagatgagaaacgaatagctgccaaaaaaagaaagaaagcaaggaaagaacagtcttcaccgtctgtagatttctatttgatatatagatgcaggtcataactttcatatgtatcttgtgtttggtctcaaactcatcgtcaacaaacaaaaaaaagtgcaattcccacagtggagcgtattcctcaaattagccttctttatacaattgtaaaatatctttacaatgatttcccctacatttatttacatattcttcgacttctttttgagcgcgcggatttttgtacatgtcctgtctgaacaattgatgaattaacccaaatgtattctagctatgcacatcaataagcaccgaaattaaatctggtgcagagtaaagaaaatgtggtcatggaaaagaaacatggaggaaagcgacaaacttcttggaaaaataatcaagcggcgacttaaccaccaagcttaaggcgtagaatggaactcatgactccacggcctccggaatgctctgcagggcgggcttccagtgcgcctccctgtgctggtcgtggtggtgcacctcgccggagttcatgatgtccgccagcagctgctgcgtggaccgccggctgatcttcccgtggccattcccggcgcccttgcgctccatcagctcgtgcagctgcctcttggtgatcctgatggtcacctctgccacgtgctccatccgctcgcggtggccatcgtcctccgacgatgacgacgccgccgcctcgtcctcccactcgtcgccgtcggcccacgactccacggcacgctgcgacgccccgcagttccccatcggtttctggcttgttttttttttccttgtctatgaccaacaacgactagatttctccttccgatcttactgctagcttagcttgatctagctcgatcgtgagctcgtgccttttcgctgattccgtgtccttgtacgctgctctgagatgggatatgtaatgtaatccaaatgggttttggagtctatttatagctgggaggttggcaggggagggcaggaaagagatagcgcctaccggggccaggtcagcgatgattccgcacatgacacgaaccaccgctaatacaattcgtccgtgatgtcacgtggggaggcgaatttccttggctccgacgtggcgagacggtcgtaggatagaagctaatcctcttgtgttcctctccacccggtgccggcctcctagaaaagctggacgaactggcgcgccgcgcgcgtggtgccttgccagtgacagtgagttgcctcggcgcgacgcgctggcaaaagcaatctacgctggcgcgacgcgcgcgccgagcccgggtttccatagaagcaggtcggttgacggttggcagcgcgttctaactgggccggtcctggtgtgaatgggctctggaacgaatcttgagaggcccgttcgttcgcgcttccgtatggtcaggacatgttccctctctcggtggagactttgcggtggcgtggattaggagtactggtgaattttgtcagggtatctggccacgtgttcgttagggataggcacgtttttaaaatttaaataaactttataatttagaggctatacctttttatttgttatatggatcttgaaatggatgtattggtgtaagcactaatctactcacgttacttggatttgaatagttttagtatggtttcgagggaactagctcaaaccgtataactcaacttttagtatgatttttttttgtgtgtgttctctaaacaactgaacaacttactattagatcgcattttatttttggcttatggggattatgaattatagattaattatcctaaactactaaacggtgtaattaaaaaaaattattcatcagcatttttagaaaacttccttaaatcaactttttaatatttctatttaatttattcatctgtcccttgaataatcgtcataactcggtttcatccacatccatcggctacagataacgggtagttcatcccaggccccacctatcttgtagcgcccgttccgtcgtggcgtctagcgggaaaactctctcttaaaaaccctatttgcgaaatccgtttctttgcttgttgtctagtgtccgtgccatctcagatctcaaatccccgatctatcgtcaagttcaatcctgaatccaaatccttcccaaatcaatccctccgcaaaagtctgattcgcctccctcgggttcgatgggccgaatccctctcggcccatctccccctccctccccggctctctctctctctctctctctctccccgctctgcccgtgagccgcgccgagccctcctccctctccgctctcgctgtcgttcccgccgatgccgcccaaatcgccgcgccgcccgcgcgcgcgcgcgcgccgtggtggccgaccggccagtcgccgctgccatcagtgcctgtcgcacctgccccgcgtctgctgcccgtgtcgccgctccactccaaaccgccccgccgtcatcgccatcgtcatcgacttggccccgcctctccccgcgcgtgcctccaagggacggaggcagagctccccccctctgccgcgtcgccctctctccctcctccttttccgcaaagcagcaaggaggcaagccctctttctctcccccctttttcccttttcccctcccgccagcgtcatcctccccccctcctgtcgccgttttggccgcgagcgccgagcgccagctcgctcccttgaccgcccaaggtcggtttccaaaccgacatcgccgccctataaacccaagcgcctcccttcctctttcccctcccaatcttccccgtttctcgcccgcgccattgctgtctctctcgccggccgccgccgtcgcgtgtgccggaggagccggtgcgcgttaggacgcagaaggggacaccgggcgctcgccttcttcctcttccccggcccgaggccggagagatcactcccgtgccgtcggcctctcgtcacagtgccccgcctcatctcggtagtgcattcccccgttctccctcctcgatccatctcctccccttagttttcggtagtagcatgtgtagccttcccgtagctagctggcgccgccccgaccgttgccgccactcgctgtgtgctcgccgccgtcgccgcccgtgctccgtagcgcccgctcgtcgccggcctcgctcggcgtagctccgcccaatccgacgctagcaacggattcccgtagccgcgtagatgctctcaccgccgggaatcggcccctcgtgacctcatcgccgtttcccccttctcccgccgccggttgccgccgccgcaatccaccgccgtcgagctccctccggcaaatccgagccattggctcgtctcccctcgtcctgtgcaacatcccggtgtgctcgccttcgcctgtatcgccatggttcgctccgccgctcgccgctgtcgtccgccgtccgttccggccggcgtcgtcgtctacctcccgccggcccgcgtggcagccacgtaagcgccacgtcggcgccacctcagctgcgaccgggtcaagcagaccccggtccgccgcttccctccgccccctcgcgcgcgcggtccaccgcgagccgtgaggctgcgcgtgggcccgccgcaccacgtcctccgcgaaccgcgcgcatgcgccgcgcctcaatccccaaaccctagcatgccccgcgtgcacctcgctcacggtgagccaagtcgccgacaagcgggtcccacccgggaccacgcgggatggacccggcccaccggctctctctcccccctccccgcccgcgcgcgcgctttgggccgccttcttgggccggccggcccattaagctcggccgagccgccccattctctcgggccgcgccctagccgcccgagggaagtctaatttccctccctccttcttttctt

SEQ ID NO: 28590 - DNA, 11216 bp, Oryza sativa
  unsure (1)..(11216): unsure at all n locations
gactccgttcaacttccaaaattcctcaaatctcgagatctatctaatggcacgcttagaggtcaataatagggctttattttcgccgtttgctgagttgtcccgtttcgcgtgtagtttcgaagcccgaagacccgcagtgcgaggatttcgaggatcaagctcaagatctcgagcgaggcaagccacctttgaacatcttgagcttatatttgaacttaattatgttgcttgaaaaatattatgcattgataggatcgcacttaatctgcttgtcccgtctgcaaggcagattggcggacctacctaatttgttgcatttcacccctccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccagggtggtgtcggggaggacccctgggcttcctggcatagtatggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcagatgtgaggtgattcctagcgtagttttgtttgactactgccttgtgaaatttgctgttgtggaatgggtttgatgtttggaaaatctgcggctgatgggatcagccaggctcgggtggccgtttgaaagctgttggccgggtgccaaccttgatcgattcaaaagactgatacattgcacatactccgaccggacgagacgcactgtctcatccgtgtcgtttgagaagcactcccttagttgtttcagaaaagagtttaaataaaatcaatcacaaaaacaacaacctttccttgaagcctgcattaaacacttatttcccatggcttgctgagtactcccgtactcacccttgctctatataaataatcccccccagttgctgaagaagatgaagcggatcccgctgacgaggagttcttccaggagcaagccggctacgatgagttttagggtttcggcctagttcccaagtcgcgcctgtgatgtttggtccaagtcttggctttcggttccctttgtnatgcangtgtgagctcgggatctgtccgcagcctaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacatatctgctgtgagagcaagtataatagtaggctataagccggctaaatgctaaagtgaaggagagaagagaggagagagagaggagaagcgggctataaacttacatccggcttggacataagaaccaaaaaactttatgagagagacaagtgggctatgtattaattgtaaagagctaactattatatgggtaggctaaaaaaaagctacaaagaaccttgtagccaataggtcggctgtattattagcctttctctaactctcgaatgagtgcatcttctagttcccatgatttgttaagcaagtgtgttcgtatatgtttcccaaaaaaaaaaaacgtgttcgtatatatgctttgcaaacggccggatatatacacagacctgttcatagctgttgtgattatcttcctagcatataacgcggagcgctcggcgccgcatggaaatttctgtcatataaagagacgaaatcttcgatcggctacacgcctagacctgctcgacggtggccatggtcctctgcatatatgaacagctcgattttgagacccgccattattgatctggatttttttttcgaaaattattgatctggattagttcaacttcaacatgccgtgcgttcacttcacctcagcataactttgatgcaggcaggacaaagaatgcttccatccattcacaaactttctcgattatttaaaaatttcaggtgttataggtccatcatatatcaatatatcatatatgcaagcttctgacgctggcttaaaggtctaatatttcagtacaaaaatcctcactgtctccttcggggtaatcacgaacaccgactaagtcttcgttgcattggctttctgaaaattcacgaaattaatttccttacccaatccacggtggattcttcttcaacgccattgtgatggagtgcaattcagcagtaagaactaaggaccaatgtagcctcaagacagtgtgtctctttcaggatgtcgatagagttggtgaagacttgatctttttgttgcatagcgaagggcgcgaggtcataccatgcaagccttggttcttggaacaaatcattgtagatatatagaatggaccaattcagtgtggaagatacagtcattgagctaacaaattaaagggccaaagtggtagtaagtgtccatttctgcaacagtgtcactttgactgcaattgcaaagggatggaaattctagttgggcatatagagccttcacttgctggccttattatagctataggtagtggaaattactttgcgaaggctcggttctgacctccgacttaattctgataaacaaaattacaaaatcacggaggagacgagcaatttttggctcaaaattttcattactagctgtgaagttcatcgtctctctgcagttcatcagtgatcatcgagacatctgaggccatatgagtacaaagttcagggacagagctatatcagaaatctgctcaagtaaaaaaagttccagcaatctctctcaatcagtctcgtagcctgtacatctccgaaagaatgacgatcaaactacaatatcttcctagctagagcaactatacacatgtggagaatcaatcaaggaacataaaacagtcctatggaatcaaaagatccactgaataatctatgactcgtcggcctccggtatgctttgcagcgacggccgccagcccgctgcctcctgctcgtagcaaaccttgccggagctgatcatctctgccagcaccttctcgaccggccgccccttgccctcgccggcggccttctccagcagctcctggagctgcctcctcgtcaccctgatcttcacctccacccgctccatcttctcgaccgccgccatctcatgtagatgctgctgctgctgctgctcctcctcatcctcccactcgccgtcgtcggcccacgatgcggcggcgcgctgcgacttgaagcagttccccatacacgcagaaattcagaactgaagagatgcgagatgatcgatgcgtgtatctcagaatctgaagccgcagagctttgctttgtactaggcccttcgctagagttgcttgacggtgctcgggttggtttaatggttgctttggttgcctccgtttgtgagagcttatttatacgtggatgctgggagaagaggaggcgttcagcgcgacgtgccaacttggacctggctggagacgtggatgcgtaggcgtggagaccgagtcgcgcggggcaccaccgagcagcattccatcgggccacgtggacggccgggacatcgagcgtgcctcgcggggagggcactggacggccgggattgggcggggggcgagtcggtggtggggacggcgcgagtggcgggcgtacgtggtgggaaagtggcgggaaaggggaatcttttcagcgcggaggaaggcctgccggtatgaacacggcttttgcaggggatctcccagcgtcgtcgtggtcgtactgatctcgtatggaagaactctttgatgaagccatcgccgttgggatcgggattcctctctccagcgccaatggtatattggtatcgccaactaaaaaaaaccgtgcatatttcggaacggcacttgagaagttgagatcaaaatccgtgccgtgatgtctaccggctacccgccgccatcacgagcagttttaaattgcacctctcgcctgacgttttcgcaggaaagaacgaaagaacatcaagtttaaagtgggtgtgatttgagatccatgttgaaaacctcataaagtataataaaaagcagctggtgaaccatgtctaaactttaccaggcttatcaccaagctagtgtgcatatttttttttctcaacaacttaagattttggatgaaatgattgcacatggtggagcttctgttctatcgatctcagcttctattcttttctcaaccaaactttgtgcattggtggtcctctgtatcatgtagctaggcagctagctcaaaatttgatttgtgactgaatctaacaaagcaagaactataagtctaaaaatccaaatcaaacaaccgaccgggtaattagtactagcataggactaccatgcattttgcttgtctccaaaaaatatatgtggagatagattttctttcctgagaggacattcacgtttcttgaatgacacttaaatagtcatagaaagtttcataaaagaaattaaaaaaatagatttttatgagatatatcacttaaagaaatgcaatgtcaaatttcacttctacgagttgtgatggaagaccaaactaaactgaaactagtatattagtatataatacattcgtattaaatattttatttttttacaacttgtaaaagtcaaattaaacctacatgcctgtgaactcatattaattaacttgtcctttttaacttttcatgactatttaagtgagataaaaaatgagagggtgtctccttaagggaatattttttttctaatatatatgcatatatgatggcctttccaagcttccatgaacaatagaaaattaggccccctttaaaacaaatggaaaacatagaaactctagagaatttttattttatgggagataatctatggagtgctttaaaacaaaggattgattccaaccaatctatttaaaattcctatggagtgaactgttatagaaatttcggagagaaaaataagcataatgcccatatgtttttcttctcgtgtcttgagtttgtgtttttcatgtgtgctaatcaaacgataattttgagatgatctgttgaaacaaatttcacaagatttacggagtaattttgtaggattaaaatcccatagaaatttcatctatttgccttttcaaaataaaggattggagtttttcaaatcctatgaagtttcttagaaatggcacaatgcatatagattttagagaaaaaatagtaagagctcgtacctcttgaaaaattttctatgagtttatctctcatttggctactacatttttcctatggcctattcatataatcattcatttattttcctcatgttttctgattctctattttacacttgcatttaacatgtgtttgttcaattcttccgttttcttaacactacgtttaaaaaaaataaaaatttcgtgtgtcttaaaatcctattaaattctttgtgaatattacattgtattcatactggttttcccttcacgtcttttgataatgctatgtttcaaacaaatccttaacattgttacaagctagcaagtggcaagcttccacggaattaaacatttgtacgtagccatttatgtggagacttcctctttaagataatgcaagctttatgtgcaggctttagctaattccgcacaagaagtctgcagacgcagacgctgaagtaccattgcgatactattatgtcatttctgcgtcagcctagacccttttccatgaaactataattcgtatggcgaattccaccagtttttttattctcacctaataattgtttcatctgttaaccaccagctgcattgagctgatcggaattgacactttggtggacaaaacaatttccagagccttgttgttgggtagtggccgggagagcaacgtacaccatctatccgcggtcaaaacgacagcaacgccaccactaattcgaaattaaatcgattgattggcacatcgagcaaccctcgacgcagacttttgtcttgtcaacgtgttggtgagagcacctactagtgtgcgtcgactgatatctgccccccatttactttgatatatgtatagaatttatggaaaatattttttacttgcaagtgcttgcatccatggccagcagctcaaaatgtatggattaatttgtggtgaagatggcctttcaaacttaatgctcagatgtgctgagttgtttgggtcaagtctcacaaaaaaaacttataaatgtttagtaataatttcgtagtttactactactatgaaacattttcgttgcgtctgggtttgttttacaagctggaaaaacaatgactacctaactgctagtaggtaactgaacattttgcgcatgaaagtgttctcttgaaaaactaatcaagatcattatcttcaaaaaaaaactaatcaagatgtgtatactactgtttcataaaaaaaatcatccaaatgtaggataaaattagcttattctcgcctcatggagcaatcaagtgaacaaaactgctctagatttttttaataccgtgttgaaccaaaaggaagtatagtaaggtttctgtttagtccaagctctgctgtctgcatgggtaccacaactttaccagggagcagtagagcacccaatcattttgagcagatctcgttgaccattaagaaactactacctccgtctcaaaataagtatagccatgattttcagcgcccaactttaaccattcgtcttatttaatttttttttaaaaaaaattaaaaacataagtcatgttttatcatcttataacaataaaaatgctaattataaaaaaatttcaaataaaacggacgatcaaaattgggcgtgaaaacttatggctgtacttattttgggacggaggtagcaatgcacgaagggcacttaattgctcccatgatcatcatgcattttcacatgaattaattctccattttccatgtctcagtaatggattgtggacgacagatcatcttctttacaccgttgtatctgtcatcacttaatcatcctactaatttacatcgttcgtggaatctgagctaggagagaacaacaacacccataggtcacaaaaaagctgtgttccatcgaacgaagctgcaaggatgcagccagagaaaagcaaacgaagttggccacgccactgcaggacgtgtcatgactccatggcggcctccgggatgctctgcagcgcgggcttccagtgcgccaccctgtagtgctggtggtagacctcgccggcgttcatgatgtccgccagaagctccgcggccgaccgccggctcttccggtagacgtggtagccgtggccgccgccggcggcggccgccctcttgtccaccagctcctgcagctgccgcttggtgatcctgatggtcacctccgtcatgtgagccccgctcctcggcggcgcggtgccttcctcccccgactccggcagctcccactcgccgtcgtcggcccacgacacggcgtgctgcgtcacggcgcagttccccatgtatgcgcagagatgatcgagatgatcttctttcctctttctgggttgatttctttgctgttgctgcgctgctttacttccggtgtcggagtaggtgttcgagatgatctttgtgtgaccgattcggaagggaggcagccgttttatagtttcgaggtaacccgggtcggtcgcggctcccatcacctaaagttacgccgatgtggaggtccagtccaacgtggacgccgaggtggacggcggcgggtggtggcccccgcgcgggcggtggtctgaacgcggggacgtgggggcatctcgcataggtgggatcgcgacgcgcggggtgggaacgcggcttttcgagggggattcccctacgcagcacgggcgcggcacgagccacaggcccacagcgaccccaacgtgcggtttgctttgagttgcttagccgcggcgggttgggaggacatcgcgcttggtttggggctttgggccgtcgtgatcgccgcgtgctgttcccttggcgtctcgtcggtggcgcgcggccgccgaccggctatagtgcgtgagattgatcggcggcggtgaactggcaactcacgtttgacacatcctgtggcggtttgcccatgattggggtgtcgcctcaattagttcgtgtggttgatcgttggcatcggatctcgtcacacctcctcccgttaactaatcacgtcaattaaaaacctgatgcaactgtgaaccaccgcaagaattttcctctgtagttgagacttgatactcagggaagggatgagctaggagttccaactccaatggtacaggacatgcttccgtgtcggtggcgttcatgttcatcccgttcatttccaccgctagagcgctactgtaggaacgatgcttgcacttggccgggtggcatgaactggcagcactccggcacgccgagccactgtgggctaacacgcaagaagttcgtatcagaagagttgactcaaatgattgcacaaaggagtagccacgaagaaatttattgacaactcatgtctttggcaaaaactagatttatgaggctcatttctttcacagctgtaccacctccgtcacatgatatagaatattttaaaattaaacgtaaatattaaaaaagataaaattaagtaataaaatattatgattagttgagaagtggagacaagtgaactaaattaaatgataaaatattaggattgaaaatgttgatggataagttgttatattttaaaataatttttaaacactaaaagttattatattttagaacgagaggagcgatatttatgtagtgttttcatggacaaaaggaatttgcactgcaaattcgtacgcactttggtgagtcgatgtgaacggaatatctcttgtatctgatactctgatgcgtcagcgtattgtgttgtgtgggcttgtagcatccttccaccaatctggttcataaaccgtgtgcgcttcaattgtcccaactcccaaagcgtacaagtgcgcgtagaaggctgcactagccactggccgtctggttgtgccgtttaactttgacccactttgctctcggcttctcgctacttgctagtgcttgtaaacagcaaactctcgcttcaatcttatcgaagcttagccaacagactgtacacgtcgtgctcgcaacgtcatggctcttttgtgtctcttcttcatccatcaaatgggaggaaaatggtaaagtaaatgctacgagaactacagacgacagatgtttcaggattggacactgaaaatcagaacaaattaagccccctttacactgtacaaattacaaaaagatgcaatacgtacgtctcttgggaccgaaaatatagttggaatctgagtgatacgcaatatcacagaaagttgtttgttacaacaagatatgttttaactaagagaacaattggaaagttgttttgccgaaagatagcaattggaaaggcgaggataatgacactagagaacaattccgtttggtcgactaggtgcaacaacccaactttgtcttttaactaagagaactagtttaagaaaattctccaactttgggtaacgtttcattagactggtgcactggcatgggttaattaaaaggactggtgcactaactgcgccttgcaaatgacaaatggtgatgcttgccaaatgccaattatatatagaacttgttcttcagtaatattattgattctgatctactcatgtacacagtgcaatctatagcatcatttcctggcatcactattacaacattaactcgatctagagaaggaaaaaaaaactgagaatcatttttccgattggcggttggtttcatgtgtgttataatagcattattttgatcttttatcattgtttatgaccatagagggcataaagcttgtaaatttaagtagcaaatcatatcatgcatgttgtcgagttgaactctaaaacgtactttgcaattggagaactttagcccggaacttcattcagcttcagcactgccaatttatttgtctgtttcgggtgataaaatttcactggaataataattctcacccttcattcaattcatactttgtatagatgcatacgcaaaatctagccacatagtactctcttctctcggcccccgcgccgccctccctcacgggtgacacgggaggcgaaaacaatcggcatcgccgctcccccctcctccctctgccgcccgagcggccgccggcaaagccgcgcggctgcaaggacggcggcggcggggcttcgtcgcctttgtctgcctctcctgtcggcggtggggggccgcgcgagacagcaaaggccgcccagatccaggccgcctcggctggatctggcggggaggccgccggcggagggttggcctgaggtggcggcggcaattggtggtggtggcggcggggattgaagatagcgaggtggcagcgacagttggtggcggctggcggcagggaaggcgacgacggcggcgggggcgacggcggcgtcggggatggtgagggggcgccgccggcggggatgaagatggtggcggggatggaggtggcggcgaggttgacaacggcgggtggctctggcggcgagaccggcgacggcggccggatcaggtgctgcaggccattttggccccccggagggcggatctggcatgctgcaggccgatttgcccccctccccccgcatggcaacgacgtcggggcggctgcattggaggtggcgacggttttgcgacggcggctgctggcgtct

SEQ ID NO: 28591 - DNA, 2103 bp, Oryza sativa
cggcgcagcatcgtttggagaaggggtcggagaacgtcttgtcgcagagtggcgcagccgatggcagcggaggccggctcggcgcgaaaggcgcggccggcggagatgaaggccggcttggcacgagaggcgcagccaatggagggaggccgaattggcgcgagaggtgcgtacggtggaggaggccggcttggcgcgagaggcgcggctggcggtggaagaagcgacctcggtgcgtggtggagctgccggtgggtgtggcgcggtctttagcgcgagaaggttggccggcggggggcgtcagtgcagggggcccacatgttggtagagtttgagtggtggtggagcatcggtgtgtcagccgtggattcgcaggtggcgagcagcgggtgaaaacctagctcggccttggccggaccgacaacgatggttaattccccctcctaagggcgttgttgtgctgtctcacccctcaagggtggttgccaggcgaaagcccagtcttgcctcctttgagccctgacggatggcgacagcggtttttcgttgcttctcttcttgaagacgtcgttttggcaccccccttgctatggcgatctcgtctatgcacctttgttggtctagtggcgaccggtccggtgctaaccttctcctgtcatgtgtgttggcgctgccggtgtgtgggtggtggtatatttttttctttttcttggttatgacctttcagggttgtaatcttgtaattttttactgctctatcgatagaacaccgcaccgtctcgtgcgagtcgttccatgaaagttcaagtgccattgatttggttttgatgattaataacaaatccaattatgtgagactaatgtttttataagcatttctttgcctagtctcatgtggatatgaaagtggagtgttggtggacctaaatcacaaggatgaaatacatggagatcaagctatatgtatcactctttctcttcatgtacatattgatatgttcgtatataatatttccacgtgattggcatatgcatgtgagactaatgttttgtttgagtattatctcttatttagtctatttacattgagaacgtggagatgatgaaggtatgtttttattttattgtctatatttaataaatgccttctattcttatataggataagctctcaatgtttaatatcttgttatgcatactcttgcttcacacaaatattttgtacgcatacatttagggggagcaaatcctatactttagttatgcatgtaatcgatccaaattattcaccttcatttaattgggatctttacacttgaacatatatttgagtatatgacacttgtggtgttgattaatactcatcatttattcatatccttttatacatgcgatcggttggtcaacatgtgtaggttgacaaccggatcattgggactaataattttattgagttgaatgaaagaaataggtcccaaggattacaaaggtgttgatgctcaactgatatcattacatctaacaataccaagaatgacaaagtgaagatattgaagatgtgtgatacgaagtggctattatggcgagacggtgaagggcaagcgatgctcggtcgcgatggaccatgcggcggtgaagggcaagcaaggggcttggcaccgaagaaccaaatccggtggtgaagggcgagtgacggctttgtcatgatggaccgttcgagaccatttaaagctacaagtaaccgcatcaatcatttgaagaatatatggtgaaacggtatcggcattggcgtccctcaagacaatgaaagaaagatgaaaaaagggcatttctaatggtgtagttctcttcttatttacatttgaatttaggaatgccgtactattaagagggatgcaacgtcgaggtgtttgtgtatgtctcggtgctcaaagtgacctatcatagtgctaccttgagagaaacccaagctttaacctatcctttgagtgtttttagaccttggttttggttgagttgggtagtcctttgagtgagctttccatagagtccaagttattcaaaaacggactcccgagcgaaaagttatagtcgttttactct

SEQ ID NO: 28592 - DNA, 3375 bp, Oryza sativa
tgtggtgcctctttgtgagggggatttgagaaggggagagagttggattgagagagtgaggagttgagagctagtgagcttcactccatcctttgtggtgcctctttgtgagagggatttgagaagggaaaagagttggattgagtgattgagaagttgagagctagtgagcttcactccatactttgagcactcgagttcatagcaagcaaatcttcgattgtgtttgttactcttggggactaaggtctcctagacggctaggcgttgccggtgagcacccaaggttgtggtgtgccacggaaagtttgtaaaggctttgatttcgcctccgcaagggaagaaatcaagagtgaaaccgaggagtgcatttgtgcaccctcgtgaggaaagggttgaaataggcccggcccttgtggctcctcaacagagacgtaggatccgtggatccgaacttcgggaaacgaatcgcgcgtctcccctcttggtttgcctgttcttgcattctctcatattgtgcttgagcttgtttttacccgatctacttgcatgcttatttgatttagtttgtgaccttatatcttgcttagataccttatttgtcaccttttgattcatatacattttgtttgtttgagctacaagttcatagctagtgtttattccgttatccaccgaacttttcgattgagaccggaacttccaatcccataccggaagtttcgatttgaatcaaaagttatcatcactctaatatgctatgaagttgtgataatttttaggaacacctattcacccccctctaagcgatattaaggtcctttcattccaaaaaaaataattctctttttgcgcacacagtaatatactgactaggcctctatcctaaaatcaaactattttgttcaagatagacactttacttatttgaagtgtcgaggaagaacagatcggcccagcaatccatcaattggctcgctttcttcacgttcatcatgcttctctgtgacatctctactattataagtatatccagtatcccggtgtacgaaataggcctttagtccactttcaatcctcgtttcttcaagtttgatttttcaataggataaagttcttctagaggcgcacgtggtaaataattgtgtttgaaataatattatatgtcctttggtttttctttaaacaaaagtagcagttctgccgatcaaattagatagaagaaaaatcagaaatggtgcaaaatgacatataattgtgcagactggcagtcactcattctgggccctctggggcaacactgaatccgtcactttcttggataaaattgacttgagtaatatcactgcataattctacggaagagcattttaattcatccctcaagaaaacatcatctcattttcttgcatgttatctaaaaagtatttatttttttaaaataagatatatctaataaatatgcaagtttaaattcgacttctataagttataaaaaaatagcaaatatagttgtaaattacacatagtactagttttaatttaatttgttcattttattataacatgtagaaatcgaatttaacattgtatattcatggaggagtgatatatctcacgttaatctatctcaatcaattattttttaaaaaattctataatatatatttatgcgacatgcatgtaagaaaaaagctctcgagatccgaaaatcccatatgctatgtttggcagccatacaaactacaattacaaaatcgatgcaagttgactatgtaaaatatcagccgcacacgcccataatatacaacttcttccatgttccaacacacacatcatggaataagatggacatggcaagccccgaaagctaaacccacaagagcacgtaaaagaagaggttaaatgatatcttccaaaaaaagagctctatatatatttctttgttctgttttttctccatctctattaatatacgaggtaaagcttttgccctctttaaaaaaaaaaaggaagaagacggaacaggggcaaaagtaagcggtcattgcatgagagcaaagttttttttccccccggggaacaaagagtttcttccatcaaaaaaggagctcaaaggttcttggtaggcaaatcgttgtctaagacccaaagctgcagcggcaggtttgttgatgtgcatgcttgaccaaaccgcaatattggtgagtactcgtgtctaaacctgattaaatttattgggagccaatgtcacactagaacatcaatcttgaacacttctcaaacgtgcaaccatgggaaaaggtgataaggaaggaatactgaatcctgttttatgatgtgaacaaagtggcatcaaaggaatctccggtatccatatatagagccatagaggtacaaactgcgtacacttcgattgacctcataacaccagttgaaattgatggcgattatttcagtctaataatttttatttatgtctttgcggcctttgttatgatgagggaccaatagatagggcccaaggtggcaggagagctaaaaagacaaggccggtacagccgacgtactcatcggcctaacagctgcacaaacaaattaaaatagaataagttcactttaggtcccttaatttgccgccgagtctaagatttgtccctaaccaaaataccaaatacaacaggttcctcaatttacaaaaccggatcatctaagatcctagacaatattatacccgattttagctgacgtggcaagccgagtcagcatggacccacatgtcagtgtctagtattctcttctcctctctcttctctctcccctctcccctctctctcatctcttcccacctaggtcacaaggacgggcggcggccggcctagcgcgctcacacgcaacggtttcccgtcctccatggccacgcccggcgtcaccggtgccgttgtctaggacagcgccgtcgtcctcgccaagttccttgagcgtgccgtcaagtcggtacgccttgctctccgagacgcgcgggcgctcgagctgggagtaggttgcggccttgctggctgcgttgctaccctttttggagtccacgtcctgctcactgccctccctgaccgcctcaagctcctcaggaagaacttctacctcaacgttggggacgacgcgaggggctctgctctggtcgcccaactcgtcgtggggtgatgaacctcaaccggacttgctcaacccacctttagctagattacaggtatcctcttaccctcctccttctcctcttcttcttctccttcccggggatccccaccttcatcagcatgaaccttccctcctcccggaacaatcggaagcacacgcacggctccttggaatgatgta

SEQ ID NO: 28593 - DNA, 6418 bp, Oryza sativa
tcaccgtcttcgtcgtctttaactatgtcgtcgtgtcctcaaggaccttgctcttgtcgacggcggcgacgtcaatccacaacaccgtgtgtacaagagggcttgatgatggcgacggaagcaggcagggcgccgccccttctccccgccggccgccgccggtcccggtgcagattgggaggaaagggaagagaggagaggagaggagagagagaggagagtactatttactggcatgtgggggccgcgggagatgactcggcttgccacgttaagtaaaaccgggtataatactgtctaagaccttgggtgatccgattgatttgagagacccgttatatctggtattttgaattagggataaattttagactcgacgataaatttaaggaacctaaagtgaactattctaatcaaaaccagccccatgctttcacttctagcccatcacaactctcgcgtccttcccgatttaaccaggccgtcttctagctcagtgtgtcgtgtatgggcttcattgttggcaagtcctactggtgcggtattcgcaagtcctactgtcatacagcagtaacaacaccgagaaagctatttgggctgtgtttagttccacgttaaaattaaaagtttaaagaaattgaaatgatgtaacggaaaagttagaaatttgtgtgtaaaaaagtttaatgtaatagaaaagttaaaagtttgaagaaaaaaaagttggaatcggccttggcgtcgagatttcctcaaactgccacggctgactgccaatacccaatagagaatagactatgttctcccatgtatacttggacagttgatcatccgaagacgcaagcaacttttgcattattactcctttccgttctttccgcccatccccttaatcccatctgacctgaagtcctgaacgcctcacacctgtccccgccggaaaagataagcacaaattcacaatagtggctcgaagggccaaagaaccgaagaactcaacctctcaaaaaaaaaaaaaaaccgaagaactcaagaagcacgcgcgagtcgcgacgccatcacgagaaggtggaaagctcagtagctccttcgaggcggaaccgcggaaggggccctcctcctcggctcctctcctctcccctctcggtgccgcctgcgccggcctccttgcagtctcacgctgcgtgacgaaagggacaaacgcgcgctcgacttggccgtgtcgtatcgtacgtgtcgcggccccgtgtgcggaaggaaggatgggctgatgggcattcgctgaacccggcgtgacgcgagcagcgcgagcgcgacgccgcaccggtgacctggccgttcgttttgtactatcccccctagctttctccaccaggaccaaccaccacgtgccccttctggttgcggcggctgctggccaggtgggctggttgagcaccatcatttatcacgtccctccgcagtgatcgcctctgctacaggactacaggagttcactcctgtacatgcgtgacaggtgcggtcgccctatccgattcacgcgatgaccaagctagctgccgtgttcgtgtgggtacagtatcttggaagacaagggagaaaggttataatcatgctcctgttgtctgtctggagcaagcacggccttgagcatcattggcgcggtacgtatgtctctttcgatgttgaggcgataatggagcacatcttttcgtattttcatggatgtcgcatctacgatcgttccgcgttttcgagcgagttccttaggcgcgacgtgtcttaagacgttaggccgcctctggttaattctgtaacggctggcactagctagttaacgacgatgcatgattcaactttaacagacgttaatcatgcatccaccaatggctacggatcaccttttgcaaaatcctcccatcctcgaatgatgatgatcttctgcctcctttgtgttcccgtcaagacttttggctacgatcatgcatacagccgatgcaaccaccgtgacgccgccgcgcgcccactggaacacgttgcgttgcagctggccgatcggtctcggagtcggagcgcaccactgacccccgtgtggccgtgtcccggtgccttttccacgcccaccgttgctagctaccgagccccccacgtacccctgggccgcgcggcaaaaagacgtgctccgcgccgtcgcctccgcgcccctgccagctgctcgaacggcagaccgccacaccgcacgcgaaggctttgaaagcccccgccgcgtttggccattacccggcgccctacagcgacggacggacggacggcgtcacggcggccgaaatgacgtgaacgcccctgtggaaaaggaatgaagcgagcgcacagcgcactgcccatttatttctggagaaaatctgtggcgtgactcgactcgaggacgttgtctgcatagaccgttccactacttgaagtcttgcagggacctagttattagctagctagcggctgccgcctgccgcccagcaaaatcgagcacacagggaaagcgccgagaagaatagtggacatgggacgggagccggagatggaggaagcacgggagaatgggggcgtcggcggctctgtgctgcctctggcctcgctcatctctccaactgggaacgaggtgctcgtcccgttcatgctttgtttctgattctctactcgatcggttcttgtcggttaaacttgcttgctgttctccggttttaaagattgcttatccaggccttgtactgtggcaagcgaacaataagcacatccttgatttctggggtggatttgaacatgctaggctggatataaatcatgcgggtgaattgatctgatattacgaaaatcaatatatattgtgctatggatgtatcagttcagtcagacggcaaaatcaaagtgagtaactcctcaggaatggttgactatccttaatcatcagtttttcacgatgaagctgcaagccttatgatcccatcgactgttgagtattaacctctcaaacaagtggctaggaacggggtgccaaagaattgaattacgatcctaactcctttgccagctctaagaaatctcaagtcccaactctcaaggttatacttataaattacagtataagattattttttggttgcaaaagtaaaaacgcaaaccgaaagaaaggttctaatataatacgcagatgcttttttttttcttatagagaacatccaaactgtatgtggattttgtgaaatagaagaggaatcagatttcggcttttagaacagttcggtattctgtagtccagtccacactacaagaatcagaatactagcttcgtgcagaatgtgtttgcaactttgctgtctcagtgttgacatctgtacgccttcttttgtaccgggaagcattcctttgctgccttttttgccatatcttgttccccatttctgtcagccatacatggtccaatggtccatgaacaatctgatcaaaactcaaaggaaggtgtatttttcacaggtgcagatttctgagctagagggcaagatcatagggctgtacttcgctgcaaactggtaccccaagtgcgaggccttcacccccgcgctgaccgccgcctaccaccagctcaaggagcacggcgccggcttcgaggtcatcttcgtgtcgtgcgacgagaatcgaccgtccttcgagaggttccaccgcgccatgccgtggcccgccgtgcccttcggcgacatcgggtgcaagaagcgcctcagcgagaggttccaggtcgagggcatcccgcgcctggtggtgctcgccccgaacggcgaggtcgtgcagcctgatgccgtcgagctcgtgcaccgctacggcgatcgggcattccccttcacgtcggcgagggtggcggagctggaggccgacgagcagcgcaagttcgcgtctcagacgctggagaagatcttctccgtcagcgggaaagactacgtgaacggtagccaagaacaggtaagttttgttggcaatatagtcattaatcggcatattttaatccaagaaattgaaacaatgatcatggcataaatagcgtagggtgatcttaacataaccagtagcatactaggcgcatcatgaatgtcagaaacaggaacataccagtaacgcgataacatgctagaggcatcatgtagaacaggaacaagaacatagcgcacatagttcgctaacaatgggaacatgaatagcgctagcaacagtagcaggaggagaagattataccccgagaatggccctccgctggatggtgaggcagaattgcctccgttgttgttgttgtcgttcacggcacctcctcctggcgcaccagctccggatccggatccagctcctgtcggcggcgtaccacctccgctggcagtggcggcggcaactccagacatggcgacgagcagtcgtgtgggaggcactccccaaaaacctgatcacccgcctacccggtgcagatctcaggcgaaggtgtggtttcggaggcactgctctttccaatctctcgtgcgcgcaagagatcagaagcgaggaagcgagagcaactcaggcgcggagaaggagaaactaacaccgggaaagaagcgaagaagacggatcgaactcgcggcctccttatctatcaggagaaagaacgtggacgcgctgttgcggagggaatcgtgggaacgtgggttagtggctgcaaaaggatagcgacgtgacgtgacgcacgcccgccgccagccagccacgcccacggcacggcacggcccggcccggcccggcgcgcgcgcgcgcgcgtgtggcattccgacccccacctcaactggtcaacagggagcctccaataactccctatttaggttgagatatttctcgcttaaatcctaaggtggtattattatcctcaacatttattatgggcctttgagatttaatattataagttgggcctagcccaattattctaacaatccccaccaaattttaaggctcataagaaatgttctcaatgttgtgcctgtttgatataccagggttttggtggagactgttaagttgaacttccacctaggaaatgagctacatcagaccacaactgaacagtggactatgccttgaattgtaagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttggaaaagccactcggatcacattaagacataagccatcctaccatgcagaaaagaagagaagcacatcatgaaaatgagcccttttcaagggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagttttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggtctcaactgtcgcagtatctagtgctgtaagttctgcttccattgttgacctcgttaagatggtctgcttgcaagacttccaggaaacagcgccacctccaagtgtgaacgcatatccacttgtggcttttatctcatcagcatcagatatccagtttgagtcactatacccttctagtacttttggatacccggtatagtgaattccatagctcaaagtgccctttagatagcgcattactctttccagagcctgccaatgatcgtctcccggatttgagacaaaccggctcagcttgcttacagcaaatgagatgtcaggcctcgttgcgctagccaagtacatcaatgaaccaatgatttgagagtatctcagttgatctcttactattcttcggtttttccttaatagcacgctgggatcgtaaggagtaggagctggcttgcagtcactatatccaaagcgactcaaaaccttgtccacatagtgggattgcacaagtgtaatcccaccctcatctcctctttgtagtttgatgttaagaacaacatcagcctctcccaaatccttcatttcaaaat

SEQ ID NO: 28594 - DNA, 1290 bp, Oryza sativa
gtgtcaatcttctcatgccattgcttaggtccttgcttgagcccatacaaggatttcaatagtttacacaccattccctcctgaccttctagtacatacccgtctggttgatccatatagatctcctcctccagctctccgtttaggaaagctgtcttaacgtccatctgatggacgagaagactatgagaggctgccacagcaagtagtactcgaatcgtggtcaagcgagcaactggtgagtatgtgtcgaagaagtcctcgccttctttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatctacgaggtatacaatgtagtcatctccaaaggattttgcaaccctttgtctcttactcttgcgagtatctacaatgttgtcctcctcaggattttcctcaggcgtttgatcattgtgttctatcggtgcatagtgctcatggggcatgacagtttctttactagaagtgctaggtgtatatttcataggaaattcattctcaaagaatgtagcatctctggactcaagaattgtaccagcatgcatgtcgggtactccagagtttactattaagaatctataacccacactgtggatagcataaccaagaaacacacaatcaacagtttttggtccaagtttccgctttttggctataggtacatttaccttggccaaacagccccatattcgtaggtatgagagatttaatttcttcctttcccattcctcgaatggtgttacttccttttgcttcattggaattttattcaggacatgacacgcagtcaaaactgcttcaccccaccattccttggaaagccccgcagtgtctaacatggcattcaccatctcagttagagtatggttctttctttcggccaccccatttgattggggtgaatagggaggcgtcatctcatgaataattccaaactcttcgcaaaaggatgcaaactcattggaaaaatactccccacctctatcagacctcaactgtttgattttcctttcaagttggttttctatctcagctttatagattttaaagtaatgcaatgcctcatcctatgttttcaataga

SEQ ID NO: 28595 - DNA, 7819 bp, Oryza sativa
catatttagatacgacacatttattggactcaaacacaagtctaaaaccttctctacacaatagagagccgctaactagattcttctttattgaagggacatgctgcacgttcttcagctgcacggtctttcccgaagtaaactttagatcgaccgtaccaacaccgtgaacagccgcaagcgacccgtttcccatcaacaaggaggaacctctcccgacctgataagaagaaaacagagaaatatcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcccttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacgatcatcgaccatcttgtagtcatagaactgctccatgacatacagctcactgccggcgtcagagactccgaacttggcctcaagtgcatcccacatgtccttcccagaaggcatgtgcatgtacacgtccactatgttgtcagcgagtacactgatcaatgctccacggaacaggcaatccgaagcctcgaacatggcctcttcctcaggaaaaagaggtggttcacttcgtttgccccgtgaaacataaaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggcaatatagtcattaatcggcatattttaatccaagaaattgaaacaatgatcatggcataagcagcgtagggtgatcttaacataaccagtagcatactatgcgcatcatgaatgtcagaaacaggaacataccagtaacgcgataacatgctagaggcatcatgtagaacaggaacaagaacatagcgcacatagttcgctaacaatgggaacatggatagcgctaacaacagtagcaggaggagaagattataccccgagaatggccctccgctggatggtgaggcagaattgcctccgttgttgttgtcgttcacggcacctcctcctggcgcaccagctccggatccggatccagctcctgtcgcggcgtaccacctccgctggcagtggcggcggcaactccagacatggcgacgagcagtcgtgcgggaggcactccccaaaaacctgatcacccgcctacccggtgcagatctcaggcgaaggtgtggtttcggaggcactgctcacccgcctacccggtgcagatctcaggcgaaggtgtggtttcggaggcactgctctttccaatctctcgtgcgcgcaagagatcagaagcgaggaagcgagagcaactcaggcgcggagaaggagaaactaacaccgggaaagaagcgaagaagacggatcgaactcgcggcctccttatctatcaggagaaagaacgtggacgcgctgttgcggagggaatcgtgggaacgtgggttagtgttgcagagggaatcgtgggaacgtgggttagtggctgcaaaaggatagcgacgtgacgcacgccgccagccagccacgccctcgcccacggcccggcgcgcgcgcgcgcgtggcattccgaccctcacctcaactggtcaacagggagcctccaataactccctatttaggttgagatatttctcgcttaaattctaaggtggtattattatcctcaacatttattatgggcctttgagatttaatattataagttgggcctagcccaattattctaacaagtttaagagcgtcggtgcatggcacaagatcgagcttgcattaccattgccgttgatccaaagcatgaatgcatccagctgttggcctcaccatggctaagggctgcaggttcccatctcgagcctagtcgggaagacggtagggctctacttctcggcgcaccggtgtgcgccgtgcatcaagttcaccgcgaagctggccgccatatacagcaacctgaagggcaaggccgaggactttgagataatctacatccccatggacaaggaggaggacgggtacctgcggtcgtgcagcgacatgccgtggctggcgctgccgtacgacgacggcgcgtcgtcgggggcgctggccaggtacttcgacgtccgggagatcccgacgctggtggtggttgggcccgacggcaagacggtgacgagggaggggaggaacctggtgaacctctacttcgacatggcgttcccgttcaccgacgagcagatcaggctgctgcaggagatggaggacgaggatgccaaggggtacccgccgtcgctgcgccacaccggccaccgccacgagctaagcatcgtgtctgacaagtcgggaggagggccgtacatctgctgcgagtgcgacgagcaggggctcggttgggcgtaccagtgcatcgcctgcggctacgagatacacctccggtgcggtcgggacatggaaggcagggcggaataggagcatagggccctccaactcgtagtatattgaactgaacgtggtgtggtgtggtgtgtgtctattgatctgaacaaagcttgggttgctcttgccaagcctgatggcagaatagatgaggataacacaagtggtttctgtacttctgttatgtgttccttggctgcaaaagtgatgcagttcagggtgttgaataaacgtgataatgctggatacgaacgaagacttgggtcttgccttgcgtctccctaacagcaaattaatgagcccaagcttagtttcataacatattataacctccacagatcacatgatcacatcgaagtcttgtgcgctgtggctgattaatactagaatttatccagttcaaaagtgatagtaatcgatagtgtaagagctcataggagatgaatgccaaatccaaacaacaattgcatgagaagcgaaagcttagataaacacagtatacttttgtttagtagacaatataacagaaccgaattttcatataggtagcacgtacaaaccatattgaaacaagttgcatcaataaccaagagctcacaccgacacaaattcaaatgtcttagaagtagtaaaaactggtattatcacaacttcaggcttcagacacttcaatattttgtatcatataatagcacataggcattatgtgtagcctaaaacccgtgtattttgatgctctctttctttacaattccagcctagccaaaatagaagctcatcagataaaagcaatctgaacaaatatgaagataagcgttggtatcatatagattacctgaactaggaacgtcgcaacatttttacgctgatcaccttgaagttgaatgacctgaaaaaatagcagaacattcatcattatacacattcactatttcacaccagacaatgtgaatccaacacaacagaaatgctattttgtacctggcctaactctggatcttggactacagtaccattacaacagaattcctttttcagatccttgaggattttgttgtaactgtactctttcttcaagccctgaacagtagtcagactctttcttccgttgcgctgctgaatgcgcacgtgtacatagtcctttgatccagcaccaacgctggagtcctcagcattggcttccgcaaacggatctacagggaagatttcaaaattatcaaatgatgggttcaggcatgctcagaatagactaccagttactcctaatcaaaattaaatagaaacgaggtaaaccagataagatacaattctaaacaatatagctcgtaactggatatcaatatatcctgttgactgaaatatacaactaagagtaatctaaagtaatttagaaaagaaatataaatatttattctctaagaagtagaacctattgatcaaatcgttaaagcttgcacaggcgatgttatgataactaaatatccaaggaaatgtgtgcataccaaaagctgatggaagctggacgtcgagatcagacatgaaatttgctagttgagtttgattggtctcaaacagatgaaagctgatttctttgtctcaatgcaagctgcaaacattccaatcaaacgcatctaaaaaagataagtggccagcaagaagtgcatctccaaaacaaaattatttcttatcatgattgggtctgatggcatctatccaaaaaaaatgcacatgaaatcaaccagggaaacataagagatacaggctacagctcaagtacatccaacaaaaatcgaggtggatttaagcccggaaaaaatccaacaaaaatgcaccagtgccgttttacatattattatatgaccccatatatcctaccaggctaccacacatagttcctgttagggatggatttcttggtggtagaacagaacattcaacaatttatgtcaacgttgtattataaagcagatatggtcttgcaataagtcccactaattgggtaattcgcgcaggtacagaattatcaaaacgtatctgacgcaaatcaagcataaacatcaatacacctcccaacttgcaaaattaaattgtgttaactcatagacagaagccaattataaaatcgatcattctaagcagcaggaaatcgaaatgcctcttttacggacactaactaaaatagcgggatcatagcccatgatgtatgaacatattagatcaaaacaaaacaggtaacgtctattaacactaaaaattccccaaatctgacgcctgaattcgccctaaaaaaatccagcatcttcgcgtcgaggcaataacgaatgaacctaacctaccaccactttccactcccccagaccctggacaccaccacccaatcggacaaaacgatctccaaatcaacgacaggaccaccccccaatacctacgagatccacttcgctcgtggcgagatcacgaaacgcgtgaggaactcccaccacagaaggatctctcgtgcttcagacgcggaaaacggtcggaaacggtcggaaaaaccctctaccatttccattttcattttattttctcgaaaatggaatcggaacggtatacttggaaacggtaacgatatcggttatatcggtatcttggaaacggaaccgtcggaacgggaatataccgatatcggacggaagtcgaaaattcatgtcggaaacagcgaactgtggtatcatcccgcatttaactatgtatgaagatgaccttataatttcacccttgcatcattacgctgccacacaacaccgttatatgatgattaataagttgacaataagattgataaataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccaccgtctttcttttcctctctttcttttattttttctctctctcttatccttcccttctctcggttccttttcctgctctctcaatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggcgcttggctcggtggcacggaagccggcggtggagcatgggggagggaaggtggccggctgcgacggaggccgtcggggcgaaggaggttgcggccagcgtcggcgacctggtggcggcgcccaacatggcgcggcggtgccccagcgccgatgaagacgacgatgcggtcaggcctagttggcttctttattcagaatgggctgctccttaatgcctaatgggctcctcctcctgctagccaggcccagccgacttccttcttcggaattttgtcggaaatttgacggaaattaccgataaaaaacggttaccgacaaaacggtcggaaaaaaccccatatcatttccgctaccatttccgaaagagattaccgtttccatttccgataccgacaattaccgataccgattgaaacggtcggtgcaaaccggaaacggtagccggaattctcggaaatttccgtaccgttttcacccctactcatagacagaagccaattataaaatcgatcattctaagcagcaggaaatcgaaatgcctcttttacggacactaactaaaatagcgggatcatagcccatgatgtatgaacatattagatcaaaacaaaacaggtaacgtctattaacactaaaaattccccaaatctgacgcctgaattcgccctaaaaaaatccagcatcttcgcgtcgaggcaataacgaatgaacctaacctaccaccactttccactcccccagaccctcgacaccaccacccaatcggacaaaacgatctccaaatcaacgacaggaccaccccccaatacctacgagatccacttcgctcgtggcgagatcacgaaacgcgtgaggaactcccaccacagaaggatctctcgtgcttcagacgcggaaaagccagatcgatcggggtaagagaagggaaggggaaggtcaccttgatcggcgaagcggagcggaggggaaaggcgagggagacgacgacgcggcacggcttgaccacggggcagacctctcttctggttctgggcgcttccggccgcctccaccacgcgtcgcttataaacgggaggaaagcgaggaaagggacgcgttttggttaggcgaggcggcgaattagaacgtgccgagctgttctcccctcacggccgagctaaatttaggcattcggccttcttgggcttttcagccctcacatgattttgactaggaataagttcatcggaggtccctcaacttaacagtgagatttgattttgtaaagtcccttaaccacaaaaccagaaatcttcactcctaaactatacaaaaccgtctaatttaggtcccaagtcagtatagatacctggttttgctgacgtggcatcctactcagctaaaataataaaataaatatttggggcccatatgtcagtgagagaaaatgatt

SEQ ID NO: 28596 - DNA, 604 bp, Oryza sativa
ggccattctcggggtatatcttctcctcctgctactgttgcttagcgctattcatgttcccattgttaccgaactatgtgcgctatgttcttgttcctgttctacatgatgcctctagcatgttatcgcgttactggtatgttcctgtttctgacattcatgatgcgcctagtatgctactggttatgttaagatcaccctacgctatttatgccatgatcattgtttcaatttcttggattaaaatatgccgattaatgactatattgccaacaaaacttacctgttcttggctaccgttcacgtagtctttcccgctgacggagaagatcttctccagcgtctgagacgcgaacttgcgctgctcgtcggcctccagctccgccaccctcgccgacgtgaaggggaatgcccgatcgccgtagcggtgcacgagctcgacggcatcaggctgcacgacctcgccgttcggggcgagcaccaccaggcgcgggatgccctcgacctggaacctctcgctgaggcgcttcttgcacccgatgtcgccgaagggcacggcgggccacggcatggcgcggtggaacctctcgaaggacggtcgatt

SEQ ID NO: 28597 - DNA, 9626 bp, Oryza sativa
cacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcctattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacgtagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaacatacgtttcatagcagggtcgggggaaagaatggtggcagtaccaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaataattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgagcgcttcttatcacaaccgttttttgtggcagaagtttttaccggctctccgggaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctacctacctacctactattggatttgaaccaatgactcccgccgtatgaaagcaatactctaaccactgagttaagtaggcaatttatcaccacaaaggaagaccctttacttcgatcgattatagatcgaatcctttttataagcaaataccgcttcgttattggtatgttattatagtaaacagcaaggttcagatttgactgtttgcagcatgggagctgattacccaaaaaatccctgggaaaaagaaaagatatctcggtaacgaaaaccataggaggctgtattggcgagatccaagggttcccagcagcccaaaagaaaaaccgcctggaagtccgaggacctttagtaccgtaccgaaccagcagccttcgcgccaagcgacgaccgcccttgtccctttcctttttccattcagcctacttcttagctttgttccgtcagtctaaggcaaagcttaagtggttcgcctaccttacccacttgatgaaagggaacgaacttcgtttccttgacggttttatggatggattcagtcagcctcactccttccttttgaaaagtgacgctttgcgtcttcgcttccgagggttagggtataggccgtttcgagcaagctttcgctttttctcccggctttctacaactttcgctttagcttcgcgacccctttccggaatttgaagtattcgtcgccctaccctaagaaagaagtcactataaaacagcttgccctcctgaagtaccaaaggtgcgcggagcccggtgaaaatgaatatgtttgctactgaaagaagcctgcctattgactaatattcgtctttagaatgaaagtagctatgaagcccaatctactgtcgattcaaaagagggcatagtcgtatgggtggggtgtttgtggggagctgccttggatatgaggaattcctcaaatctaaaaaaaatagaacaaaggcaaagtccgtgacgaagatctttcttttctatcaatagatagaaatgagtgttcgttataggggataggatccatctgctctctctctattttctttgatgcaatttagagagaaagagcagtgcgaactagaaaaaaaaagataatcgggagatgattaaaaaatagatacatagacatctaaagtaaagggatgtatatattattcctatatatatcatctatctatgaaaaaagtaaacagagttcgtttttgggttccccgaagccccgaatggattggatcgtttctgcttctgccaacgaaatgaaggcctcgccccttccgaatgcttctccgatcctgaagttctcgcgaagagaataagatgcagctccccctccctctgtctttttccgctttgctaatcttcccctctaacgcgggccgggccgggcttaggcgggcgcgggaggaagaaagaaagtcgaagagcgtcttctcctttgtccttttttcagtgcaacacaggaaagcaccctctttttgtaatccctgcagcttcccagaggcttttttttgtattgaacgcatggcgtagctaggacccctccaatcatgtttgagcctatgttcacccggggcccaaaaaggagaattccggaatgcctgccgacgttcagataaagtgcatatcccttaccactaaaggaaaggctcgacgaagggggggggattttccgggtaaggaaaacgctttcggagattgagatgtcggtttgtttttcatcgaaaaggaagaaggccgaggggatagctgccttccttcgggctttgcctgccgacgttctaataaagaattccggctcggcccgggaaagcgctggcaacaacataaagaaaggggtccatgtagctgctgcgcccgcccactgagcagcaggttcggcatctactacaaaagagagaatccacttcagataaccacgtctctgctaggcagcgtgtggaatggccgggagcggaccaaatggatatataatccaagccgagagtggagttacgtgaacagccgtctgatggaaaacaactttcatgttcggttcagagagcacttttttcgttgagaataagtccttcccttttgtgtgaattccccagcggcgaattaacaacttgtggggccctatctattcaatctctcgagccccaagaaaacccccctctccctcggactcaatctctcttttgactctatatatgtgggcacctgatatctatgagggttcacccaccccggtgacagcattcctttctattgcgcctaaaatctctatttctgcaaatatgtcacgtgtttctattgttgcttcctatgggggtacattacaacaaatcttctttttctgcagcattgcttctatgatcttaggagcactggccgccatggcccaaacgaaagtcaaaagacctctagctcatagttcgattggacatgtaggttatattcgtactggtttctcatgtggaaccatagaaggaattcaatcactactaattggtatatttatttatgcatcaatgacgatagatgcattcgccatagttccagcattacggcaaacccgtgtcaaatatatagcggatttgggcgctctagccaaaacgaatcctattttggctatgaccttctccattacaatgttctcatacgcaggaatacccccgttagccggcttttgtagcaaattctatttgtttttcgccgctttgggttgtggggcttacttcctagccccagtgggagtagtgactagcgttataggttgttgggcggacggaaggttgccatgagtaaggttgggagaccgaaggcagttttccgtgcaccagacacgtagcttaccgaatcagttgcaacacagatgggaatgcatgctacgaaagacagggtcgagtctgatacatcaaccgtcgactccatatccttgtacgagtccacaatcactacacgagatgaacctgggtttggtgaatggaagttggccttaggtgtaataggactcccagttactgcgcgcgatcgtatactgaggtgctccccgtcggttgttggaacgacgcgagccgggccgggccttgattcctttcataaagatgaagggacagaggtgactaattccccatctcatttggggcggaaaacgaatcgacatctcgatgtgatacagccctttccattttcgttgggaaagaacggcgaagtccatccgaaccctccaatgaagaaataagaggagagcaaagcgccaatggcgcgcgaagcgcatgcggaaggggcacggagaaataaagaagtgtggaggagaagcagccgagctcattcccttcgcttcctgggcccaaagcagtgctttgtttcctggccaaatcaaggatttggggctgattgcaaaagatatctgaatatcaagatagatccatccatctatccagatatctaaaaaagaatcgatttcgatttcataaaacctttgattcaaagaactgcgcttagcccccccgctcatgaaacggctctgctgcaatggatggcagagggtccgtagtacccgaagcactggagtgatccagtagccgggaaggggcctagaagtgcctactactacaccacactacacttggctctacacatctacagagcttacccctgtccagtgtctggcagaacgttgggggcttcaatcgtcgactcgttatccccatctcagcccaggctaacggagcctgacttattcaggggagagagtggagcctatcgaagcactcttgagagtaagatccttggctcctcttcattctctacaggggtctctgcccacatggaagcggggcagagatggataagatcaaacacgggaataagaagcattttaaatgcctttttgatcattttgatagagggggatggataaagtgggcaaaacagactcacattttgaaatcgaaaagacctttttcgtctcgacaaagaaagaatcatcttgaaaacgctcctaaccccttcgtagggccgtgtatagtaagtgatccgaacccgcccggagcgagccccccttagaggcaagtgaagttggtgagccgtatgatgggcaactatctcctgcggttcggagaggactcagctgttagttagtacccccttggtttcggggtggaccctttcactctattttattatatacgcttagtgaaaagaatgttttttgatagacctaggacatggattctatatgaaccaatggatcgtgacaagtcgttactactagcaatgacttcctctttcattacttcatcctttccatatccctctcccttgttcgatcttactcatcaaatggcactcagttcatatctgtaaattcgatcattgacaaggttcaaagaaagggtggactgcaggtaagcactaattaaaacctccgcatttccgtgattcaaaaacaagaagggcgtacaacgcccaggtaatatttctttgctttcggatatgcttttcaatatcttcacttgtgaaaatagaaacacttgcactttctcgcttggaaaagaaagactatcctcgaagtaaatcaatctatctcgtattgcccaatctggatgctaaaggctcgtcaccccgggaactcgcagcccatcacaactactcatactaggagcaatggccactaggaggactgaaacgaagacttctatacaacaggtaagaaaatacttcaacggaaagtcaatccctgccaaccgtaatgacttacttcttccgtgagcttcttcatgttcggtcggtagaaaaaggcttaagagctaaatagagaaagtaagtttgaagtctggcttgggctaggtaaagtagtcaaagtagcttgcttgggtttaagaagtagttgaccaatctttctagctccattgcgaaaccacgcccaaaaagcaagatgcgaaccaagaacattcacaatttgatcccatctttcttcacttgcttccttcctttctactaaactgaattttaccctatttcagtaccacttgataagcccggatctgtctgaccaataggagtgaaaggtatcaagagatgtcgtattaaattcgaaaaggcattcgaatctagccaaactaagttcgaaatcggagtacgtgcccagcccggatgaaggaagaagcaaacagggaccgttttgtcttttgtgccgaagctatttataaatcacaggccgaaaccggtgaaattaaggggcattacttgaatgcgcctgcaggtacatgtgaagaaatgattaaaagagctgtatttacgagggaattaggggttcctattgtaatgcatgcctacttaaccgggggattcaccgcaaatactagtttggctcattattgccgagacaacggcatacttcttcacattcaccgagcaatgcatgcagttattgacacacagaaaaatcatggtatgcatttccgtgtattagctaaagcattgcgtatgtctgggggagatcatatccacgctggtacagtagtaggtaagttagaaggggaacgcgaaatgaccttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcattaccctttaaccgggttattctattccacttctagatagagaaaaaaactaaaggagaatgaatgaaaaaaggagcatgatcatatctttttactagaactagttacgattcggggcattggattctcaccaatgttttcgttactcaagccgacattctcgcttccgcttcgtcgacccccgctttcgcggttgcttccctctaaggcggaacgctcccctaccgatgcattttgacatccca

SEQ ID NO: 28598 - DNA, 493 bp, Oryza sativa
acctctcacgcgcagcggggcatatgcgtgtgtgcgaccgacgccggagcgggcgtgacggtcacgcgcagcggagagagatgcagaagtaccgcggcgcgagggaccgaaacggcgccggcggagagcaaagtcgaaggcgggctagcgcggctgcgaagcaggcaggacggtcgacgacgggcgagcgtggctgctagtgccggcggtgaacatgcaggcagccgaagtggtgaagatcggagcaggcgtcgggcgtcgattggggagcgcggctaccagcgactacggtgggcgagcaggcaggcggagcgacggacagctgagcctgtagcggcaacccgacgccgtccgactacatcgtcaacacgttccgctgcttcgagcagcaggcgccgctgggcgcggtgacggtgagcccgtacgtggtggtgtcgctgtacagcagcatgcaccacgacgtgtgcctcctgatgcacagctgcaaggccaa

SEQ ID NO: 28599 - DNA, 1195 bp, Oryza sativa
ccttacttttattttaaacttaatttgatagacatgttctctaaacaaaataagtctaccatctttaaaataagtctaccatctttttttaagatgatgaagaagattataaataattgtttgtaaggattaattaaatatgatgtagtataaagctaactaataggttagaaaattataaaagcaatgctgacaaaaacaatttacggagaaattgtatgtggcagatattctccggttaatattgtactcttgtatgtgtctcaaacatagtctactatacatacccacaagaatgcgcaggtatctttctagttaattctaacacttaaaacattagagatggcattatatgccttagtggattggctgtgctacaaacttgtagtttttgcttttatctcttaaaacatcaattgcaacgcatgggcctttagccagctcgcgtggaaagtcttggacgacgcgagatctcactttcttgggaacatctcactagagaaaataaagttttaaatagattgtcattcaatttgaagatatttgaagaaaacttcaaccaaaaattaaaatattggggtggatcagaaattttttaaccagctgaaaaataatctcggaaggttcaagttagggagataccatgttgtaaaactgaattctggtcgtgtatccttgtgctcgttatgttctcctacgaaatttcaagcttcaaaggccaatatatgtcaggagccatgtgggctgcaatatgggttggatcagctactttccaagaagtccaagaaagcccaagagacaaccatatataagaagtagttcacattaggtccctctatttgttgcccagtccgattttcgtccctcggtcgcaaaaccgggtatgacgggtccctcaacttacaaaaccgtgcaaaagaggtccctcggcagtattgtgtccagttttggatgacgtggcgcctacatggctccctttgacttggtcctcgtcccacgtggcattggcgtggcgcttatgtggcaataggatctcaggaaaataataaaaaatgtgggacctacatgtcagctacacaaaaataataagaaaaggtggggcccctgtggtcccacatgtcagccccctctactctctatcccccctctctctcccttacagaatggggagaggcgacgcatcggggggcggtgg

SEQ ID NO: 28600 - DNA, 1212 bp, Oryza sativa
agccatcgaggcaagttacctcttgtcaagagaactcgccgaaaagaagaccaaaaaggtggtgatgccccgaaagttgtatattggattgttgtcccttttttacaatgatctgaggtttatatttatacccagagtgcaaacttagtccattatgtacatggttcaaacttgcctaaagataaaatacaaacaagtccatacggcggactcttgccatatgtctaacttaaaccgacataaatatcctaattaataaatgcaattgccttaatcgagctcaatctctaattggcagtgacagttatcccaatctaggcacatatcgagcccaagtcatatcgtatcggccacttgccatatcggctaagtcatgctctgttccaaccgatacaatacccagctgttgacggacaacacgatggattgggagatctgcataactccagtgtaggtccaaggctagcctcgattgtgtcaagggcgtgccagctgatttgatcctgcaatcagcaagaaagataaaagcagagttagtcaaccgatagcatatcgttggcggtctcagccgatgtagttagactaaatcggctatggattgaatagataaaggaacaaaagaccctaaacatgcctcatcggctataatactgtctataatgtttaataaagaagcttaggacaatattatgaaaatagccgatggaacaatattcagagtagggtatatatatagataaagataaagtactaggtaatactctagtacaaacttatataaacaaatcaatctatataaacatatcaaatcgcgattagttagtaattcagatagcacaaccgatactgatctgacttgatacaattatatagggtgatcagtctatataagtggcaaatatacataaaaccagtaaaataacatgtatattaggtaagattggctgaaactccgatactatctgtaacatcctgaaaattcccaacaataaaaatcactaaaatttcgaactttttaaaacttttacatcatgctggttgttatgattcctattgcttgccaaaccataaatgatcactaagaaagtaaagaaaagaactacatttaagcaatagatatgatttacgagaatatatttaatcctacaaataattatgcacaagatattaaaatcaaataaaataaaagttattattaacctattttatcaa

SEQ ID NO: 28601 - DNA, 982 bp, Oryza sativa
aaaactgaattgacaatcttttggtacgtgatcagttccttcacaaaagaaacaagtgatcctgctcgttggacacctgtcgggtggatggccttcctcaccatgaacgcatgcagaggcacacgagctggcaacatgaccgatttctccacaacgagagcatgccttaagttctattttattctggttaaaaccttggggagacttcgcaccttcatcatctgaggagacttgatctgaatcttcactatcagacactctacctccattagctaaaagatgctctgtcaactgtggtgcacctcggaaggtatttcttctctgacgtcttgtcattcctggtgtaggccattctgtgctggtaatgatcatcttacggacttcatcttcggttcgcattggtgcttttcttttctgctgaggacagttccttgcatagtgcccttgctcatcacacataaaacagatgatacttgcttcttttgggtcaacatgtggtatggcatgaggggccttctgggatgttggcggtgcgctgacttgtggtgtgaatgcttggactgcctccaactgcacttgagggttgcatctgactcgggttcaaaatcggcatccgatgctgctgtagtatctctataagcaatttgttctggttaatcaggtgttggaccactgccgcacaactggtgtctggtgcttcattcactcgggagcttgaggtaccaatgtcctgacttctgaccttattgcctttctcattgtcagccatctttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgac

SEQ ID NO: 28602 - DNA, 524 bp, Oryza sativa
  unsure (1)..(524): unsure at all n locations
nnnnnnnnnnnnnnnnnnnnnnnnnnnnnnnnnnnnnnnnnnnnnnnnnnnnnnccttaggttgagcgcggtttatcattgctcccgggtgtattccggtattgtgttgatacgcaagtgaatgcattgctttccatttcgtggttagagccgccggttaggcggcaaagatacctggatatagaacttcgcgaggaagtccggttacttcttcgtatttacgcatttttgttactggaaggctgccacctcgctttttaagcatattgatggcctgaggcgttacgccgaccttttcagcaagcaccttttgagagccgcccactgcattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28603 - DNA, 643 bp, Oryza sativa
  unsure (1)..(643): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcagaatttcttcgtgtgaggccgcctgttttctctagtaccactaatcctgttgaagctagtgattggctacatgccatagagaagaagttggatttacttcagtgtactgatcaggagaaggtctcatttgcatcacatcagttgcatggccctgcctctgaatggtgggatcacttccgtcttaacaggactactgctgaacctatcacttggcttgaattcaccgctgctttccggaagacgcatataccatcgggggtagtgtctctcaagaagaaggagttcaggtcgcttacccagggatctcgctctgttacggagtatctgcacgagttcaatcgtcttgctcgttatgctccggaagatgtgcgcaatgatgaagagcgccagnnnnnnnnnnnnnnnnnnnnnnnnnnnnnnnnnnnnnnnnnnnnnnnnnnnnnnnnnnnnnn

SEQ ID NO: 28604 - DNA, 934 bp, Oryza sativa
  unsure (1)..(934): unsure at all n locations
nnnnnnnnnnnnnnnnnnnnnnnnnnnnnnnnnnnnnnnnnnnnnnnnnnnnnnnnnattgatgaactgtaaagcctgcaactgctttcgcaaaaatactgtagtctgcacgactgccggaaattgactttgatgctgccgagagttcctgttctttgatcataacaacttcgccttcatatgttcggtaaagatgttccgttgaaaagtgtcataccctgattttcgtcttaggatttataaattatttaataaattattaatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaatttttaatcatacaaagagcatttcagtaattatccacatattaaattaatcattaaatggtctaattataattttgttaagtacttttagtgtccaagtattttcaagatttttcttggaattatttgagcattggaagtatttttaacaattgaaagatcatttaagtgattattttaattggaaaaagtttttaaatccttccctaagtcgttgggccgatttcggcccaactctttctctctccgcgcagccaaaccggcccaatcggcccagctgcagccgcccgccccctcctctctctctgtcaaagtctagtttgcctccctgctacagtgtcgtccctaacctccagccggctgcctagctgagcccgagccgcgcgccgcgtcgcctttccgcctccaaatccgctccaatccgaccccgtttcttccggatttttgaggggttttgatcctctcgttctcctctatcttttcccccaagaatcggagcaaatcgttggg

SEQ ID NO: 28605 - DNA, 924 bp, Oryza sativa
accgccgagcgctagccctctccttggaccgccctaagtcggttcccaaaccgacattgccatcctataaacccgagcttccccctttcctttcctctcccattcgcctccggtgctctgttcgccgtcgccgttcgtcgttgcgcatgtcggaggagccggcacgagcaaggacgcggaaggggacttcgggcgcgccctctccttcctcttccccggcccgaggccggagagattactcccgcgccgtcggactctcgtcactgcgccccgttccgcacggtagtgcatctccccattctccctcctcgctccatctctcccccttagttttcggtagtaacacgagtagcctccccgtagctagccggcgccgccccgaccgttgccgccgctcgccgtgtgctcgccgccgtcgccgcccgagctcggaagcgccgctcatcgctggcctcactcggcgtagctccgcccaatccgacgctagcatcggattcccgtagccacgtagatgctctcgccgccgggaatcggccccacgtgacctcgtcgccgtttcccccttcttccgccgccggatgccgctgccgcaattcgccgccgtcgggcatcctccggcgaatccgagccgttggctcgtctcctctcgtcctgtgcaaccacccggtgtgctcgctttcgcctgtatcgccgtggttcgctctgccgctcgccgctgtcgtccgccgtccgttccggccggcgtcgtcgtctacctcccgccggcccgcgtggcagccacgtaggcgccacgtcggcgccagctcggccgagatcgggtcgagccgacccgatcagccctttcccgtgcacgcggtccactgcgagccgtgaggctgcacgtgggcccgccgcatccgcgttctccgcgaccgcgcgcgtgca

SEQ ID NO: 28606 - DNA, 677 bp, Oryza sativa
cagactcagctaatgaacatgatgatgcaacaacttcagaatcagcagaaccaaggaattagccatgcacctcctcagaccaagtaagcagagtttcttcgtgtgaggccgcctattttctctagtaccactaatcttgtagaagctggtgattggctgcatgccatagagaagaagttggatttgcttcagtgcactgatcaggagaaggtctcttttgcatcacaccagttgcatggtcctgcttctgaatggtgggatcacttccgcttgaataggactactgctgaacctatcacttggcttgaattcaccgctgctttccggaagacgcatataccatcaggagtagtgtctctcaagaagaaggagttcaggtcgcttacgcagggatctcgctctgttacagagtatttgcacgagttcaatcgtctagcccgttatgctccggaagatgtgcgcaatgatgaagagcgtcaggagaagtttttggaaggacttaatgatgagctttcttacccactcatgactggagattattctgatttccagaaattagtggataaggctattcgtcaggaggacaagtacaatcgcatggagcagaagaaacaccggattgctactttaaggcacaacaggggaataatcaaaggccacgtcttactttaggaccc

SEQ ID NO: 28607 - DNA, 821 bp, Oryza sativa
ttagccccctcccgcggtctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccacgccggcctgccctccgtttcgcgaggtgacccccggagctgcgtttccgccgtcgcccatccatttcctccgcgccggccgcctccagtcgcctccatctccctgcctgcacgccggtcgacgtcgccaccacctccctcggctccacgacgccgctctcatccccggcatcacctcctcctcgcccgaacatcgccggaacaccgtcgcccgcgccggcctcacctttctcctcgtcgacatctcctccggctgcccctttcgccatgcccgtgcatcagccgacgctgccgtcctttccctcggcatggtgacgtagccctccacctcgtccactcctcggtttcgccggaacgccatcgccgcgagcccctccatccgcctcgccggagttgttcggccgcccgtccctccacgccgtgcaccggtcggccacacccccatcatcttcggcatcgcagctgcgacgtcgtcctcggcctcgcctcccctccgaccgaacaccgccggtgcccgtcgtcgtcttcaccgttccctctcgcccggctcgtcgtcttgcggcgccgcctccggcatcgtcatcgctgcggcgtgttccacgccgtcctcgcctccatgcagccgttgccggctgccctcgtcgtctcctcgccggctgccct

SEQ ID NO: 28608 - DNA, 1700 bp, Oryza sativa
  unsure (1)..(1700): unsure at all n locations
nnnnnnnnnnnnnnnnnnnnnnnnnnnnnnnnnnnnnnnnnnnnnnnnnnnnnnnnnnnnnnnnnnnnnnnnnncatcttcacaggcgctcaactggggtataagccaggactccgcctaagacatcttctccaaagcttctcttactgaaggggggaaagattgagcaagaatgagtacaaccacagtactcagcaagtcacaccggcagatgcatggttaatgcaagggggtacaaggagataataatataggggttaagttttgcagaaaagcagcatttataagtcacttagttgcccaaagctattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccatattttagtcgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgacgcccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaacataagccaaccattccatggtgtccaaatgatatgagaatttcccaagtctaaagttatgaaatccaactaatgttgtcctattaaattgcgaagcatctacctaaatttaaactagggataccacgagtagagtgtccactagttgaggttttgtttactctagggtgaacaaggtaataatcataacaataacaataataaggtcataacaaaggtaaataggcatggctaaataaaacagtgataacgcgggaatttaaataaagcggtaatgcaataatttaaatcaacataattttacaaactgggattcaatatgttcaaggatgatgtgacttgccttgctcgctttcccaaacgacggcttcgacttccacgaagagcggatcttccgaaactgcagcgtctacacgaccaacggaaaagaaaaaggcttttactctaataaactccaaataacaagcaggaacaaagcacaaaaatgggttctttacttcttaaggaaaaattagagacttgaacggtccaattccgagttcaaatggccaagatatggccatttgaagtttatatgctctttaaatggatacttgcgaattcttcatttaaattttaattaaaa

SEQ ID NO: 28609 - DNA, 4007 bp, Oryza sativa
  unsure (1)..(4007): unsure at all n locations
ctttttataaaccttttcaactttgtttatttctttcaattattatttgtgctctgaaaattccattaaaatttgagggctccttttagaccaaggagaatttaacaaaaattctccgggtcacatttgaattttttttgtacgtattttagtgtttgccaatttcttttcgaattttaattaattctattattccttttagaagatgatttttattttcgggatgaatttatcaggacgtgacagcggcctgggccgagcaggccgggagggaagaggggggggaaaggcagcccgggagagagagggaggagggagtgggccgagggaaaggggagcccaagagaaggagggagagaaggagagggagagaaaaagagggaggaaagggagatttttgggctgggcttggcccaaaggaggaagagagattatttttaggttttctttttttaaataaactttgataattgtttttgttgcttaataattatttccggtgctctgaaaattcaagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgactttgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttgcacattcagccctgacgtattctttttagatttctcttatcaatcacctttcgacctacttctttgttcgataataaacacctttgctggtatcttctatcaatcacctcttaaactttgtcaaccaagtactcttcactccgagagttgtggatgcttctggtgacgatgaggtcctttggcttgctgcctttccgtgaaaccttgaagtgtttcgccaaaagctatactaactgtcgttgcctttgatccgaaaaggacgcatctgtaactcttagtccaaacaaatgtctctttggttaatcacttgatttttcttttccatcctcaggttggttattagctcgaggttagaatatagttcctctggcacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccgcctaagacatcttctccaaagcttctcttactgaaggggggaaagattgagcaagaatgagtacaaccacagtactcagcaagtcacaccggcagatgcatggttaatgcaagggggtacaaggagtaataatataggggttaagttttgcagaaaagcagcatttataagtcacttagttgcccaaagctattttataaaggcgatcctagagctacacagtgttattaacagncccgtgaccctcacgaacctccttaaccaaggcntacgatattcagaccgaactggcaacccaccctgggtcccagctcgtcccaagccaacccatgccaaccattccatattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacgggcgaaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatttcccaagtctaaagttataaaaaccacctaatgttgtcctattaatcagcgaagcatctacctaaattcatactagtggaaccaggaatagagtacccactagttggggttttgtttattctagggtgaacaaggtaataataacaatagcaataataatgtcataacaaaggtgaataggcatggctaaataaaacagtgataacgcgggaatttaaataaagcgataatgcaataatttaaatcaacataattttacaaactgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaagcctataaagaagcaataacaacacataaaaagaaagcacagggttctttaggttataacaaacattaggagacttgaacgggtcgattcagagttcgtatgaccaagatatgatcatccgaagtttaatgctgttatatggagatttgcgaattattataattaagctttgcaattataaaacatgtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgataaacggactccactagacaccacccgggttgcacacgtggaaaccacgcgggtaccgagcgggcacactaacgcggacactacacgggcaccacccggacgcgtgaacaactaccgacaccggaacacgggtaccggggtcgacgaccggacaacgggtacggggcgacaccgaaaggacaagggcggggaagcgagaagaggaaac

SEQ ID NO: 28610 - DNA, 4723 bp, Oryza sativa
  unsure (1)..(4723): unsure at all n locations
cgcgggggggttccctcccttcgcccgtgccggcgaggccgccttcgggcgcgccctcgcggttgccatgtggggcccggctgtcagccgcccgcgcccgcgggtgcggctgacgcgtgggacccacggcgccgaccgccgccagccgcgtgcgcccggtccaccgtggaccgagcggctgacgcgtgggcccccacccccgtggacccggtccgcgcgtcccctccctcggctgacgcaataaataggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagtttattagagtaaaagccttttcttttccgttggtcgtgtagacgctgcagcttcggaagatccgctcttcgtggaagtcgaagccgtcgattggggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattactaccttgttcaccctagaataaacaaaaccccaactagtggacactctatttatggttccactagtatgaatttaggtagatgcttcgctgattaataggtaacattaggaggttttacaactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagcccttggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgattaataatattgtatagctctaggatcgtctttacaaaatagctttgggcaactaagtgacttttaaatgccgtttactgcaaaacttaacctctatgttattatccccttgtactcccttgcattaattgtgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctcttttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggatattggtacctcaagctcccgagtgaatgaagcaccagacaccagtcgtgtgacactggtccaacacctgattaaccagaaccgattgcttatagagatactacagcagcatcagacgccaatgctgaacctgaatcaaatacaacctcaagtgcagttggaggcagtccaagcactcaccccacaagtcagcatgccgccagcatcccgaaggacccatgatgacgtgccacctgttgacccaaaagaagcaagtaacatttgctttacgtgtgatgagcaagtgcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctaatggaggtagagtatctgatagtgaagattcagatcaagtctcctcagatgatgaagatgaaatggaacgtaaggcatgctctcgttgtggagaaatcggtcatgtcgccagctcgtgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaacggagagaagcatcaaggcaacaccaatcctcgccaagattacagtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatccccgaagcagtcctatagcccgcgttgcaacagctccaattccaatgaatgcactaccacaaggtgtcaatgctcaatttcagccccagccaccagctgacaagacagaggccagtatctgcgttgtacctttggaaattccaatacagcagctgagaaatcaagtacaagatgaagaacccgagtgtaagaaagttattgtttgttacaactgcagtgaagaagggcattactccgaaaactgtccccaaccaaggcaaaatcgacctccacattaccgccaatttacacgaagcagacattccaatcgtattgtggtcactggagcaaacgccgtacccgtaaggcctcgtgataatcagaacccatagcagaaacaatgcaccaatgctcctccagctgcacctgactcggcaataaatcatagcaaccactctctgcatcgacagcctcagcaaagaattgtcgtagatggaagaagttgtgtctctccccgacctactccaggccgagccaagggcaatcaatatccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagttcgctacttatcatggggtaatcgaaagtttgcagcaataatgcaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcttttggaagatgcggatatgtgattatgtgtataattgcttactgataaaggagacctagggtctcatttcaaaggaannnnnnnnnnnnnnnnnnnnnnnnnnnnnnnnnnnnnnnnnnnnn

SEQ ID NO: 28611 - DNA, 8186 bp, Oryza sativa
  unsure (1)..(8186): unsure at all n locations
tccgatgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacggaacggcgacgggaatggcggccggcggcaaaggaaggcggccggacttggcgcgtccgttcccggcgattgggggcgccattcaagggggaattaagggggaaagagagaggagggaaaggggattaattccccctaatcaatttgggaatcccatgcttgaatcgagcggatttagaggaggaagcgagctagggttcacgggagagggagagaggacggccgggcgggaggaaggggacgacgcccggcctggcgcgtgggacccaccggtcaggcggcggcgtcagcgcgcgcacgcgcgctgcacgggcgggggcgcggctagggttgggccgggtggccggcccaggaggagaggaggggaaggcggcctgggccgagcaggccgggagggaagaggggggggggaaaggcagcccgggagagagagggaggagggagtgggccgagggaaaggggagcccaagagaaggagggagagaaggagagggagagaaaaagagggaggaaagggagacttttgggctgggcttggcccaaaggaggaagagagattatttttaggttttctttttttaaataaactttgataattgtttttgttgcttaataattatttccggtgctctgaaaattcaagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacagacacagattctttcacccaaccatacagttccgtgctcatcttccaagaaaccaatagcttttcctcttctcatattcttcttgatctcttgaatatcaggatcattaatttgggcttctctaacttgatcaattagagtgggcttcgcttctaaagctgcaacgaaacctctaccgacaattcccaaatttaatctttcaaattccttgcataattccaatggcaactgtcgtccttctgtagcattgcaataaccttttctgctaagagcgtctgctacaacattagcctttcccggatgataatgaattcccatgtcataatccttaattaattccaaccatctccgttgtctcatattcagatccggctgagtaaagatatactttaaactcttgtgatcggtgtacacttctgtacgagtaccgaaaagataatgacgccaaatctttaatgcatgaacgactgcagctaactcaatatcatgagtagggtagttcttctcatgcggacgtaactgacgagatgcataggcaaccaccttcccatcttgcatcagaacacaacctaacccaagtttggatgcatcgcaatatacttggaaacccttctttggatcaggcaaaatcaaaataggagctgatattaagcgacttttcaactcttgaaaactccgctcacattcttccgaccatttgtacttcacatctttctgaagcagtcgtgtcatgggcttagcaatcttagaaaaattctctataaacctccgataatatcctgcaaggcctaggaaactgcgaatctctgaaactgtctttggttgcttccaattggttacggattccacgttactaggatcaacggcaactcctccggctgagatgacgtgaccaaggaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattctaacaacccatacctagtggtaaaagctgtctaaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaattaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcatacccggtaaatcatctgggaacacatcaggatactcccggactatatgaatctcttccaaagttatttgattcagtcttgaccttaaagactcagaagacaatgcatgaacggttacaactcgaccatcatagctgttgagagttacttttctgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcaccttgagcttctgcagcagcaatatgattgacacgggcctttgatgctggtacagcagagttactctgggcagggacaaccttcacgcgttggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatggactggggtcctaaagtaagacgcggcttctgattatttccctgttgtgtcttgaattgagcaatccgacgtttcttctgctccatgcgattgtacttgtcttcctgacgaatagccttatccactaatttctggaaatcagggtaatctccaaccataagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactacccccgatggtatatgcgtcttccggaaagcagcggtgaattcaagccaagtgataggttcagcagtagtcctgttaagacggaagtgatcccaccattcagaggcagggccatgcaactgatgtgatgcaaatgagaccttctcctgatcagtacactgaagtaaatccaacttcttctctatggcatgtagccaatcactagcttcaacaggattagtggtactagagaaaacaggcggcctcacacgaagaaattctgctaacttgttctgtggaggtgcatgattattcccttggttttgctgattctgaaattgttgcatcatcatgttcataagctgtgtctgctgagcaagaacttgggccagagtgggattctctccattgatgttattattggggttgttgggaccattcccattgctacgagtgttcaccatctggtatggataggataagaagagaaaacgggggaaactacttaggacagagaattactttaacttttattgatcttaactgagtttcattattacaaactgaagactcccacaccactaaactctccaacttcctaacactcaaaagcaaacaaacacatgcaattacatcccaccactgatgtaaatcacatgcgagacccacacacacaaacaaacttaaaacaagcaaactaacacaacgatctaagacaacgacttaacaagtcactctagttcttccgagcataggaggtcgattgaaggctcatcttcatcatcttgagttgctacccactcaatcttggaattgatgcgcttggattcttcttcttcatcactacttatgatgatgaccggaggatccgcttgagctggggcaacttctttctccaccacacgaacctttggcgccagttgatagcgagggacaaataaagctctcttccttgcggtaagacgaatcctggccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctggggttggcgaggatgatagcgatactcagtgtcgaccaactgatcactgtagcgatcacggagctctcctatggcgatccttgccacctcctgacatgcatggatgtagtttcttcctccagcttcaaacattactgaggggatatcttcactattgctgttcaaggtgactttgactcggcacttttcttcatgacgatcatgacgaatctgggcataaaaaggagcattcccaaatccaatgacaaaggacatcgtacgcaactcctggacaaaaccctcaacgccaaacaggtactcaggcttgtaacacggcatctaaagacaagtgaaaggagggagttaagacatctatccaattaatagcacaagtttttggattaatttgaataaaggtagaaaatcagaataaaaaggtaagtaaataaagtaaaccaagctttgcgaaataaattaaaacagttggaaacgaggtcacaatttttgtaattttgaataactggtttcaaaagaaatgaaagaaaattataaaatcaatatggtaaatttattttattgcagcaagattaaataaaacaatattgtaaaacttttgctgataaatgagccattagtacagtaatagatgtacagtactaataacactggaataaattttgaatgagaaccattaaaagagattatgaagtgcatgtgccattagtttggttaattaaaagagaaagggaggagaacagttctacttttccaatatttttagagggcttctatggataaccatttggcataacctagggtcaaaggggctctgataccaacttgtcacgcccggaatttctatccaaaattccaaacgcttagatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgcagacggctccactccacaggcagcttgaccaaggctacacctaatcctccacaccatcagcttcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtaccattccaaaccaggagctaatcaaattattaccagtatatagcatcatttactatgatgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacatcggaaaggagttgtgacaataccccttatacaacacaatccactgcagcgcaccttcctggatcataatcacccccttataaacaaggcatggactccccagcgacccccgtgggcttatctccgccacttctcagtctggtgctccgcaatgaaccatgcgatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaaaccatcattaaataataatgaatcattagttatcccaaaagtgagctaatgtttctaagcagggctaagcaattatatctaatatcttgttgaaccaatatataaagctcaactagtcaagttataataacccaaggtatcaaggaataaggtaaacaagaacaaaaggggctataacaatgaataggttaattccacccaatgacattcgaaaataaatgcaatagttgaatagaaacaatagctttaaataggatcaacatgctcaaagggttgtttgggatctgtgtgacttgccttgctggccttggaattcttcaaactattctccgacgaaaacggactctccggaaacgacggaatctaagcagaaaagaataaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaaccggattaaaacacttaaatcggcttaaattgaattatgacgcaataatgaattatttttgaaaaggaaaaggggatttattgcgtcagcggctagggtttcggtggaccgggcgcacgggcggcggttcacgcgaacggacggccgagatctaaccgacccaagatggacggccgagatcgatcgggtccacggcggttcacggcggacggacccgatgacgccagcgatgacgtcaccgacggcggcggcggctcggcggagcgaacggctcgggcggcgcacgctcgccggcgaacggcggcgcgaggacacaaacggagggcaccgggacgaagcggacggcacggcgaactcaccggcgaccaaagcgacggcggagaagcaacggacggcgccggcgacgaggaggaaacggcggagaccttcgggtcgacgacggcgatgacactccggcggtcttcggcggcggcgaaagggcggacgaggacggcgacgcgacggcgatcacgacgacggtcttcccgagcggcggcgaagcacggctggagcggcggcgaagcacggctggagcggcggcggcgacagcggagctagggcgcacggcgctaggacgattccggcgacgagaggcaaaggcgagggtggcggcgggtagcggagagcacggggaagcttttaaaggggctcggagacgacggcggaggcccacggcgacggcaacggcgaaggaaacctcggcttggagagnnnnnnnnnnnnnnnnnnnnnnnnnnnnnnnnnnnnnnnnnnnnnnnaaagcgatttagccgnnnnnnnnnnnnnnnnnnnnnnnnnnnnnnnnnnnnnnnnnnnnnnnnnnnnnnn

SEQ ID NO: 28612 - DNA, 9808 bp, Oryza sativa
  unsure (1)..(9808): unsure at all n locations
ccaacgctttccaaagggattaggccgaagattccaaaggagaaaaggtagagaagatcccgaagatcatttcccctctattaatcgggcgggagaagaaaagaggcggccggatttggaagaaaacagcggcggcggctcggcggcggcacgatagggtttcggcccgaggaagacgacgggcctgacaggtgggacccacctgtcagcggctgcaagggcgcgcgcgcgcgcggctggctgcggactgggccggctgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattagaattagattttcttttcaagacttttaaaataaattctagaaattccatttaaacaacaatttatatattttgaattttcagggtgtgacaaacatcgacgatatcatccacagcaccaatgctcctcttgctccacctaactcggcaataaatcatggcaataatacctttagcaccaaccactctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagtccgctacttatcatggggtaatcgaaagtttgcagcaataatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcttttggaagatgcggatatgtgattatgtgtataattgcttactgataaaggagacctagggtctcatttcaaaggaactatgttctaacctcgagttaataaccaacctgttgatggaaaagaaaaccaattaaactgtgttgggttaaaaagccaatgagacagtagttggggaataggagtttggatacgccttttacagatcaagataaggattgttggatgaaacccataagggtacccgccatgcctctacattgataagttcggatatacctgcaaacagttaagaagatccaggagacatcaatatttgagaacataatagtcgatggttggtaattagtcgatcaggtatcagaaaagggtcaaaggtgatatggcagaagaacaatatggatgctccccatcccaaggaagcactaaaccctagtggcatagatacagatagcaagcaatgtatttccctgaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgatagtaattgcctcccccacaacagtcaccttgtcattaagtaagcaagatgacctaggtaaaagtgtttctatgaaggcaaggagtgaaatcttcaactcggtatcagatgctacacggagtgaaaagtgcaagcccaggttaccaggcgacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgagttgcttgttcgtgggagctattcccagttatgaaccaagtgatatgatcgaagatagtctacagaggtcagagtaaaatcacatctaacaacgaagcttcaaatttggccggataacgatcagacaataagaagtccagcagtaaaactatttgggaagacgtcaaagtatatcaagtgggataagttggttcccttgggaagcataattcaaaggcaaagttatcgacccttgcatcaaatagcagaagtagctatcacccggagaccaggaaagctaatatgaggcagttggtggcgagttagaagcaaatgacaagcatggtatcttagtaatgacgagctgatctcgacgcatgacatgaagtgggtaacttgtatgaggttgactccaaagatatgaactatgcaaagttctggaactgaatccccatcttcaagtgccgcaacccagtcgaagtcagctaaaggttcaaccagggataagtcaggtgcaaagaagattccatctgcaataggagatcgagccaagcagtccagagtggagaagctttgttaggcaagtttgttatagaaagcggagcggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaacactaaaatacgtacaagaaaaattcaaatatggcccggagaatttttgttaaattctccttggtctaaaaagagccctcaaattttagtggaattttcagagcacaaataataattgaaaagaaataaacaaagttgaaaaggtttataaaaagaaaaaccctaaaagaagtcctcttttcccccccttccttcttgggccggctcggcccagtccctccctctctctctcttcccccgcggcccatcggctcccccgcgcgcgcgcgccgctgacaggcgggcccgcccgccactctcgctgacgggtgggacccacctgtcatcgccttcctcccgccgcgcccgccgcccgcccgtgccctagcgccgccgccgccgctgaatccgccgcatcccgccttccccgcgcgccttaatgaggggggaattactccccgcgtttccctctcccgtttccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggtttcgtgcccgcgccgtgctcctctctctccgccgtcgccgccgaccttcggttcgccgccgacgtcgctccggtcctccgcccgactcggtgccacctccttcggcttcgccgagtggttgccgaccccgtccgccgctccgcttcgcccgccgactgccggagcaccgtcgccctcggcatcccgaaccgcgccgtcgccttcctccgctccggttcgccgccgccgtcgctccggtcttcctcccggctcggcgccacctccctcggcatcgccgcatcgccgtcgacctcgtccgcgccttcgtttcgctcgccgaccgtcggagcgccgccgtcatcgttatcccgagccgcgccgccgccttcttccgctccgggcgccgttctcgtcgtcgtcgttgtcccggggtgagccgtggaccgtcccttcactttccccctcctctccgctctctcgggcgctgctccgccgcgccgatggtcgccggcggtgaccatcggggcgcgggcgcgttcccttccgtcggccgtgccggcgaggccgccttcgggcgcgccccgcggctgccatgtggggcccggctgtcagccgcccgcgcccgcgggtgcggctgacgcgtgggacccacggcgccggtcggcgtcagccgcgtgcacccggtccaccgtggaccgaggggctgacgcgtgggccccactcccgtggacccggtccgcgcgccctctctctcggctgacgcaataaacccgatttttaattaaaatttaaatgaagaaattcgcaaatatccatttaaagagcatataaatttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagattcgctcttcgtggaagtagaagccgacgtttgggaaagcaagcaaggcaagtcacatcatccttgaacatattgaatcccagtttatcaaattattttgatttaaattattgcattattgctttatttaaattcccgcgttatcactgttttatttagccatgcttatttacctttgttaagacattattattgccattgttattattaccttgttcaccctagaataaacaaaaccccaactagtgggtactctattcgtggttccactagtataaatttaggtagatgcttcgctgattaattaggcaacattaggtggttttataactttagactttgggaattctcatatcatttggacactatggaattgttggattatggtggaattggacatacacctctcttcctctttcaaaacccctaaaaccttttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccttatgtgtgtggcgcacccggtctagatcttgttgcttggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagttagtggtttaattcttaaaatttacttaacaactaaaatgtggaaaggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaatagctttgggcaactaagtgacttttaaatgctgtttactgcaaaacctaacccctattattatccccttgtaccccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtggagatggagctgtaggcccgctagtccgctgctgtttatttttgattgtcaggcctgaagcgcctttgtaataatgtaaatattatcgatataataaagatgtgccttttgtatcatgtttgtttggtgcaccccggcttttcctgggacggggattaatgcactagcgttcgggaaaaggcaattttctcggtcgcgacaactgctccatgatcccaacttagttcccaaacagtagatttatcaagaaccgaacttcctataccgatctaatacgatattataggcaaaattacccatctaacctttcaaccaatcaataagctaatacctgacccactttttttaagtacctttttataggtaccttgtattgtagaaggttggaattggatcaacggtcatcttcatttccaagcacaccggagaaacacttgtacaaccaatggatcttaatttgcttgcgatgcagagaatgcatcacacacattggaggttataaattcctgatcagcagtgagaggtttcactgaattaattcagcaaagcttcgcagcagcttagccaggataggatgtcgtcgtcgtcgtcaccgcaggacgggcaggcgagggcgcccgccggcgacgccgaggactggaacgcatggttcaaggagatgcgcgggtggctgatggtggtggcgacggtggcggcgtcggtgacgtaccaggcggggctgaacccgccgggagggttctggcaggacaacctgggagggcgcggcgggcaccgcgccggcaacccggtgctgcgcgacagcgtcgcggcgaggtaccaggcgttctactacctcaattcgacgtcgttcgtgacgtcgctggtgatcatcgtgctgctcatgagcaagcgcttctacgagacgaaggccaaggtggtggcgctgctgctcaccaccttcgccgacctcgccggcctcgtcggcgcctacatcgccggctccacgcgctacatgtcctcctgcatctacgtcatcgtcatcgccggtgtcgccttcctctgcgtcatctacgctggacagtgcgtattatatttatggctatcgacacatatgttatcatcgtcgtccatatatatctatatccatactactttcaataatattagtggtggtgttcagatcttccttcaatatgtcatctcataagttggttgatatgtgggggtcttaaggtctccccatttgaatatcctttcgttggatatggcattatatagctaatcaactaaggccattcccaacccaagatactagacatagattccataaactccacatcacaaagaaactagtactagacactattttttcaatgcaaacaccactatttcacacttaactttaatgctacttatatcacatgatgtcttggatgttgtgtagaaaccatgtctccttctcttttctcatttattgatttgccacatcatttttcttcctaggtggcagcttatttaatgctatggacaccatcctagttattgggttaggaatggcctaactgtgttataaccttttaatatttgtttttgtttttttctcttacaatatcagttgcaattaatacacgggcctatatgtatctctctataaacctatatatgttacatggtttcagtgtaatggaggacgtgatccccgacatgaagaagatcccctgccttgacagtggggggttgtttggggactacaaccgcgcaaaggctaaggcaggtgaagctgaaggacgtcagagcgtttgagaattttcatcgccaatttatgagcctatctggagttctattaaacatgggacttttccatgtttgagagagaggggcgataagcttctgtcgggaaaataatcgtatcggtatacttaatcctatcgtcaaatatttttacaggttgtactatagagatatcagtgcgaataagttgatcattcccaatataatcaggtgcggtccgctaatctgcagcagcaccgtgacagcccttaatatgtaatagagagatctactatatataaatatatgtcacacagtttctttcagttcaacgattttttattacattgcttatttctataacatatatacgagtttatcaattagtctataatatgtcgttaagctttttttaaaaaaataatcaaaatatccttataacatataagggtaaaaaataatttatcctgtcggcactactggagaactgatatttgctcggatgacaaaaatcaattttgtcctggttcgaataggaacgggactaagatcttaggccggattcaaaagcctaaagactttttatgatctttaatcccggttgataaatattatttttattcctggttcaaaaagtcgtcaggccgtgtcaaacccaactatctttactcctgtttgatgttaccaatcaggactaaagatcaacactttaatcccggttgtttatgccatctgggacaaagattgaaaaacaatctggaacaaacgcgttgagccgcacgcctccccgcctccttattgacggaaaacacggcggcctaggagatatgcttaactccagtgcggttccaaggcttgtctcccgggttaagggcgtgccaactcgtttgatcctgcaaccaacaaggaaatcaagaaaatagagttaaatgacgaacagtcgatcaaccaataatccgatgacgtatcgatagtagatctagccgatgtagttaccccagatcggctgtgagttgataatcaggtaaagcaaaccctaaatatgtcccatcgactgtaatatcatctattaggttttattaagcttttcgatgacacagtatttggagcaaaaaatatagaataaagataatatactagctattactctaatacagactcatacaaacaaataaatctaaagaaatatatcaaataacaaacaatcaccaagtttgacaacttagctgatattgatctatacttgatatatttacataaagtgatttatttgtataagtggcaaatatacataaaacagatcatgaaacatgctctataatgcatattaggtaagattggttgaaacgctgatattatcgttaattatgattaattgcatgttagtttataggttctaaacaagactagggatgatgcatcgcaaagtatgtaaagaaatctaaagtctaaacaatcaagaaattaaccacttttcaggatggataccttagctaatctaataactaatctaatctagtaaagctatttagccaatactggcaagaaccctaaagagagaactagccggtagggttcaatcgggatactatgattagcttaactaagatatatgatagcagatggttatgataaaagaattaatatatctaaagcgacatactagccccgataggacaagccatcgaggcaagttacctcttgtcaagagaactcgccgaaaagaagaacaaaaaggtggtgatgccccgaaagttgtatattggattgttgtcccttttttacaatgatctgaggtttatatttatacccagagtgcaaacttagtccattatgtacatggttcaaacttgcctaaagataaaatacaaacaagtccatacggcggactcttgccatatgtctaacttaaaccgacataaatatcctaattaataaatnnnnnnnnnnnnnnnnnnnnnnnnnnnnnnnnnnnnnnnnnnnnnnnnnnnnnnng

SEQ ID NO: 28613 - DNA, 13414 bp, Oryza sativa
  unsure (1)..(13414): unsure at all n locations
agggagaagtcgggagggagaaggaaaaagaaacgaaagaaagaggaaagtaaaagagaaggagaaggaagaaaataaaagagaaaagaaaaaaaaaagagagagaggggaaggagaagagagggtagagtgggccccacctgtcagtcactatagctcgtggataaggttgtagtataaataaatgaattaggaacagtagccttttacaaactttcggatttattccaatttgaatctttaaactagcgtaacttattcgtcttaactccgattcgagtgaaacttgaacctaaattcatctaaattcataagcttaccaatggtatacaattagctatttaataaaatatatttataattataaattaatatcaaatgattagataatagttaacctaaatagtgtgccaataaataaaaatggatattgtacagtagaataattatccttaatatgttttgtcactgtagcaaccacataaattaagtataatcaatgtttgaaattaatggatatataggaaaatattagtgccatttattaatctatgtccaaatataattaaaacccacgacttattagttatttaaatagagttagccttataattattaggtaagtaaaatatagatacacatagatcgatcctaagcttgtttatggcaaataataacagagctagtgtgattaaatcacctatatgagattaatcaacgacatatcccatataatagcatatattatgagatgtgagcaacccttagttaaccaagcagtaaatagaaactattcaaataaatgattcaatatattaagatattgcgcacacgtatattgtacatcccattatagatatatggtatcgtattaatttacttgttgcatatattaatttagagggagtataagacaaacatgaatattagataaatgctagctatacatcttgtcctcgtataattacagatcaactgtaaatttggattattcattgtaaaattatgtgatgggataatccgtaaccataatatgattaacctaaacaattctaacatacaaagcatgggtaattgttaaccttttataatttattttgagaagtgaaatatgtacataattaaaataaagcctccattaataaaataataatacaaatgattcacagtaattatttgaccgatccaaaatccatccggcaacagaacctctagtgtataaccgttctatttagatagatgcatgtgtaaccataacccttccttagccattagctagactgaaccaccatgacaacagaaagactaagaaaccttagctcttagcttgattagagtccattagcaagcgcgaataatataagcaaccttaggttcgacctcagcaaatatattttgtctgtgcatatttgattgttgcttgaatattggtttttctcgcgtattatagactttgtgtatcggttagtcgtgaggcaacgtctgcaacttccagaaggtgaaggttgatcaagattatatcgagaatagggattatcctgagcaggcaagtcatcactattctttgaacatgttgatcccaattgcgaaattgttttgtttacaaataaaattgcatgcaattatgaacatcctacttgtgattataccatgccttgactattgttcacctttaaatctttgtaaccatagatacgtacgagtccttagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccgggaaaaggttagtgccgtccctggtcaattaaggaccgagccatgaagttaagcatgaaacgacccccgtacaaccgcacttctcgtatgggtatagacctagcggaatagatagctgagcggaggcagtatccatgcatagtggtttcttgatgtgtgcggtaggggctctacggtggggcagtcattggtagaaccgcgaggcgggtgtctacagtggtgtcgccatcagtaggactaccatgtgagaatttgaacataattacaacttaatgcatgtgtgagtctttcctccccgggtgcgccagaactcctctcactgctagaaaccgtgtacgcctagagtgcatgaggatttaagttcatggagcgggtactgccaatgcgaggttatcgaaaagctttgccgtgacgcgtctcatgtgttgggacgaggctcatgtgttgggcagtcacggagtgcgggtaaagtgtacatccactgcagtgtgagtaaaccaaatctattcgaatagccgtgctcgcggttactgagcaccgggacatgtattacacttggctagactctaaattcttaacttgtgtgggatgggttattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatataaactctggtactaaaatttgatcagtctatggtaggttttaggcttgtgaaaagaattgtaaaaattagctttatgcaaaagaacctgaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgccttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggccgacactatcacgaattataattaattccaaaaactattttagggttctaaacaagactagggataatgcatctcaaagtaagtattgagctatatattatgccatcctttgtgtattttgtgcacttgcatatttgttgtgtggcttgcggagtattccatgtactcactttgcaataatcaattaaaccccagttgaagaaaagattcgaagcagaagacgtttggcttataccccaattaagctgcctgtgggagtggatatgatgccatcgctagaccgtttatctgctgctattttcttttcttttgtaaatatgtaacattattattatgatggatttgtatattaaattgtcagtttataaacctcggatgattcctggacgagggttttaatgcacaaattcgaaaattacttgtgaatttttgggcgtgacaatcaattccttaatgggccaattaaaaaaatagcatatatatgacttttagcaaataaattttacattctcaagggaaaaaacaacttccaaatatttacactcaataaagatagaaattacagtcaaagttacaatgtaaattcaactaaaacaagttgtaaataatattttaaataatgtatagcactttaaatattacattaaaattaaaccatagtaaattaaacaatagaaattatgtaatcacaaaaaaataataacttacaattatattgataaaaaaatacataccatttacactgtaaatttagtaattacacaatgtaagtttagtatttgcacactgtaagtttagtatttactccctctgtcccttaatataagagattttgacatttcatttgcaccgtttaaccactcgtcttattcaaaaaatttgtacaagtataaaaaatggaaagttgtgattaaagtactttggaataaagtaagtcacaaataaaactaataataattccaaaattttttgaataagacgaataatcaaacagtgcaagcaaaatatcaaaatcccttatattatgggacagagggaatacatccgttttcgctgcattgagcagagtactacatcatgtcaggctcagaataaaatcaaactcctacatgacaggacgggaaccaaacacccgatctgaccctaaatcacagcctcagcacagatatggaatccaacggatgaaaattcgacaaattttgactgagaaatctgtcgacagatgcgtaataaattcgattttatctaatacaaccctctatattttaagaaaataatcaatgtatttaagcatagaattacattttagcttgcacaacgaaagagttagcaactagctagttttgattaacggacgtatgcaatgcaaccatgagaaataaaaatgtactttcaaaacaaatatttgtttaattaataagaaaagaaataataacaatatcgcacaagattcggtagactacaatctagcagatccatacaatctgcacaagaaatttcttatagtttgtaactatgtaaacatgctaaaaaaattatctaaaaaaaaacatgttagaaaaaatgttgggtgtaaactccatatagacatatccttcgtgaatacgccctagatcagagaaagttaaagttggcatgattgtctcttttttccaatcacaaacgaggttgccagatatgttcttttctcattcgtgttagttagccctcctgttgatcctcatgtcgccatggcagccttatgatgtacttgtatcaatatatcatccgttgatccgtacactgacagcattttatatttactggacagcaacacaatcaagaaaagttgcaattcttcagcctgaacagcctgatgaacgaaaatcccttccttgtccatgctgaattaacctaaagctacataacatatttatatatatcggattgaaacctttcgtcctcttcactaaagtgaaattttcgttactataaccaatacagcttgcttgcaatccaaacaatgcacatacatggcggttataaatgtacggcacttacagtaaccagagtgaacaattaatggactgcagcgagaggatgtcatcagagacgacgaggcataatcagcatgacgagcggtccgagcggaacgcatggttgaaggagatgcgcgggtggctgatggtgctcgcgacggtggcggcgtcggtgacgtaccaggccggcctgaaccctcccggagggttttggcaggaggacgacagggtcgccggccacagggccggcgatccggtgcttcgtgacagcgttgccgctaggtacaacagggttttaaatctcctactatagctgccactatctctagttataactgtatgagaagggttctagttatttgctctcatgtacaatttagccgctaaaactctatttagcatgctatagctaccgctatagctgtttgagaagttaaccgctaaatgtcttagccctctatttaaaacatgaggtacaagacgttctactacttcaactcgacggcgttcgtgacgtcgctggtgatcatggtgctgctcatgagcgagcgcttctaccgcacggagaccaaggtggcggcgctcgtggtcaccaccttcatcgacctcgccagcctcgtcggcgcctacatcgccggctcgacgcggttcatgtcctcctgcgcctacgtcattgccatcaccggcgtcgccttcgtctccgtcatcgccatgggagagtgcgtgctacgtacattaattacattacattgcatatattaattgataattagacaagctacaagcaatgttaatatatatagttagtgctgacgcatggtataatttgcttcagggtgatggggatagtctgcgatttcttcagggggaggtcgccgtgcatgagcagctgctacccgctccatggtagagctgagggtgacggactcccgatccacaaggccgaggatgaagagcaaggtagaggcgcggcgtttcacatcagtagtgttgacgcttgagaattttccccgattttagctaggctggaattgatctaggctacatatatgtaaaaatttcttcaagaattactggaaagttgagagagagagagagagagagagagagagagagttgtgttaagcttctgcaaaaatgcttcagagttcagtattccttttcatggactgttctagtctataggttgccagtgttctgcgcgcggttttcttcatgtgacatgcttgggcttttcatgaacatggagctgtctgtttagttatctgtgagtgtttttaatgatatagtaactttctatacaaatactagtatatgtaaaaacatcctatttttatggatggctatcataagcggtttctgatcatgaagcggtttaaaccaccatcacattcggttttccttttcggctgcttatgaaatggaaagtctaggacctataaaaatataatttttataggggatgtcgatctgttagtaattgaatggtatatggattttggaactgatggtgtgctccatagaaaatacaatctacagtcgaacacatttattccatcgcaaacggtcgaggatgacatatagtccctccttttctttttatcagcacaagtctttgaccaataattactctaccaatattttatttatgtgatataaaattatagcctgaagaaagcatttttgaatacaattataataacaacagttttgtggaagataatatgtacaataatcgtgggttagatcttgttctaataaaactaggtgggcgacccgcgcatttgcactgctagcatcaatttaaaattatctatttttatacatgattttattttaaattatcattcccgtggttctaataattttatagtttttaaaagccacgccagtcgctatcccttactcctttgtcatctttttatttgcttactcgatctaccactacttctattcatcctctttagaacttaaaaaattaggccttatagtttttagagttcattgtctttgttgggtttcgttttcatatataattctttgaagtatcgtcaaacattaccaatttactactctacagcccgtccgctatcatctctctttattatcattgggattttaataatcgaacataattattgtttgtgttctttttaaatttctataagtctccataatcgttagtggcttcgccactatacttctctgcagtccacccgctgcctcctctccttattgtcattgagatttcaaaaattgaacatgattattattggggtttatttttactctccataagtcccgtcaaccgtcgtgatcatgctacttaacggcatgcccattgtcactcctcttaatcgtcattgggattctatttgaagttttgtttatagtttttagatatcccatcgatcgccagcactctactaatttacaggcctattgctcctctcctctttattgccatttataatcattgtgttctagatggactttttttttgaaaatttgcatatttttcattccgataatttttattcgtaaattatattcctacttgaacttttataactatttttctattttttaaatttaatttatttgtcatttcgaactttaattaatctcgtcatgtgttctagattgtctcttatttcaatagtctttattttttattacaaattttagttatttataaattgtattatagttgagctcttatttttctttttctattttctgaatttattttattttttatttctaattttaattaatctcgtattgtgttttatatagactattcttttaatatttcttatttttttatttctaatttcaattgtttcaaaattgtattcctacttaaactctcttttttatttttctaattttttattttatttgatttttttattttgaattttaattaacatcatattggtttcttatatggactcttattttaatattgtttattttcaaattgtattcctacgtgaactctccttttatttttctaattttggattttattttatttttatttcgaattttaattaatctcgtattgggttattatatggactgttctttcaatatcccttatttttaattccgaatttcagttattttaaaattgtattcctacttggactcttcttcttttttttttctttttttttgctaattttggattttattttatttttattctgaatttggattaatctcgtattaggttcttatatggactcttctttcaatattacttaattttaattccgaatttcaggtatttttagattgtatttctacttggactcttcttttttttttctccgattaatgtggaaatttctaaccttcacagcgaacgtggtgtctgctttcaaagctattttaataatataatagatagatagatagatagatagatataatacgtccctatataaaaagagaaggaagggaatatatctttcccacattgtaggtagcccatctcacgggtacttttttgttttggcattctttattttaaggctcctttccagctaggctgatatcatgacatgacatagtaatgatgtaatcaagagtctaatatgtgtcattagtacacaataacaagttggagcaagaacatgtatatgttaattactcccttcagtcagaaatatttgacgccgcccaagaaggccgacaggctagtagaaactagaaagcagaagtgaaatatcacatagtaatacattagcacgctgcagtgggcatatatttttatttcttcatctcgaataattggacaattcctttcttgtccacttaaaaattcgcatatgtgcaccctttcttcgtcttcaccaaagatgggaaaaggaaagctgccttgcttgcaaagcagacaatgcacatgtaatatggacgtcattcggaaaagcgtaatcacaactcacaatccacgcgagtatttaaaccaacaattgaaacatgcaaattaaagcgcactgaaatcaatcagcgtcaccaggatgtcgtgctcgtgccagcgtcagtcgccgtcgtcgggaggccgcggccgcgccgtccccgtcgccgacgcggccccgggcgagctggcggcgccggaggccatcaacctagtccccaacgggaagcgcggcatgccggtgctgatcacgccgtcgctaccgcagcagcagggcggcgcgtcggcggcggcgttccatggcatcatcgtgctcaaggaggagagcgaggacccggtggcgctgcggaacaagtggttcagggagatgcgcgggtggctgatggtggtggcgacggtggcggcgtcggcgtcgtaccaggccgggctgaacccgccgggggggttctggcaggacgacgcgccggggcccggcgggcacagcgccggcaacccggtgctccggcacacgtcgccggcgaggtacaagacgttctactacttcaacgcgacgacgttcgtgacgtcgctggtgatcacggtgctgctgatgagcgagcggttctaccggtcggagacgaaggtggtggcgctcatgatcgccaccttcctcgacctcgccagcctcgtcggcgcctacatcgccggctccacccgcttcacctcctcctgcatctacgtcatcgtcatcaccggcttcgccttcgcctgcgtcatcgccatgggagagtacgtagacaccaatccaatcatctaactatctagcttcggccgtgtttagatccaaactttttgttcaaactttcaacttttccatcacatcaaaactttcctacacacacaaacttctaacttttccatcacatcattccaatttcaaccaaactttcaattttggcgtgaactaaacacaaccttcatgctagtagtgataccagggattgaaatgttggttctttttctttttcctacatggcaaacgcgcacacgcatactctgctatatgcatggtcgcacgtaacaccacattcacccccctaacacacgttctaagaaacggaaaccagtgacccatccctaattaatctaactgaaatcccgttgaaagccctccctcaaacacgtaatattcactttcacgcacccacgactccatgccaccacatcaccagtgtttttccttattttggttcgaaattttgaatggatggatgatgaatatatattgtttattcacctctgctccgcatgcagggtgatggagcaatgctgcgggttcgtgctgaggacgtcgccgtgcatgctgagcctggcgcagcggcactggtgcccggtgccgaggagcgtggtggacagggcggcgcggcaggccaaggacgacctgcacatgatggaccgcgtcaacaacaaagcgaaagcggcggcgccggggagcagtagtagcagcaagcagcggcgaccttgttgctgcctgtgttgcgccggcccgcctcccaccgatgtctgatcgatcgagagggaggggaggcggcagcagcagcagcagcagccggcagaggccatacgcccgtaccaatacaccatggcccttaattagcttgttcttgcatcgggcagtttgtgatctcctttaaactgctttttgcacgcacgcatccatttatgtttttttttttttgctacacatgttattcggctcttgtcagaaaaaaacatttttttctctgtagtatggatatgtatcatgctcggttgattttaccaatttgtcatgaataaaacaagggaacaatgggactacccatatgtatggatccatagttttttttttttaaagaaaaagtcaagtgtaaatttttctaacgagaagaattttagtggaaatactctacaggtaccgtgagatgtttccagctagtaaaaagggattaaatctccttgagaattcgaagcagcatggtggcagaaaaaattcaccaagttcatattggttatttgttcggtgtagtatactatgctgcatgaatttttataggccccattttaaattataaccagctgaggaaacaaggagagaatgctcaaggcttaaggaaaaaagagataaaatggcattggagatggctattgatagaaaggaagcaaaaaatgcttaacatcataccctctttcattaatgactaaaatttatctctttgcaatatggcttctttaataggacttgatttaggatgcacaatagaaatgatgggacacaacttggatacttttagggctttggaaagtgctagattggatttgttccaacaaaacttgaaaaaaaccaatgaaaagtgtcagacagaggacatatctgaattcaaaacatctgatttgggtgtgattgaagatttggcctctgacaatgactctgaacttgatatattagaagatatcctggagaaaatccagtcaaagtcagaaaaaaaaaagaaaactaggaatgctaagagaaactttatgatttgtaaggtcactccaaaagctaagaaaaacagaagacccaaaaataatagaagtacaaaatgaaagtaagggtggacccaaaagggttctaggtatgcaccggcatacccaaaaattacgaaaactttttaatacgtagttggtcgcgatagggtttagagaatcagcgttggcggtggcgcaagcacgtggcgctgcggcagttggcagtggacagcctcgattggaggtggacagcctcgattggaggtccacgccggctggactagccgctagcggaggctacctgcgatcggctatgcacaagcatgcagcagcacgccgtcgcggttgccagcaagtcggcgacaagcagcggttgctcaaggatgccgaccaagttgagccgtttgaggtgtcgtcctcgactcctcgtccacttgtccgtccatgtttagcccgagtatactctctctattgttattctctctccgatttttctcttagcagagagccatagattgattgaaaagtagaaaactgaaattagtaaaatcattgggagttaaaaaattgaaggcatatgcttttgtgatttaatttgtctgagatcaatttaatcaatcaaattcaaatgggaagaggaacatgtcgcgattctttcttaagctagaacataaagaatcttagtgagctttccatcaagctctttaaatcaattaaactcagtatattcacatcaagttgaatcaatcatattctgtcacgccccgaactagtaccgaccggaactagcccgtgacgttccaaattaacctgttaatcgataccagtcccaggaaacagtgccggtatcacaggaagacagaatatcacagcaacaaagatctctttattatagagtagaggtacagtcatgttgggctgcggacagatcccgagctcacaactgcattacaaaagggaagcggaagccaagacttgggccaaacaacacaggcgcgacttgggaactaggccgaaaccctaaaactcatcgaagccggcttgctcctggaagaactcctcgtcagcaggatccgcttcatcttcttcagcaactgggggggggattatttatatagagcaagggtgagtacgggagtactcagcaagccatgggaaataagtgtttaatgcaggcttcaaagaaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgaaacagggttggcacccggccaacagcttttcaaacggccacccgggccaaccactttcaaatggccacccgggccaacaatccttcaaacggccacccgggcctagctgatcccatcagctgcagatttttcaaacatcgaaaccctttccacaacagcaatttcacaagcagtagtcaaacaaaactacgctaggaatcacctcacatccgcccatgaccgtgggcacggctgttcgaacagtttgttaacctctgtagagggggtacactttacccacacaacattactaacccggatcacccagcccgtggggatcagccacgtcgggagacctccaagctttcatgacaaggcatttcgaaagnnnnnnnnnnnnnnnnnnnnnnnnnnnnnnnnnnnnnnnnnnnnnnnnnnnnnnnnnnnnnnnnnnnnnnnnn

SEQ ID NO: 28614 - DNA, 938 bp, Oryza sativa
gaacagtttgttaacctctgtagagggggtacactttacccacacaacattactaaccgggatcacccagcccgtggggatcagccacgtcgggagacctccaagctttcatgacaaggcatttcgaaagccgacacaggtttaccatatgctgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcgtacttgtcttatgtttggatgaaattccaaggaaacggtccttaagtgcaagagcggggaaaccgtacacccgatatgttccccggttcgcggttttggaaattcatttagttcacaagcaccgacccaggtgtcgggttttccaagtcttttgtaaaacccaagttttacccaagatgtttttcagattttaagtttgaaggcggccgtcgatactcgtgcagagtgcacgatttccgaggcgcaactgggtggttacaagggaacatggtataacaattaacaaaggaaggatcaaatgcaacaaactaggtaggtccaccaatctgccttgcagacgggacaacagattaagtgcgatcctatcaatgcataatatttttcaagcaacataattaaattcaaatacaggctcaagatgttcaaaggtggcttgccttgctcgagatctagagcttgatcctcgaaatcctcgcactgcgggtcttcgggctccgaaactacacgcgaaacgggacaacttaacaaacggcgaaaataaagtcctattaatgacctctaagcgtgccattagatagatctcgagatttgaggaattttggaagttgaacgg

SEQ ID NO: 28615 - DNA, 1136 bp, Oryza sativa
agcgacggcgaagcacggctggaacggcggcggcgacagcggagttagggcgcacggcgctagaacgattccgccaccaaaagccaaagccaagggtgccgccgggtagcgaaaagcacgggaaagcttttaaaggggctcggagacgacgcggaggcccacggcgacggcaccggcgaaggaaacctcggcttggagagagggaacccgatccgaatcgaactcgattccaacgctttccaaagcgatttagccgatgattccaaagggaaaaagatagaggagatcccggagatggtttcccctcaatcaattcggccggagaaggaaagaggcggccggattggaaggaaacagcggcggcggcgcgagctagggtttcggcggcgatggcgcgaggaggacgaaggtcctgacaggcgggacccacctgtcagcggcagcgggcgcgcgcgcgcggcagcggactgggccggctgggccgagaagagagagaaggcggttttgggccgactttcggcccaaagccaaaagaagactttttttaaaactttttcaatttaaattatttcttaaatgcaattccatttattaaaaatacttccttagctcaaataaatcccagaaaaatctaggaattatagaattaagcaaagtatttaatgaaattttatctggccactttttagattggaatttattaattaaacttagattttcttttcaaacctttttaaaataaattctagaaattccatttaaacaacaatttatataatttgaatttttagggtgtgacatcctacctgtcggagagagagggagggagaggccgactggggaggcagaacggacttgagggagagagagagccgagcgggccgagggaggaggccggcccgagagggagagaaagggggcgcgcgggccgcgggagagaaaggagggattgggccgaaaggggcccaaagagaggaaggaggattttatttgttttctttttattttaattgatgcaatgatctttgtgctattaaaattatttctcgagctccgaaaattcacggaaaatttcggagagtacattagggcccaaagaatattacaaaatattcccggccaataatttttaaagg

SEQ ID NO: 28616 - DNA, 734 bp, Oryza sativa
cgagctcggtacccctcatattcttcttgatttcttgaatatcagaatcattaatttgggcttttctaacttgatcaattagagtgggcttcacttctagggctgcaacgaaacctctactgacaattcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatcgcatggttcattgcggagcaccagactgagaagtggcggtgataagcccacgggggtcgctggggaggtcatgccttgtttataagggggtgattatgatccaggaaggtgcgctgcagtggattgtgttgtataaggggtattgtcacaacttctttccgatgtaccgtggtggtattgaggcacatggtgacatgatgtggggttgtgtcttgtgggtacagtggtacacctctgatcaaaataaaactattcgaatagccgtgcccccggttatgggcgggtctaacaatgtc

SEQ ID NO: 28617 - DNA, 291 bp, Oryza sativa
  unsure (1)..(291): unsure at all n locations
cataattttacaaactgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaagcctataaagaagcaataacaacacataaaaagaaagcacagggttctttaggttataacaaacattaggagacttgaacgggtcgattnnnnnnnnnnnnnnnnnnnnnnnnnnnnnnnnnnnnnnnnnnnn

SEQ ID NO: 28618 - DNA, 540 bp, Oryza sativa
  unsure (1)..(540): unsure at all n locations
agggcgaattcgagctcggtacccgtaccaaatctattctgaactctatatcccttttaggcggcatacccggtaaatcatctgggaacacatcaggatactcccggactataggaatctcttccaaagttatttgattcagtcttgaccttaaagactcagaagacaatgcatgaacggttacaactcgaccatcatagctgttgagagttacttttctgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgnnnnnnnnnnnnnnnnnnnnnnnnnnnnnnnnnnnnnnnnnnnnnnnnnnnnnnnnnnnnnnnnnnnnnnnnnn

SEQ ID NO: 28619 - DNA, 769 bp, Oryza sativa
  unsure (1)..(769): unsure at all n locations
nnnnnnnnnnnnnnnnnnnnnnnnnnnnnnnnnnnnnnnnnnnnnnnnnnnnnnnnnagtattagatcatagatcgttaccactcgacgcgctgcgcagcggaagaagacgctgagaagtcgaaggaactctcgcgaagtagcgcgcgtcgatgtagaggaagtagtcgatcgcaccggctcgaccttctcctcctcgtgcgttttcctcgccgtactcccacgccgatcagcaccgcaaaccagcgacgcctctaccggtatccacacgtacagggacggaacgccacgcgcagatgtgctagcacccgcgtgcggctagggttttgctcggggagggaagtgacggctagggtttctcacgtgatgcaatacctccgctggtcacacccctcacgaatatataggatccatcactcgggcctccaaggcccctaggactcctatttggatccctatccgaattaagctcatattggatctccatccaatccccttattccggcccattaagcatgcgaccctgtaggttcatgtatactcggctatagcccgaaaactccttttcggtccacgcatcaacagcggtccctagcagaacgtattaacccaccggacatacataaagatcatatcggctgaacctctagtgtatacttgtatgaacccctttgcctcacgatatcgattaagctaaaggctagatatgtgccatcctctaatagctcaatcattcactcgagcctgtggatagattatataatttgtga

SEQ ID NO: 28620 - DNA, 587 bp, Oryza sativa
  unsure (1)..(587): unsure at all n locations
cnnnnnnnnnnnnnnnnnnnnnnnnnnnnnnnnnnnnnnnnnnnnnnnnnnnatcttcaagtgccgcagcccagtcgaagtcagctaaaggttcaaccctggttcgagtcaggtgaaaagaagattccacctgcaacaggagatcgagccaagcagtccagagtggagaagctttgtaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttccaaaaggaataatagaattaattaaaattcgaaaagaaattggcaaacactaaaatacgtacaagaaaaattcgaatgtggcccggagaatttttggtaaattctccttggtctaaaaggagccctcaaattttagtggaattttcagagcacaaataataattattaagaaataaacaaagttaaaatggtgttataaaaagaaaaagccctaaaaagtcctttttcccccttcccttcttggg

SEQ ID NO: 28621 - DNA, 546 bp, Oryza sativa
gcggcgctccgacagtcggcgggcgaaacgaaggggtggacgaggttggcgaggacgcggcgaagccgaaggaggtgacgccgagtcgggaggaagtccggagcgacgacggcgacgaaccggagctcgtcggcgacggcggagagagaggaagacggtgcgggcacgattccgacggggagagtgagcggcgagtggcggaaacggaggagagaggcacggggaacaattatatagcgccgggagggggagaaagcggccggaggggaaggaaaccggcgcggaggtctcgggcgccattgatggcgccggcgaggtttgcgggagcgattccggacggatccgagggagagagagagggaaaagagggggatcgggagagggaaacgcggggaataattcccccctcattaaggcgcgcggggaaggcgggatgcggcggattcagcggcggcggcggcgctagggcacggcggcgacggacgcggcgggaggaggaagatgacaggtgggccccacccgtcagcgagagtggcgggcgggccc

SEQ ID NO: 28622 - DNA, 181 bp, Oryza sativa
ggggcccacgtgggccccacaagtcagcctcacttatctcttcttccctcttctttctctctcttctttgctttcccctctctctctctccttcccaggcaggggacggcgcgggtgggccggcggagcaggcgagatccggcggcagtggcgggcgtggtcgtcccccgaccgaagcgcc

SEQ ID NO: 28623 - DNA, 1543 bp, Oryza sativa
ttcggggttgaactcgacgatagatcggggatttgagatctgagatggcacggacactagacaacaagcaaagaaacaaatttcgcaattaggatttttaagagataattttcccgctaggcgccacgacggaacgggcgctacatattctttctttcattgatggcatgaaaaagaaacatgaaattcacaagtacaatatttgcttctcagatcgattctatgcaatatgaaaaagcaccgcaattaagacttcttaattaatacatttgtgtgcatcaagccatcaagctttgatttagctcttcgaaccaagcatacccaggatcaaaatcctgggtccaccactgaatgaaagggatattttggaacataagagggattggtgggggaaggaaagagtaaacatctgaaagacattattgatgagtataatttggattttattggaattcaagaaactatgaaataggatttcaacaataatctcctgaattatataagtggaaagaaattgtttgattggaccttgttacctgctagagggagatctaggggaattctctgttgataagaactagtgcttggtccaaaaagtggaaatcggggattactgtctcaaaatacatttgcttaatcaaaaagacaaatgggaagtggaaataataacagtctatggaactgctcaacctgaacagaagagtgaattccatctggaattggctagattctgtcagaaattgagcaagccagtaattataggtgtggacttcaacattactagctaagaggatggaaaaaacaaaagaggagggacaaacaagtggagcttcatttttaatgcaattattgaacaatccaatttaagagaaatcaacatgggtggtagaaggtttacttggtgctataatcgtgatcatcccacttatgagtaattggacaaaattttcattaacatggagtggtagaatattcacccacttacaagagtcaatgctttagagagatttctttctgatcatgtcccacttatggtagaatgggggaaaacagaacttctaatcttcattttaaatttgaactaagttggttcataagggaagacctgtcaaaagtagtaggacacacttggcttcactctgggaagggaggaactaatgtagaaagatggcaaaatagacttaaagcattgaggagagtcctcgaagggtggaataaaaattgggaaggattatacaggaaaaagaaaaaggaaattttggaaaaaaaaatggacgagattgattagacatctatcaagataaaattggacaacatatccaaaatcacaaaaacaggatgcagaaaagttggtgaagccttttagcattgaagaggtgaaaaaagtggtgtttgaaatggaaaacaataaggctcctaggcctgatgggtttcccattgaattttataaaaaattctggaacctaatcaaggctgatctaatgggacttcttgaagattttcataggggaactggatattgaacgtttaaatcgtggagtga

SEQ ID NO: 28624 - DNA, 20964 bp, Oryza sativa
  unsure (1)..(20964): unsure at all n locations
ttttcatacaggggaactggatattgaacgtttaaatcgtggagtgataacgttagtgccaaaatgcaaagaagcaattcaaatccaaaaatttcgactaatctgcttgctcaatgttagttttaaaattatcaccgaaatcctaatgaacaggctaacagaggttatataaaacattatatctaggaaccaggctgctttcataaaacacagatatataaaggaaggggtggtagccattcatgaaattttgaactcattgcacactacaaatggaaaaggagtgctattcaaagtggatttcgagaaagcttataataagattaagtgaccctttgtatatcaaatgctacaagttaatgaattccctgatagatggaatgactggataatgaaaacagtgaggggggggggggtcgagtatgtgtgaaagttaatatgtggaggggccatattttgaaacaaataaggggttaagacagcgtgaccccttctcacctcttttgtttaatattgcagttgaagctcttattgccctaaccaataatgcacaaaaacatggttttatctctggtttaaaggtggggagattaggggaggaaatctctatattacattatgttgatgacacaatattcttgttggataattctttgggaagcactaagaatttgaaatttatcttgtgcctatttgagaacatgtctggactgaaaataaatttccacaaaaatgaggtttttagtgtgggtttatccatgaaagaggaagaggatttatgtgcaatactaacatgtaaaaaaggggaccttcctatgagctatttggggatccccgtggataagataagaatacacaacagagtggaaacctactgaaaacaaaatagataagaggttgagctgttggcaggggaaactactagctacaggagggagattaacccttataaactccagtctcagcagtactatacctctatatatgatgtccttcaatgactacctaaaggagtgaaaaaataagaatggattactttagaactcatttcatatggcaagagatcaaggcattagaaagtatcacttggtccaatggccagagatatgcaaaccaaaagaccaagggtgattggggatccttgatctagatataatgaacattgctctactaggaaaaaggctttggaagttagaaaatgaaccagtactgtgcaggaaaatcctgagaaccaagtatttaaaaaaacaagcctctagctttgatcaaacacaaacaaggagactctcatatttttgtctggccttttagagattaaagacattttcctagctttttgtaggaaacaagttgggaatggaatgaggactcatttttggcaagatgagtgggtggggaacagtacaattgctgaacaatttatattacatttacaaaaaaaaaaattatagtagcaaaggcctttgagaaaggttgggatttctttaaatttaggagaattttgattgaggatatatatagctaagaaatgggaaacagttaaaaaaaatgtgtgcaatgatcactttgaaggcagaaaatgataaactgatctggactttaactaaaaatggacttttcactgtaaaatctttctaccatgctctaaaattatagacaagtgggtttccttttaaagagatgtggaagttcaaaattactttaaaagtcaaaggttttatctggttagccctcagaaatagcattctcaccaaggacaatctgatcaaaaggggtggaaaaaagggacaaacaaatgtcagttctgtaacaatacaaaaagtattgcacaagcttctttggttgtagtatggcaagatttgtttggagcacagttagatgtgtgtttgattgtgagatacctgatgggattcaaaatctaatgggaccttggttgaaagaattcgctaagaaaaccagaaagatggtagctgttggaatttctgctatcatatagataatatggaagatcagaaataaatcttgttttgacaatatactacctaatgatcctatagaaataatcaggcaggtggctaactgtatgtctgactgggcaattttacagaccaaggaggaagaaacaagaatactactggaaggggacaactgctaagacgggtggcaaatgagatctacaacgctaagtatggatggagcttcaaggcaggaagactgatgggatgaacgctgcagctccctcttgtgaattgattctggaagacctgtttctcttttgatgtggataaacaaaacctctgtctcgctttggtagtctgaagcctgttggttaaccttctggaagcgttgcaactatgtttttgtttttgtgtgtgaaaactctacccacttagtggatgtctctatgtaatattggagccagagtaactgttgggatacacgtaggctacgatagtataaatcaaaattttctatcacgtaaaccaggaaccatgcaagtattagatcatagatcgttaccactcgacgcgctgcgcagcggaagaagacgctgagaagtcgaaggaactctcgcgaagtagcgcgcgtcgatgtagaggaagtagtcgatcgcaccggctcgaccttctcctcctcgtgcgttttcctcgccgtactcccacgccgatcagcaccgcaaaccagcgacgcctctaccggtatccacacgtacagggacggaacgccacgcgcagatgtgctagcacccgcgtgcggctagggttttgctcggggagggaagtgacggctagggtttctcacgtgatgcaatacctccgctggtcacacccctcacgaatatataggatccatcactcgggcctccaaggcccctaggactcctatttggatccctatccgaattaagctcatattggatctccatccaatccccttattccggcccattaagcatgcgaccctgtaggttcatgtatactcggctatagcccgaaaactccttttcggtccacgcatcaacagcggcccctagcagaacgtattaacccaccggacatacataaagatcatatcggctgaacctctagtgtatacttgtatgaacccctttgcctcacgatatcgattaagctaaaggctagatatgtgccatcctctaatagctcaatcattcactcgaacctgttgatagattatataatttgtgattgactcctcaatcacctttggcatggccatgcacttccataatctacaacatcgaggggcccagagatatctctccataggaggggcaaatcccatcttgattattcatatcccactacatgtttcatagcatacccaaaaactacttttataactacccaattacggagtagcgtttagcagttactaagtaagctactacacatgttgggaaccataataatctcaggtctaaggattcaacacttacaataaatgagatcactgatgacacaacacatatggctcttgtagtgtctcatgttgggtctatccaacaacatgttcaccaacatgtgtccacattattaatttggtatctctataccatgatccatgagatatgatcatcaattaatacatgtgctgatcatataaacatatttattccacatatgatatttgatcagggatcctttagaaatagtaacaaacaacataaagagtctcatgaaagaatcacatattcattaaccaataataagttatctatttcaaggaacaatgtcggataaatatgtaaatatagtatgtgatacaatcatctctatgattgcctctagggcatatcactaacagtaacctcctcttccagatcgttatatattcatatcgagatatgatatgaatgatgtgtccgcatatggaagatcatcattttgaagaagggaaagtgagccgattatatgatcattctttccaaggattgatatataggaaagcaacaacgtaatcttgcaatcaattcttcattggaaatctgaaaaaaggatttgtttttcttcaccaagttaattccgagacgctgcacacacgaatttaacttggtgagggggtggggcaattttgttggatgagaatttgtgcatattttctaaaatgattttaaatgtagtgtgtatacacaaacgtatatgtaggatggggctgatgtaaatctctaaaccggcttagctagcttgtagcctcatcttttcgtttatatttatacttatcaactaaagttggaattttcaaccttaaatttagagttgattttggggttttttcatcaaagtttatttttcactctttacttttagattactaagaacacatatataaaaattttattcacaaattatttttcgtttgtaaatatgtcgtttggtttattcctcgatggagccattgttttgttattttctaaacttttcttgtttaggaacttttataaattaaggtggttagcaatttcgttccaccataaatctttcgggtagtacgtgtgttgatagaaaaaagcgccaaaagatgtaaacatgcttgtttttttacggttaaaacagcataaataatatatgtacaaggaggaacatgatacagaggggaggaaaaaagaaattccaaaaccaaaaccaaattatctaatcgattgaatccatgattgccagctaggtttgcttgcatcctttactctatgcatatgctcaataaaatcctccctgaaatctgagatccattaattcctgaagttgatggggattccattaaagatgagatcatttcttctaacccaaatattccagcacccaatgccaaggacttccatgaagaaagaatgagggaaaagtcctcttgcagccatgatcatgttcatgaattctgtattcagattccatgatatatataccaatgtgattccaatattgctgagcaaaagagcatgaaaaaaaaatagatgaatgttgtcctctgtgatgtaaacatgcttgtggttgtgtacactgtcaaaaagttttccttgaaatctttaggcttcaaattctatactatacatcatgcttatatatgctcctgtattaattgcatgcatgtcaatttttttcttgcaatatgtgttataaaaccgatccgaaaccaccgtcgaaaatcaaatatggaagaaacaccatagaagatccaaacacgatgataacactgagacactatatttattattgaggttcaaacatctcgggatcactgattacaggcactcctctccgatccaacataattacagcgcatcatatttacattgaccctcggccgactaatgctggcagccgcttcctcccgtctatatatgctaagtcatcatgtggttacaacatgattgtgtctctatttaagagagagtttagaaatagttcgattttaactctatcctgcatctgttataatttcaagttctaaactgtgaccgactacgtacatatatttaacacaaattctaatgataaacacagttgagcctcccaaaattcttggagtacagagaagacgtctgcagccatgttccacacacttgaaactcgcagattcctgccttgattagcatgtcacacatcgatgtcagcagctaatgcggcagctgcaaaactcacaaaacaacgctatttggagaacctagtacttgtctaaaccactacgccacaagaatgcaccataaaacctgccaaaactagcttcaaacataaagtatattgttcgatcgtcgcatgcacaagcatatggcgccaaaccatccaccggccatggaggcggcgccggagcacggtggacgttcgtcgtcgtcgtcgacggatccagagctggatcagcataacaagggcatactggagaagatgcacaagagcctccttctcctcgccatcctcgccgccaccgtcacctacaacgccggcctcgccccgcccggcggcgtctgggccgacgacgccgacggccacgtcgccggcgactccgttctccaggtgtgcgcgcccaaacatcaactaatttgtgtgcacatgatcaactgtcgttggactgaatttaatctagctcatgctcatctgacacacacaggcgcactacccggtgcggtacagcgtgttcttctactgcaacgcgacggcgttcgtggcgtctctggtgatcaccatgctgctgctgagcagcaccttcagcttccacgggtacagggtgcgggcgctgcaggcggccatggcgctcgacctgatcggcctcctgggcgccttcgcggcggggggatgccggagcgtgaggacgtcggcgttcgtgctggccctcgtggccgtcatcgccgcctacctcgtcgcccacctgctgctccacttctggatccggagcagccggtgcccctcccaccgccgggagctcgtcgagcttctgaatcttcaccggtgccattcttgctgcgtcggcgccgccgccgccaaggacgacgcgacgacggtggcgcaagcgggcactgaagcacctgctgctcctaagcgcgcgtccagcgtgtaactgcttgcgcctttgcctcccgcgggcaaagaattaccttccgtcgtcgtaaaggcagtaaacgcagacgtccaacaggaaattgctcagttttctttaaaaaaatctggatgcatatgagtagcatcgagcgagagattactcagtatccacatcaattattgggtgcattatcaattattgggtggatatatgagtcttgtttgtgttttctggttttatataggttgagaaaatatctgtatcctacttggccatatattcttattcttggaatctatatataattcctaggttgtaattactgagccatgtaattgtatctcactctatttaggcttcaatccttccccgtgcgcttcaaaaagactgatgattggaaaacagtggcaggaaaaaatcgggcccaccaaaaaacagcgacagaaaaaatcgccacccactgagaaaaaaatcggacggacaaaaaaaggacaggtggagatgggaaaaatttgggcaaaaaaccgcagcaaaaataacggcgacaaaatctgcttgcggaaaaaaatgatgacgaaaaaaaactatcggaaggattacttatttttttaattaagtataaattagaatagaaaaaaatacccgtgcgttacaacggataaatgttattttaattttattattgctataagatttagattaggtgaaattcactataagaactcacttagatatttttttataaaatcgagctataattaggagtccaacttttgtctcacgttcacattcgattctccaactgggcttgttagatattaatggcatgctttttaaactgctaaatgatgcgtttcgtgcgaaaattttctatatgaaagttgttctaaaatatcagattaatcattttccaagtttgtaataattgaaacttaattaattatacttttttaccaccttattttacgtgaaacacttaatcttcatctttaagagattcaaacatcacctaaagagatttcttatcctactccttttgtatttttaaagcaaatgaagttaaaaactaactcaaacacgcggatacgtagaacttaaacattaacttaaacaaggatgacgtaccaaaacaccgataaaaaatattcaatttttataatagtagtagagatatactgtatacctaataaaaaattaattccttagattccgtatttgtttcgtcgtctttttttttccgctttttttttccgcctttttttctttttccgttattttcgctgctttttccttttttccgttcctttcgcttgttttcttggtttccacacgagaatgacagggctcgggcccccgacggtggtggagccgatcgggcgctcccccgtgcgcccctccacccacgcgcgtgtatgcaggccctgagccccaccgcgttctctgctcctacctgccattgtaacaaatcacccacatattttaaaaaccctctattaaaggaatttggtttatttttttttccaccgaaaatgtttcactcagtgtactcacaatgtttcactatgtatagatttagtgttacagtgaactgaaatattccattacaacaaaaaaaatccacatattttagaaaccccctattaagggaattcgttttattttttttccaccgaacgatgtttcactgtgtatggatcaaatattgcagtgaactgaaacattctttcgctatttgctgaaacattgtttttatataaggtgaaacaacatccgatttaaacgagtgaaacatttttgatctacttggtgaaacaattccgatatacctgatggaacatcgtgcaacatttaaaaataatttaataataaactaattttttttgtcggaatacatccatgtgtgatcttgttttgaagatttaattgcaacgaatttaacggtgtaatcggatcatgatttggataagtaatttaagagaaagatcagtttaaaatagttttgcacgtaaattgggcgctgatgtccgatttttctctaaaccgatcgggcgcccgacccgtagactcgtccgccttttattcctcttttttccgttcttttttgtatttttttcgtcgtatctttttcgcctttctttctttttctcgccttttttttctccgttccgtccacttctctttttttctttttttattgccctgttttctttttctccgttcggtgggtttttttctttgtttttttgttttttccggtctattttttcgccgttttttctcgtcacctttttccttttttttttcatccgctcgtttttcgttgcaattttttaaatttgctcttttacacactttggtatggattcggttttattttttgtcgctggccggacccgcaccgtcgccacgttgatctgcctcttcatgcgttaccttctccaattgattgtaaaaatcgattcctcactacccgttatcatttttcccatgatttttccaatcaattctgctttaatttaccagatctaatctccttttaaatgtagtcgtttttatctcgagctttatggattcactcagattttgataaaaacagaaatagtagatcaagtgtatcaaaaagtcatcaaccaattttaggatcgagaatgattcgatctgatttaatgaggaggatccgattttctgaggtttgaaaacgcagtcggctatgtgagctgggcctacactcccacttgggactaacgatgctgatggcatttttaggacaaaattgcttgtacaatggcatttcatggaactcacacctgtcaatgctatttcttggaattgggcgcttatcaatggcatttcatggaattgggcgcttatcaacggtatttcttggtttttttctcatgataatgatacacttgttggactgttctaatgtttgatattttgtaccaaataatttgagttgttagatcttcatctatggctaaaaaactgacagtggcatttttttttctatcaattgtatatagataatcccaattatttattggtacctaagaaagaatacccgcgaataaaaaattgctatggattgttgaggaaagttttaccctggcatgtttggcaagagtagggaaggggaatgggagtttagagaaatgagtttacgtggcattagtcatgggagttggatttttagtccccatccccttgtttggattaatatgaagattattgtcagggtcatggataccacatacccaatagtaatcgactaagctcggtggggcctaccatataccaagtcttataaggaatcatacctcgtttatagaaggagtagcagataaggaaggacaattagagttcgatatggaaactagaaggactactcgaatcgtatcaatacttgtctccctagctctacttggacaagggatatctaatgggtattggtataaatacaagaccccctaggaggagaggggacacaaaacaacgagacataaagatcgacacacaagccaacacactctactagacatcgatatcagatattagcctagacgaacccaatatagtacctacggaggccgacaagagggatctaacgccatctctgatctcgacaagttcatattcgaggaggaagactaccatgtcgtcgactacgtgttggttatccatgccgccaagtcgacgacagctagataggttatcccaattattgtacttgtgtgagattcagatgaataaagagcaacactggcttcggccaacaggagtagggctattacttgtcagataaggggcctgaacctgtataaaaacccttgtctccatctcttttacttcaatctggcatataccctggtaccaacgatccacataccatgcaaataccatagtcgagacctcaaacatcgacattggtgtgccaagtagggagcttttggtgcatcaagatttcgacgagatgggttcaagagatggattctccaacaataaactactcgacgacttcggctgtggggtgatatgacctgaacgaagtgcgttctctgatggctcgggaccctcgtcatctcaagtcatcgtcaagtcaaagatttattgttcctatcatttgtatggtcaagtatattacgagattaactatgcttattaattaagttgtccccttaccatggaaaccttaaaaccatttggtcttgataaataatcatgtactacccttccatctactgcagacccttcccaacccagtaatacataactgaattgcatgtcgggtgcacatacaccaagaacattggttgcaacaacattttttcttgaacagtatcttggtttgtcaattgcgggcacatgaacttgtatgtatgtcccatctaaggcacctagacaggtataaaaaacagtaaatatgtgttgaaatatgaacaacttcaatctaaaatgtttgtggttagagttagaatattggtttgtactttaaaccacttccacctttcatctttatgatttccactaattggtttaggcttatttagcaacaccttccaaagctttaggactacacttagcactttgaaaattccaacttactgtcccaggtgatcgttgaaaatcaaaatgtattgcccagtccttcggatcatgtccaagattgtgcaaaaacatggctaccatttcttccaacttcatattgctagtatgtcccacaaaattctctaaccaaagaacacaccattctaaaataatgtctatccatccatagatatctaatgaattctttatcacttacacatatgatgttattcaaattttgtgatcgagtaatcgggtcataccaagaaggttccgaacttcgacaatgttgcattgacaccttctaatttaatatgccaatatatggatcaacagatacaatgtcatcacttttttcactctatgtgttgtagccacgatcatggtcttcatcttgttaagggttggcgtcacatgagccggtgccttaggaagaagggtatcgagaagagtgattgatctaatgacgttatgctatggtgtgagaaacatgatggtatcgttgaagtcaccaaagtcgacaatgtcggtgatggcgtagaagttgtcttcagaggaattaaggtagtcggcaatctcggtagatgaacatgaaccaagtggttgaagcattacgccaaccttcctgaagctagatccaatctcggccgacgctagatcaaatcgggtcctatgggggaaggcaaccttgagccgaacattgcagtgacgtcggccgggagtcgcatggtgatcggtggatacgttggcacgtcttgagcagaacttggtgaagaaagagaggtctttgcgatttcacccgaatggtttgaggccacctcgtgggatagaactttggagtagatcacagacgcgttcggtaaactgaacggggcagagtggttgtcccttcctgactggttcgaatcgagtcgagaagagagatcttaccgaagctgtcggtgataaagttgaggctgctaaaacagtacgcctgccctaggggtaaggtgaagtcatcgatgcctgatgtagatcccatcgcactagtcggcgagaaacatgacgcaagcccctacctagcgcgccaactgtcgaactagttttcagcaatactagaagggggtagcgaacaagcaggaaagtggatgagttgtgagacaagggatttatataggtttaggccttttcaatgagaagtaataccctactcatgtccggggaattaatccgctgattgtgatattgatatgatgatctcaagtatggttatgccccctaagaggcgccctgccctccaaaactgaacagattggttctgcttgaactgacccagactaggactgcggatgctcgtgaaactttcttatcttgggatgaactgttgatgctagcaacttgataacctgacagttcaccaagttggctagagaaggatggagttgttcctgaatcttgcatctggcatttgtaactcattgatcctacgtccgcttgaactggtcctggctcgaatgacaagtaattccaggaaacctgcttgacctgtcttttgtctgaactgcaaccatctgcttgacctgtctaagctaagcggttgaactggcctcatgggtgtaccttagaattcaatcggttgcccggggatcggcttaattcttctgataccttgcaacatgcttcttcaagtgctaccctgattgcggcactggttgagccttcaactaaaacagcgacgaagtgaggcaaaactcttctccgagacctaccccccttacagggagtagtcttactttcgcgtggctgggatcggttgaactgttgtccttcaaatataaccaacacttctctgttttgcgaagagccctgactttgaaaactaaaaacttcgccgatcgatcaaaatagagtaacaacgatgcactttcatcccattaagatttggaacttaaccctcagttgctgataggaaattccacataaagaaattctcatttagcatatgatcttactaactcttgactacttccccatcagttctacggctggcataactagcatgcttctggactgacgtcggtgtcgtatgcttggacatattgcatagtcgacattctttgaagcacacattgaccacttaacggatcaaaatcaagagtccttctcatgacataaccccacacgtcaattttttttttgactcttcctggattgatgaactgtaaagcctgcaactgctttcgcaaaaatactgtagtctgcacgactgccggaaattgactttgatgctgccgagagttcctgttctttgatcataacaacttcgccttcatatgttcggtaaagatgttccgttgaaaagtgtcataccctgattttcgtcttaggatttataaattatttaataaattattaatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaatttttaatcatacaaagagcatttcagtaattatccacatattaaattaatcattaaatggtctaattataattttgttaagtacttttagtgtccaagtattttcaagatttttcttggaattatttgagcattggaagtatttttaacaattgaaagatcatttaagtgattattttaattggaaaaagtttttaaatccttccctaagtcgttgggccgatttcggcccaactctttctctctccgcgcagccaaaccggcccaatcggcccagctgcagccgcccgccccctcctctctctctgtcaaagtctagtttgcctccctgctacagtgtcgtccctaacctccagccggctgcctagctgagcccgagccgcgcgccgcgtcgcctttccgcctccaaatccgctccaatccgaccccgtttcttccggatttttgaggggttttgatcctctcgttctcctctatcttttcccccaagaatcggagcaaatcgttgggtattttatccgaatcaaactcgttttcgagtttatctccaaaaccgagtttttgatttctcgaagcgattcctctcgtttggagtccaatctcttcaatccaagcctatataaagcaccccctagtcctcctctttcgtttgccccctctcccgtggtctctcgtgcctcgtagctcgccgtcgacgccgcttagtccgccgccgccgccggccgaactccggtcgcgccgccgcgccgtctccgccgtcgccgccgcttgccgtcgccgcccgtgggtgcgccaaggggtggagaagcccggccgccgcttccccttcgccgccggccaccggagagccgccgccgccggtgaaccgagccgccgccaccgttcctctcgtcgccggtcgtcgtcgtttgtcgttgtggtgagtaccgttgggttcgtctcgtcgtcctctacgtgtacatgtcctccaaagtcgcagccgaccatccaatctccggcgtggtcgtcatcttggttcggccgccattgatgacgtcatcatgacgtcaccagttttcctttttcccgtttttctaatagattaaatcttcggaaaatcataactaaataaccatagatccgtttcgagtggttcaagttgctaaatttttctaaaataaagatctacatattaaaattgtccataaattgaattaaatttatttaattctttttaaatgggctttaattagatttaatcttgtaaaattcataataaattcatttgaagtcagaatgaggccgttcaagtctcataattcaactaaaattatgatctacgtgtttgtttactttatatgtattgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacactatcctttgagtatgttgatcctatatttaaattctctatttatttcaactgtgcatttattttcaaatgtcatcgggtggtgtgaacctatttctttgttatggccaatttgcattaaatgccctattccttgataccttgggtaataaattgattagcttgaaccttatgtattggtttggttcagctaaatgttatatatataattgcttagcaatgcttagaaacattagctcactaatgggatgaatcatatatactacattattatttatggttacatttaatggtagctcacgatggtaaatcgtgtgattttaattaattgataattaaaacctggttaaggtgggttgtgagcatatggttttgatggttgtgctcatgacaattaaggaccggttcgcgagctactgttgtgaaacattaactgtaccaaccacaagccagcatgggcaacggctttatcttttgtatagcgtgattcattatagtgcgccagactgagaagtggcgagaagtccacgggggtcgctggggagtccatgccttgtttataagggggtgactatgatccgggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacgcctctcacaataattatagatgttataactggtaataatttgcttagctcctggtttggagttagatctgtacagccgggtgtggttgttcaggatggttgggcctgagcagcatgggtgtgctgttcagtgttgattaaaattgatgattaattacttcactgttttacttctcttaaatgttttgctaaatgctgcttttgcaaatgagcctatattatgccatcctttggaatccctgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccagagcttcgctagattttattttccgctgcagttttcttcttggtgaggactaagtgcctcttaagtaagtacttatcgttttagttaatgtgatggatttgtatattaaattgtcagtttgtgtacctcggctgattcctggacgaggattttatgcacaaatcagttcggaaattactagtgaatttccgggcgtgacaaaaagggattctctaccatataccctactgactacacacttctggactcgactctatatacttctgacccatgtattggaacaatttctctttcaacttctgggaaacctcatgagaattttttttttctggaacttatagcggttgccttgaactatggaaaccattcttgtttcataatcacaccactagggtgtaattgccgcttaccattctctaacagtttccaaggctatagattccttgtatgatgttacttctgaatatttttttttcgttactccttacacttgaatacccttggtactgcctttagagagatttcatagtgtcgagcgccatggatccaaccattgtcactttcaaatattccatccctcttttcatttgagtaccactgatgctgcctttagagagacctcatcatgtcgagtgttgagggtctaaccattttcactccgttggttaaccattcctctattggctcgcaaacaggttttggagctcaacaaaattgcgatgagttagaagagaaactcttggtttcttgtggcactggcagatacacatgttaaattgcttctacatgctcaagatgaatcataaaaggagaggaactggctgactcatattttattcaatatttccttttcattacatggctgccataaacatatatgtacaatgagaagtactacaaaatcaaaccattgtagactgctgctgattagaactgccttttagacctgaaaagtagaggtcttgactggaactgttgttgcttccatcattcaaacctgactgacttgtccctttagttcctactagctgaagtctcaccgggaacgttgctctgcttgttggtcttcgatggtggagtaacaactctcttgactgccgtagcaggtgggacttcttactcgcgggattgccgagcggtggtttgtcgatgggcctccggattggagcaatacgaggtgcattgctagaactgacaacagtcgagcgacctggtgctgacgacacttgctgcgggtgctgatgaaggagcatactgcctctttgtaactgtagcgagctgttgttctccttgcattgcttaccctgctggcgctggtgctgtaggcttgaaacgatggccggtggaacaatgcggcctcttacggtgcccttgacgatgatccgttgaggcggaggttgcacattcaggtgtcgattggggtcgtgggcagtgctgataacttgtgaatcacgacgaactgcctttgctgctcttggaagaggacaatcactgaaacaatgtcctggcttacgacagttgcgacagaatcgacttgcttggtcctggggtgcaggcttctgattatgcactttggcagctgaaactggaacaagcagcgatttatgaacatccctagcgacgttgcttcttccatggttggcgtccaccggggctagaattggaggaagagcagaaggattgtgactgatgtcgtcgactgccattggttgatgaaagggttgcacggttgtcccttgttctttcttggtcataactaggaccgagttccgctgataatccttaggcacatgatcagttccctcacacaggaaacatttgaccttcctcaaaggtcatgcatctgagtaatgggtgtattcaccacagcgacatgtggggaggcataaactagcagtttgtccgactatcccacatctagtacatgctttgaactccaatcctctttccatgaaactgttaagggttgtatcatcatcgtcatcagtatcatcatcatcgtcatcagcagaaaaccgctctcctgattcatcatcttcgggtctgggcggaccgtactttatgagatgtcgggttagctggcgtgctccacggaaggtatttcttcctctctgacgcttgggtatcttgctgcatcatcaggagtaaattctgaactagtgatgatcatggtcctgccattatccatcttccatatcaccttcctattcgctccagagctgtgctgcagagtaccatctttcttgttagtagactgacttggagcttggttacttcctgggcactgcttctcgtccttttcaggtgacctggtgaacaccttccatggacagttccttatataatgaccttgctcaccacaatcataacaggtagcacttacttccctttggtctgacggtaacttggctgcagttatcttcagggatctagacaatattttggcaggggtcttcggtgccgatattgggaactcctgactttgattctgattccggtttcgggctggcatctagacttgcgcttgtggctggtgaccttgacgcggctcttgacattgctgttgcatctgctgcatcagatagatctagtaccgatgtcgcatctgccgtaacaactcttccactgtctgagtctgattagccatgacttgggattgtggctgatctttgagaggttgacgtgggaagcttatagaattgagctgagttgatccatgaaactgacgggatcctgatccgttgaaattgtccctcatgctgaccaattgctgtgggcacaagagagggagggggagatgagaggggttactaaagataaggtcttaaaccgattgcctactgatctgttgtgagtagacttttattcttcaagttgcttaagcaaacaacctagtatggtcgcatccccaccaatgatgcaaaacatacccctacacacaagcaaacaatacacgatcttgctaacgaagctacccttcagggaaggattgggtttaggtgaacttcgggaaaactcttcttgatcttcgcggaacgacgactctgaactgaccttctcactctttgctgcacgaagcttgagactcgacttgacttctggacaggcatgaagctggcggtttctcctccatgtttgacaactaaaagagttggagggacagggaggaaaaattttaataaaccgtttcgcaaagaaatgccgaagggcaagaggagacacttcgcaaatagggttttcagaaaacttgtccttacggtttgaccatttggctcaacctacagtcgagttggctctgataccactttgtcacgcccagaaatttaacccaaatttccagactattttgcgtattaaatccctgtccaggaccagccagggtacacaaaacgacaagtaatatacagttccaaacgtaaataaagcataaaatacttacggaagaggcacttagtcctcacaccgaaacagaacgacagcagcggaaaaaggcaatcctagcggggcttcagctccactccacaggcaaaactcaactggggtctgagccttggtcttctaactccatcttcagctcagaagcactacacttctgaaaagggggaataatagcaagactgagtacaaccaccgtactcagcaagccacgccaacgatccagacgtgcaaggggatacaaggaggggtttgtggctatttgcataaaggcagttgtaaaacattttattgagcaaaacagtaaaactgttgagtaattaaagtaatattgaatctccactgatcaacgctacaccaaattgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactttacccacaagacacagccccacgacacgttaccgtgcgccgacatgtcaccacgacataccggaaagaggccgtgacaggacccttcgcataaccccctctaaccaagcacaccacacctcaggtttcacccccgtccccagcgggcaacgggcagtcccctctcgtgcctaggtgaatccggaagcgacagaggccgtcgcagggcccgccccgatccatcacgcccacccttgcctggatgcgtcggccagaggaaagctacactacaagcccagccgttgcccacgctggcttgtggtaagtacgataagttcttccaaggcatcccgcgaaccggtccttaattgccatgggtgcgactagcaaaaccatgcacccacagcccaccattcagtcgcattttagttggataattacgaccatgaagcatggccagatgtctcgagcacgcagctcactctgatactaaaaaggtctaatactgtaattatctcatcaactgagctagtggtaattaagcatggctaagcatatagttctagctaggtcacacaagtaacatgagctagtcgattcattacccaaggttgacaaannnnnnnnnnnnnnnnnnnnnnnnnnnnnnnnnnnnnnnnnnnnnnnnnnnnnnn

SEQ ID NO: 28625 - DNA, 1383 bp, Oryza sativa
cgggcacgggccagtcccctctcgtgcttaggtgatccgggaagcgcaagggcccgtcgaagggcccgccccgatccatcacgccccccctggcctgaatgcgtcggccagagaaaagctacactacaagcccagccgttgccaacgctggcttgtggtaagtacgataagttcttccaaggcatcccgcgaaccggtccttaattgccatgggtgcgactagcaaaaccatgcacccacagcccaccattcagtcgcattttagttggataattacgaccatgaagcatggccagatgtctcgagcacgcagctcactctgatactaaaaaggtctaatactgtaattatctcatcaactgagctagtggtaattaagcatggctaagcatatagttctagctaggtcacacaagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaaggaaacagtacataaaaagtaaacaaacatgtagagctcaattttagatgaattttgcaagctgaacggctcaattcggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcggcacaagggctccggtccaccgtggaccgggaccaccgaggcggtccaccaccggtccacgggaaccgacggtccgaatcggcccaagccgatcgggcggccaggggcggcgcggctggggcacagcacggcacaaagccggcctagttgagccatggcgcggcggtagcgcggtctccggcgatggcgaccgacgggcggcgcgggagaggcggcacgcatgggcggcggcggcgcacgagatcgacgcggcgcgacaaggggggtccgggcggcccaagcgagcggggcggcggcgcacggccaggtggtcaccggcggcggcaccggcgcagcagcgcgcacgggagacagaggagggaggcaaggagggagaggaggagctcaccaaggacgcggcgacgaggggcggggaaag

SEQ ID NO: 28626 - DNA, 9337 bp, Oryza sativa
  unsure (1)..(9337): unsure at all n locations
cggactgggccggctgggccgagaagaaagaaaaggcggttttgggccgactttcggcccaaagccaaaaaaagactttttttaaaactttttcaatttaaattatttcttaaatgcaattccatttattaaaaatacttccttagctcaaataaatcccagaaaaatctaggaattatagaattaagcaaagtatttaatgaaattttatctggccactttttagattggaatttattaattaaacttagattttcttttcaaacctttttaaaataaattctagaaattccatttaaacaacaatttatataatttgaatttttagggtgtgacaaacctaccccccttaaacagaatctcgtcctcgagattcggaagaactggcaaacagatacggatgagctgacttcaattcatcttctcgttcccaagttgactcttcttccgagtgattactccactggactttgcaaaagcggataactcgattcctggtccttctctcacttgtttccaagatacggattggtttctccacataggtcagatcctcttggacttctatctgttcaagattagcttcttcagtaggtacccttaaacatttcttcaattgcgacacatggaacacattatggactcctgccaaagattgaggtaactccaactgataagcaacttctcctcttctactgacaatcttataaggtcccacaaaacgcggtgccaatttgcctttggtctgaaaacgatgaactcctcgtagaggcgtgacacgaagatacacataatctccttcttcaaaactcaaatctctgcggcgattgtcggcataactcttatgacgagactgagccactcgcaatctttcttgaatgattttcaccttttcttctgcttcccttaggatatccgtcccgaaaacctgacgttctcccgtttgatcccacaaaagcggagtgcggcacttccgaccatacagtgcttcgtacggagccatctgaagactagcttgataactgttgttgtacgaaaattctgcataaggtagattcttatcccaacttccaccgaaatctaaagcacaagctctcaacatgtcttccaaaatctgattcaccctttcagtttgtccgtctgtctgcggatgataagcagtactaaagttcagcttagaacccatctcttcctgaagtttcttccaaaaatttgaagtaaactgactgcctcgatcagacactatcttcttaggaacgccatgcaaacacacgatccttgccatatacaattccgccaagcgacttccggaataagttgtctttaccggaatgaaatgagccactttggtaagtctatcgactatcacccaaatagagtcatgacttgatgatgttctgggtaaaccagtgataaagtccatatcgatttcttcccatttccattcaggaatcttcaaaggctgcaacaaaccggcgggtttctgatgttctgccttgactcgctgacaaacatcacatactgctacatattctgcaatttcacgcttcatacttgcccaccaaaatctttccttgagatcctggtacatcttagtactaccggggtgaatggagtataaagtatcatgagcttctttcagaattgcatctttcaaatctttattgtccgggacacaaattctttcacccaactatacagttccttgctcatcctccaagaaaccgatagcttttcctcttctcatattcttcttgatttcttgaatatcagaatcattaatttgggcttttctaacttgatcaattagagtgggcttcacttctagggctgcaacgaaacctctactgacaattcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattccaaccatctcctttgtctcatgttcagatccggctgagtaaagatatactttaaactcttgtgatcggtatacatctctgtacgagttccgaaaagataatgacgccaaatcttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggtagaatcaaaataggagctgatactaagcgattcttcaactcttgaaaactctgctcacaatcttctgaccacttgtacttcacatctttctgaagcagtcgtgtcatgggcttaacaatcttggaaaaattctctataaaactccgataatatcctgcgaggcctaagaaactgcgaatctctgaaactgtctttggttgtttccagttggttacggattccacattgctaggatcgacggcaactcctcctgctgagatgacgtgaccaaggaacttcacttcagacaaccaaaattcacacttgctaaacttagcatacagttgatgttctcgtagcttctctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttgattctcaactgatgataccctgatcgaagatctatcttggagaaaacagtggcacctttaagctgatcaaacaaatcatcaattctgggtagcggatacttattcttgatagtcacatcgtttagagcacgatagtccacacacatcctttgggtatgatctttcttttccacaaaaataactggagctccccatggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggcttgctgccttgctccctcttagcaggctgttgttgtgttggagctgcaacagggcgtggaacttgattgcggatgttgttgccaacattgttgttgaagatctgacgctgcggacgaacaacagacgaagaacctccatgtggcatagactggggtcctaaagtaagacgtggcctttgattattcccctgttgtgccttaaagtgagcaatccggtgtttcttctgctccatgcgattgtacttgtcctcctgacgaatagccttatccactaatttctggaaatcagaataatctccagtcatgagtgggtaagaaagctcatcattaagtccttccaaaaacttctcctgacgctcttcatcattgcgcacatcttccggagcataacgggctagacgattgaactcgtgcaaatactctgtaacagagcgagatccctgcgtaagcgacctgaactccttcttcttgagagacactactcctgatggtatatgcgtcttccggaaagcagcggtgaattcaagccaagtgataggttcagcagtagtcctattcaagcggaagtgatcccaccattcagaagcaggaccatgcaactggtgtgatgcaaaagagaccttctcctgatcagtgcactgaagcaaatccaacttcttctctatggcatgcagccaatcaccagcttctacaggattagtggtactagagaaaataggcggcctcacacgaagaaactctgctaacttgttctgaggaggtgcatggttatttccttggttctgctgattctgaagttgttgcatcatcatgttcattagctgagtctgttgagtaagaacttgagcaagggttggattctctccattgttgttgttattgaggttgttgaggttgggaccattcccgttgctgcgagtattcaccatctggcaaggacaggataagaaaagaaaccggagaaaaactacttaggacagagaattactttactttcattgatcttaactgggtttcattattacaaactgaaaactctcacaccactaaactcaccaacttcctaacactcaaaagcaaacaaacgcatgcacttacatcccaccactgatgtaaatcacatgcaagaccaacacacacacaagcaaacctaaaacaagcaaactaacacaacgatctaagacaacgacctaacaagtcactctagttcttccgagcataggaggtcgattgaaggctcgttcggctcatcttcctcatctttgatagctgcccactcaatcttggaattgttgcgcttggattcttcttcttcatcactacttatgatgatgaccggaggatctgcttgagctggggcaacttctttctccaccacgcggatctttggcgccaattgataacgaggaacaaataaagctctcttccttgcggtaagacgaatcctggccttctgcggcggtgcttctcccttcaacgcggctagctccttctccaaacgatccaccttgtcttctagcttgcatatcttaccacgattccaatcttcccgatcttgagccgctaacacagtctccgcacaactttcatccatagcccatagcatctcaaccaaatgccttgtagtagcatcattctcaattccttcagtctcaaggtagctgccacggtcacttccctgtggttggcgaggatggtaacgatactcagtgtcggccaactgatcactgtaacgatcacggagctctcctatggcgatccttgccacctcctgacacgcatggatgtagtttcttcctccagcttcgaacatcaccgatgggatatcttcactattactgttcaaggtgactttgactcggcacttctcttcatgacgatcatgacgaatctgtgcataaaaaggagcagtcccaaatccaatgacaaaggacatagtacgcaactcctggacaaatccttcaacaccaaacaggtactcaggcttgaagcgcggcatctaaagacaagtgaaaggagggagttaaggcatctatccaattaatagcacaagtttttggattaatttttaataaagtttagaaatcaaagtaaaaggtaaataaataaagtaaaccaagtttgctagatgagttgaaacagttggaaacaaggttacaaattttgtacttttgaataacaggtttcaaaagaaataaaagaaagagggttataaaatcatcttgctaaatttattttattgcagcaggattaaataaaacaataaaaacttctactggtaaatgagccatcagtacagtaatagatgtacagtactaataacattggaataaaatttgaatgagaaccattaaaaaagattatgaaatgcatgtgccattagtttggtttaattaaaagagaaagagaggagaacagttctacttttccaatatttttagaaggcttctatgggtaaccatttggcatatcctagggtcaaggggctctgataccaacttgtcacgcccggaatttctatccaaaattccaaacgcttacatgtgtgtaaaccctcgtccaggaatcagccgaggcacacaataacaaattgataatagagtacaattattactctaattattaagcgtataaaatgtcattacagaggtagatagttcctctcaaacaataaagatctaagcagcggaaaaagataaacggcgcagacggctccactccacaggcagcttgaccaaggctacacctaatcctccacaccatcagcttcactgtagaacccttcttctgatgaatgattgcaaggtgagtatatgacatactcagcaagccacgcagcaaatatgcaagtgcacaggataacaaaggatggcatagtagggctccatttgcaaaagcagcatttagcaaacatttgagaatttaataaaacagttaagtattaaacattattaaatcaacgctatacaacataccctgttgtataggcccaaccattctgaacaaccatcccggctgcacagttctatctccaaaccaggaatataccattccaaaccaggagctagtcaaattattaccaaatataacatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacatcggaaaggagttgtgacaataccccttatataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacaaaaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcaactagggtttgggtggaccggcgcacgggcggcggttcacacgaacggacggccgagattgatccgatccaaatcggacggccaagatcgatcggtctacgaccggctcacgggataggatcccgatgacgtcagcgatgacgtcaccgacgacggcggcgactcggcgaagaagacggctcgggcggcggacactcgccggcgaacggcggcaccacggcaccaacggagggcaccagcacgtagaggacaacgcggcgaacacaccggtgaccaaaacggcggcggaaaaggaacggacggcgacggcgacgagaaggaagcggcggctaccttcgggttgacgacggcgacgatgctccggcgggttccgacggctgcgaaggggcggacgaggacggcggcgacttggcgagcacgacgacggtcttcccgagcggcgccgacagctggagcgacggcggagcacggctgaagcggcggcggcgacggcgaagctagggcacacggcgctagagctcttccgacgacgagaggcgaaggcgagggtggcggcggaaagagaagggcatggggatccttttaaaggggctcggaggcgacggcgaaggcccacggcgacggcaacggcgaaggaaactcgcggcttggaaagagggaaaaccgatccgaatcgaactcgattccaacgctttccaaagcgatttagccgaagattccaaaggagaaaaggtagaggagatcccggagatcatttcccctctattgattcggccggagaaggaaagaggcggccggatttggaaggaaacagcggcggcggctcggcggcggcacgctagggtttcggcccgaggaagacgacgggcctgacaggtgggacccacctgtcagcggctgcaagggcgcgcgcgcgcgcggccgncttcggactgggccggctgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattgaaatttattaattagaattagattttcttttcaannnnnnnnnnnnnnnnnnnnnnnnnnnnnnnnnnnnnnnnnnnnnnnnnnnnnnn

SEQ ID NO: 28627 - DNA, 2078 bp, Oryza sativa
  unsure (1)..(2078): unsure at all n locations
nnnnnnnnnnnnnnnnnnnnnnnnnnnnnnnnnnnnnnnnnnnnnnnnnnntttaaaactttttcaatgttaaattatttcttaaatgcaattccatttattaaaaatacttccttagctcaaataaatcccagaaaaatctaggaattatagaattaagcaaagtatttaatgaaatttatctggccactttttagattggaatttattaattaaacttagattttcttttcaaacctttttaaaataaattctagaaattccatttaaacaacaatttatataatttgaatttttagggtgtgacatcctacctgtcggagagagagggagggagaggccgactggggaggcagaacggacttgagggagagagagagccgagcgggccgagggaggaggccggcccgagagggagagaaagggggcgcgcgggccgcgggagagaaaggagggattgggccgaaaggggcccaaagagaggaaggaggattttatttgttttctttttattttaattgatgcaatgatctttgtgctattaaaattatttctcgagctccgaaaattcacggaaaatttcggagagtacattagggcacaaagaatattacaaaatattcccggccaataatttttaaaggaaatttttaattccctcaataattcacttgattaagttgatttaacttttatttaatttctagaaaatgtattattaattgatttttattcccgaacgaaaatcgggacgttacatatcctatacttattctagttacataaactatctcctgtaaccatttggataatcaagccctgcgagtatatggtacccataatatccacacccaacattataattttgtcggcgcatcttcgcactacacaccattgcatgctaatggttattcaacactgcttgctcatgatggttcttctgtgccgcttgcgaaacccacttcatccgcacttactgggaacaatgaccatgtcactgttgatagtgatgatgacaatggtgccgttcggaccagattgaagctaaattggatccaagaggaggatgttagactggtgagattttgatgcaatttgcctatatttgctttgtgaatgtgtgtgcacaataacgctttcttttgttatgtttgtagatgagtgtttggttgaacaattcaatggacccaattaatgggaatgataagaaggctgaaaaatattggggagatggagaagagatggagaagcccaaagcaagccaaggagcgttggcacaaactcaacactcggaaggatgtattccaaggctgttggtggaaggctaaccacacgtataaaaccacacaacatgagatggagaagcccaacgcaagccaaggagcgttggcacaaactcaacactcggaaggatatgttccaaggttgttggtggaaggctaaccgcacatatactcggacggacccattatttccaatcgttagatctatcttatatattataaaaaacaagtgtgtattcatgatacatcgcattctaaaaaatattatcatgcaattatatttcatcgtccaatcgtattcatgctaggctgcatggagcctcccgccactcgacatgaaacatttgctgatggattatccctcaaattttagactacataaacccatgcatttagtggagcctcatgtcccacccaatttatccgttaatatacaatggcaacctatatcaaaaaaaaaagtaaaacaccttacttttattttaaacttaatttgatagacatgttctctaaacaaaataagtctaccatctttaaaataagtctaccatctttttttaagatgatgaagaagattataaataattgtttgtaaggattaattaaatatgatgtagtataaagctaactaataggttagaaaattataaaagcaatgctgacaaaaacaatttacggagaaattgtatgtggcagatattctccggttaatattgtactcttgtatgtgtctcaaacatagtctactatacatacccacaagaatgcgcaggtatctttctagttaattctaac

SEQ ID NO: 28628 - DNA, 4794 bp, Oryza sativa
  unsure (1)..(4794): unsure at all n locations
nnnnnnnnnnnnnnnnnnnnnnnnnnnnnnnnnnnnnnnnnnnnncctccaatattgcaatagaatcaattgctccttgttttggattggtactattatttttgaaactgctattgtttcaagtgagtgaagtgggtctctaacaatctggtatcagagccaccaatccctactgagttcaccaagcaagttgccatggcaagtgaacataagttggatatgattttgaggcgaatggaggagttcgaacggaggcgggtggaggcagagcagacaaggagagctgatttccaatctctcaaggtagcgttagcatcatggattccccatttagaatagcactgaagactcacattttttagttgggaacaagcagtacaagatgacgcccaccatgtgttcgacaaaatgcttcagccccgatgtcgagcccaatctcactgttgatgtggttgttacatgtgccaccactgctatgacctttgttgatctggtagctgctgaggacgcaatcggtgcaacctacatctacaatcctatacagcccatggtaacgcccgccaagtgtttgacaaattgctccaaccccaatgacatcccagacctcatcgtggtagcagtggttacgtgcacctccacttctctggcctccatggacctagaagttggtgaggacgtcgcctgcaccactgaaattgatggccctgactgtcacaaggagacgcacaccaaatgttcgatgttaggccttgatgtcaagggtggcgcagaccacgtcggggacgtgttcctgacaatgacgggtgtggccaaggctgttccaatatctatcgagtcaattgacatcttctcggcaaggttagtcagcgacctcaagtaggacataccaatgcccaccgggtgtttgttgagaatccctcgatatgacagcaagacacagttcagtaaaaagctaaggctggaggggattgaattgaagccatggccacctccaacctacagtggagtgattagtggactgagttccggccaacgccttggccagcattcatctattgttggcttgaagaacatctacttgatccttggccaccatcaactgaatgggctaagttgaaaccgtggcccccaccacatgagaatgacatcctgcccttattgatcaatggcttcacccatatcctggtggatcgaaaagcaatttcaaaattctggaaagcgatttggagtgagtcaggtgaagaaggatcattgtttgttcctaagctatatgagctgcacttgagtggtctccttcagcattcagtaagcatgatatgacaacagcttatgtcaaggagaatatggtccactaaggctaaaatgaagatgttgaatggttgggattctaaacagtacctgagcattatgcggcctattccaggattgtttgttaaacttatccaagatatatctccaaagagccatcatcaagcttatgtagaagctcaagttgttaaaaattcttggaaaactttggtgaaaataaggtacactttttggctcaatcaattgctgtacctgagactcaccttggacaaagctgtattggctgctgttggttgtatggcccaaatgcaattagcacattccatttactaatagccatgctgcatattgtgagaccacttcccatgtagcaaagaaatgggctacagacttgaaaggccaaaccaagttggaagatgccaagtttgattggaatacactgggtacattggttcaagaggtcaattacatttaattgatctgtgacagggtttcttatggttgtagtgttcagaagtgctatcctcagtctattctattcatgcacaatggttggtgttttggtggattgcttgattggaactctaaacaatacaggaacagtatgctaactgtgaacccattggaactcatgcaagttatgttagtgccattagtgtgggatccagatgcgttgaaatgggtcagattggcagctatgctttacaaccagaaaattgtcaattaactacctgcatgagagcacattgcattaagccaagtgattatgagatcatcactgcctattgatgtaatggaggatgaaggcaatacagtttggacttcagaattttcagtcagtggagtggtacagaagaagcgattgaaacgtgatctttggtcgtgtgcatttgctgttaacaaggacatgaaggttgttatgttgctgcagcaatatggttctgcaaacttagtaattgtcaatttattgagtgttccatgggatccaggcggctctcatttggcattagctattaaacaaggaactaggctttcactgtgggctattacaagcattggctggttgtgtttcctatgatcatattggctacattacaagagaaatagtaacaggggagatcaagtgggtgaagcttgcacagcttcgagtcatcggcttggggacaaaccgaatttcaagcgaaggaggatgttaggagccatatgggctgcaatatgggctggatgaactactttccaagaagtccaagcaagcccaagagacaaccatatataaatagcagcagcacttctaggagggggcgaacagatcattggccaagacggcgaacggcggcggcggcggcctggaggccggttggctccttggcgatcttttctctacctcccttctcatctactaatctagaagcttctagaatcttttagcctttgtatccttccatcttccacctcaaaagcctccaatattgcaatagaatcaattgctccttgtactggattggtattacttttgaaactgctattgtttcaagtaagtgaagtgggtctctaacaatatatttcacacaagatgtctgaacaacgtgctgaaacacaccttggtagtggtagatgtataagtatttcaaaactcgtacaacagcggggattattacttatattccccttaggagcacatcacaaatacaatccatcaatcgtgtataagaatcacactagtattagtaattcatactcagtattatcctttactctgcttcagtgatcagtgtcagcagctagcgttcaatgtcgccgccctcagacctcggcgacgtggccgccgccggaaggccgccgcggacgtcgtcgccgcaggcaaaggcgatctcctgcagcttgatcgacgcgctggagctgaacacgagcagcggcttcttccgcggcacgggcaccggctctgcctcgcggttcaggatctgcaccacgcgacgcatcgccgggcgctcgtcgcagttggggttcgcgcagctcagcccgacgagcagcagccggagcatctcgtcgcggtagaacccgccggcgaggcgcgggtcggcggcgtcgatgaggcggtcttcgccgtgcaggcgccacacccagtcgacgaggttgacgttctttcccccgccgtcgtccttgtcgatggggcggcgaccgcagcacacctcgagcaccacgacgccgtagctgaacacgtcggtctgctcggtggccttgcccgactggaggtactccggcgcgaggtagcccatggtgccggcggtgagggtggagacggggctcttgttgtggtccatgaggcgggcgaggccgaagtcgccgaggcgcgggctgaggttgccgtcgagcaggatgttgctggtcttgatgtcccggtggatcacccgctgctcgcactcctggtggaggtaggacagcaccgacgcgatgccggacgccaccgtgtaccgctccggccacgacagcgtgcagggctcgccgtagagcgccttgtccaggctgccgttgggcatgtactcgtacaccagcagcagctcgcccttgtcgtcgcaccatccctcgagctggaccaggttcttgtggcggaggcaggcgataacggagagctcggcgacgaactcgttccggctctggtgcgcctgcgtggatcgcttgacggcgtaggagacggcggatgcggtggccgtccccggcatagccgccttgtacaccgtcccgaacgcgcctttgccgatgaccctgctcgcgtggaatcccctggtggcggcgctgagctccttgtagctgaacttcctcggccccttcaccagctcgggcaagaagccggcgttcttccgggaggtgagctctatcagcttcctgatggacacccaggcgaagaagacgaaggagacggcaagcgcgacggggccgaggatgccgagggcgagcccgaacctcttcttgcgagaggcggcgccgcccgcggccgcctcgccggggacagtctgcgccgacgcgttgccggtggtgttcgaaaaggaagaggagttggtcgccgacgggaagccgaacgtctggaaggtccattccttgatggtgtgctgctgcgtgctcccctccgtggaggccgagaagccgacgtacatggcgtccctgagatacggcgagaggtcgacggccacggagaggacgggcttcgccggcttggcggcggagtagctgagggacacctggaggaggtggtcggcgccgtggtagtcgatccacgccgtggtgaggttgccgctgttgaggacgacaccgaacgcggcgaggtcgacggcgttgaccgacaccggcaagccgaggtcaagcccgacgtggttgtcgctcgggtcgccgaactcgtcgttcaacatcgtatcaaactcaacggcgacannnnnnnnnnnnnnnnnnnnnnnnnnnnnnnnnnnnnnnnnnnnnnnnnnnnnnnnnnnn

SEQ ID NO: 28629 - DNA, 2497 bp, Oryza sativa
cggcgttgacagacacggcaagccgaggtcaagcccgacgtggttgtcgctcgggtccccgaactcgtcgttcaacatcgtatcaaactcaccggcgacaatagaggcgttggtcttggcggccgaggaggaggagttgaagagaccgaggtagcccccggtggccccgagcgtggcgtggtcggggaagatgaagaaggcgatgccgtcgccgccggtggatccggcgttctgctcggcgatgacgaaggagaacctcgccgcgaacgacgccgccgatcctccgccaccgccgaacgcgacggcgcggctgcagagcacgctgccggcggaggacgacggcacggcggtgtcgcgcgtcaggccgacggagccattccgcaggaacgagtcccccagcagcgtcaggtcggagaaggccagcgccgccgaatcaaagctaacattgaaaccaccaccaccaccgctcgccgccgccgccgacgcagaaaccgttagaaggagcgacaagaaggcgacggcgaggcggaggcggaggggaggagcgtccatgggtggcggggagggatccgggtcatggggttatgtggggcgcgcggtgtccgtgggattccgaggtggtataatggagatcagaacggcggacacgaggagcacagtggaggctggaggggaatcggatgtgcttgttggtgtcgaagcgtgtccattttttttaatgtgggtaacggtcggattggcgcgtttgaatgtaacggtcggggagggggagcaggtgagtgtggccggcaggtggggccgcatcgagtcggcggatgaggctgacaggtggggatgggagggtggctcgtgggcggttcgcacggttggctggtggggtccacagccgtgtgtccgtgtccgatcagatcggacaccgacacgggtttgcatcctctgcctttgtggcaaaaggcaaagtttgccgttgctttcatccacgccatccctcattcaatcaaccgcttccatcaatcgtgattaactagtagccatttaattagagaaattgaagaaaacaatctcaagcggtaaaccaggaaaaaaaaaacaaagacagccaacacatccttcgctatttgaatgagcagctaaaatatatactccctctgacgccgttgacttttaaacgacgtttgaccatttgttttattcaattttttatgtaagtataaaaatacttatgtcatgcttaaagaatatttgatgataaataaatttacaataaaataaatgataattacataaatttttttgaataagacgaaaggtcaaacgtttattaaaaagtcaacggcgtcatacattaaaatacggagggagtatttgatatctattcattcagaaacataaagaaaataattatcccacctccatactaaacaactcacaactgtctcgctaatgtttactactccgtctcaaaaagaatccaatcctatcaacgaatctagacacatacgtgttcaggtctgttgctaggattgtgtttttttttgggacgggggtatttagaaaaaattgtttaagttatactcccttcatccgaaaatgtttgacgccgttgactttttaaaaaatgtttaaccgttcgtattattaaaaaaattaagtaattattaattcttttcctatcatttgattttttttatgtatacatatagttttacacatttcataaaagtttttgaataagacaaacggtcaaacatgtttaaaaaaatcaacggcgtatgagaatataagagtatattttttctataattcttatagtcaagtcaaatggttgagaactttgttcgtataagtattgtaaagattttttttataaatatgtttagcaatgctaagaattatttgtcttttaaatcagatcaattaattgaatgttaattgtccatgaagtggggacaaagacatacatccattgattaaaagatggatgggcaggatagaagcaacagcaaactgtgccgtcagcttcaaagtcagaggatgcgaacccgatgtagtgatgtccggacatcgatcggagcatacacgtcagtggttgctgaagtgattcctgccttcactgtttcaccacgaacgccagtgtaatacagtaaagtgttgtgcggcacgtgctttgatactgaacacttttggctgagtttgagtgagagaggagaagagaagataagattgagaaaatacgtaggacgaggtgagttattagcgtatgactaattgagtattaaatatttgaaactataaaaatagattaatatgattttttaaaagtaaattttatataggaaatttctgcaaaaaaaacacaccgtttaatactacctccgccccaaaatataacaacttttggctataaatctggacacacggttggccagattcatagctaaaaatgcttatattttgggatgaagggagtagttcggaaagcgtgcgcccggaaaag

SEQ ID NO: 28630 - DNA, 1609 bp, Oryza sativa
tggtgtaatcaaaagcctgcagctcgactctattttatcccataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgcataactgcagactgactaaaggatccccctagggtctcgtgtcagaggaactatgttctaacctcgagttaataaccaacctgtggatggaaaagaaaaacaattaaactgtgatgggctaaaaagccaacgagacagtagttgaggataggagtttggatacgccttttacagatcaagataagggttgttggaggaaacccctaagggtacccgccatgcctctacattgataagatcggatatacctgccaacagttaagaagatctaggagacatcaatatttgagaacataatagtcgatggctggtaattagtttatccggtatcagaaaaaggtcaaaggtgatatggcagaagaacaatttggatgctccccatctcgaggaagcactaaagatgaccatcggcaattaaaccctagtggtatagatacagatagcgggcaatgtatttccctgaaggtagtcagtacagccttttgacgaaccacatcaaggtttcactggaaggcagcaagccaaaggacctcatcgtccccagaagcgtccgcaatccacgttaaagaataccacctgttagagataagccgaaagatgatttataaaaaaaaaaaagattggcaaagatgttctctagcatgaaagaagtaggccgaaaggcgattgataaacagaaacatgctctgcatcgcttaaggaagacccctgatagtaattgccccgcaacagtcaccttgtcattaagtaagcaagatgacctaggtaaaagtgtttctatgaagacaaggagtgaaatcttcaactcggtatcggatgctacacggagtgaaaagtgcaagcaccggttaccaggtaatgccatgtcctgggagatgatccaacgggaaagaactcatcaaggttaaaggtgtaaaggaatacgttgagtgctaactgaggacaacctgaagataataatgggaagtaaactgaatgtaaagaaagtgaatccgagctgcttgttcgtgggaactattcccagttatgaaccaagtgatatgttcgaagatagtctacagaggtcagattaaaatcacctctaacaacgaagcttcagatctggcaggatcacgatcagacaataagaagtccagcagtaaaactatttgggaagacgtcaaagtatatcaagtgggataagctggttctcttgggaagcataattcaaaggcaaagttatcgacccttgcatcaaatagcagaagtagctatcacccggagaccaggaaagctaatatgaggcagtttgggggcgagttagaagcaaatgacaagcatggtatcttataatgacgagctgatctcgacgcatgacatgaagttgata

SEQ ID NO: 28631 - DNA, 839 bp, Oryza sativa
ttccgagatataattgccacgtgagcgccacgtcaatgccacgtgggacgaagaccaagtcaaacaagccacgtaggcgccacatcagccaaaaccgccttcaaccgccgggggaccacgtttacccgtttttcgtaagttgggggacgggtcatacccggttttgcggtcaagggacgaaaatcggactgggcgacaaatagagggacccaaagtaaacttattcccatatataagtagcagcagcacttcgaggaaggggcgaacagatcattggccaagacggcgaacggcggcggcagcgacctggaggcctgttagctccttgttgatcttttctctacctcccttctctactagtctagaaacttctagaatcttttagcctttgtatccttccatcttccacctcaaaagcctccaatattgcaatagaatcaattgctccttgtactggattggtactattatttttgaaactgctattgtttcaagtgagtgaagtgggtctctaacaatctggtatcagagccaccaatccctactgagttcaccaagcaagttgccatggcaagtgaacataagttggatatgattttgaggcgaatggaggagttcgaacggaggcgggtggaggcagagcagacaaggagagctgatttccaatctctcaaggtagcgttagcatcatggattccccatttagaatagcactgaagactcacattttttagttgggaacaagcagtacaagatgacgcccaccatgtgttcgacaaaatgcttcagccccgatgtcgagcccaatctcactgttgatgtggttgttacatgtgcca

SEQ ID NO: 28632 - DNA, 450 bp, Oryza sativa
acgtgctccccttcctgcactttttcccccattcccccctcaaaaaggggcgccattcgagccccactcgcccaggtcgccggagctccatccgccggacgttgccgcccgccacggccacgatctccccctccggggcctataaaaatgcaccccgacctcccctcatccatttctccaactcactgccccctcccgcgcgctttttggagctccccacgccactcccatgtgccgccgcacgccgacgaccctccagccgcgcgccgtcgccgcttccgtcgcccccgcactgcgccgctgccacctatagcatcgcagcatcccaccgcaccccggcatccgctccatttcccctccccgccgctgaaacaccgtcgccacgcgcaccacctctctccaccgtctttaccacctccagccgccgcttggtgccgctcccaaccaccc

SEQ ID NO: 28633 - DNA, 894 bp, Oryza sativa; identical to SEQ ID NO: 13605

SEQ ID NO: 28634 - DNA, 850 bp, Oryza sativa
gtagccttggtcaagctgcctgtggagtggagccgtctgcgccgtttattttttttttccgctgcttagatttttattgattgagaggaactatctacctctgtaatgacattttattcgcttattaattagagtaatatttgtactctattatcaatttgttattgtgtgcctcggctgattcctggacaagggttcacacacatgtaagcgtttggaattttggatagaaattccgggcgtgacaggggcccacctgtcgggcccgtctccctcctcccgccgatcccggcgcgccgccgcgcccgcaaccatcgccgcgcccacgtctccgcctcccccgggccacgtcgaccacgcccgcgcgtgcgccgaatctcccgcgcccattcccctctctctcccgctcgcgcccgcgcccgagatggccgggattcgaaaatcgaatcccgcctctctctcctccccactcccccgcgtcggccggcgattcccgcctctcccggccacgtccggttccctctccccctatttaagcatcgccgtcgtcctctctcactttttccccatttcgccgacccctcccgagctccccattgctcccgcgccgtgcaaccacccgccgccgccgcttccgctactccggtcgccgctagccgccgctaggctcgccgccgcaccgcgccgtcgccgccgtcgggttcgcgtggccgagatccatcccgtccacccctctttcgtcgaggtccgtcgccggagagccgttcccgtcgtgcgacggtgagggtcgccatgtccgccgccttcggccggcatccccgcctcctatggcccctctcttcctctctaa

SEQ ID NO: 28635 - DNA, 167 bp, Oryza sativa
aagtccgggtagtctccagagactagacgaacagacagctcagggtccattcctgccaagaacttctcttgcttctcctcatcttcccgcacatcctccggggcataacgtgctagattgttgaactcatgcaaatactccatcacggagcggttgccttgcttcaa

SEQ ID NO: 28636 - DNA, 6605 bp, Oryza sativa
attaatactgcttaatttttacaactgtttaaatccttcaatctctatttataaatgctcgctttatgcaaatgaaccactttagctcttctttgatgattccctgcatcatacctctattccggtatgacttgctgagtacagtgggtagtactcatttttgctctacttttcccaaccccagagttcgagttcgggtcagatgaaggtttctctgaggagtaggcttcgtccgtgccgtcgaggatgcctgtggagtggtgttcccgctgcagtttagtcaaggattagctccagtttcttctgttttccgctgcatttatgtaagactttacgatgtttgtaagacgtggatctgtatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaaatcttggtcgctcgtttaagcggggttttttcaaaacaagtcagtctagggttttagtaaaattattgggatttattcgtcagtcagttggggtttgatgggtgaaatgcattaggtcctagctcaggaatatgagttgcaaggtgtttatgctcttatcgttattattagtatgtatctaatttctcattattttatcgttatgtgggtctgtcttgtttattcgctctcatgcaaaatgatctatgcataaaaatttcgctcttgttcgtttcccttatttgggtcttttattgctttatttaaatttggatttgagcatgcattgatcctactcctttgtcttctctagatggccggtcacccacccaaccaccgcggagaaggcatgatcgatttcgtggcagagttggcacgtatgacactggtggtgggctaccccaatgcgccggagtacacgacgattccgctgcttagtggcgagcttcctcaccgtgtccgcttggaggtccatggctacgtggggacttgcctcgctaacatggcggtcgaggcatctggaggcacagcagatcacgcctgtcaggaggcagcctacttgatgatggccagactacgggagcgccacaactacatcttccacgacacggcgtaccgctaccacccccgtcgagccaacggtgatggcgtcagctccttccgtccgacagctggcgagaacgacaccacctttggtcacatgtgtgctgtgatgaggggattggacaggatgcactcggacttgcacaaggcgaccaaggctttgaacgatgggaagctcatgaggatcgtcgctctgaaggacgagatagcgcgcctgaagaaggagaacgctcagctaaagggtcttccagcgccagaaggagtccggatccgcaccacgccccgcaagacgacgactgcacctgtgcgcatccagcttgcgcccaggaacccacctccagcagcagctcccgcagcacctccagttccgcccgcagttcctgcagctccagttccagctcccgcgttcactctctccttcgctccagcatcagccgccaggggtccagccagtggcaccggaggttggttgtctgctactcccagtggcagcggcgagactgatctgtcaggctccaggagtcgctcagagggaccgggtgacgagcaggaggacgccttcgactccaccgaccgcaggagccgttccgagcattaggctcgttttcccattagtttatcgatggtctagcttctggttgttagtttgcgtgtttaggttgcttgtttggggtcagttgacggtcgatatcatgtgcctatgatatggctgtcttaataaggatttttgcttgctttttaagtgttttaattcagatcagaacaattgcagttttaattcctttgtaataaagcttagttcttgagcatctgtttttcttcttttcccccgtctgcttttccctccagatggtctacaccaggactggcagtcgcgcgacaggcgagggcagcaacggcgaagagcgcactgatggtgtgcaccccaacagcgattctggcaatggtccgccaccacttcccgagaatccgacgcttgcccaagttatggcacatcagactcagatgatggcagccatgatgcagcagatgcagcagcagcaccagcagatgcaccagaggatgatgcagcacgccgaacagcagcatcaacagtttggtccccctccccctcagtccaagttgccagagtttctacgcgtcaggccacccaccttctccagcaccaccaaccctatggaggcgaacgactggctccatgcaatagagaagaagctgaatctcctgcagtgtaatgatcaggagaaggtcgcttttgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaataggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggaccaacgcaacaagatggacaggaagaggaaggccgctcagttcagggcacatcagggaagtcaccagaggccgcgcttcactcccggacagcagggtggacctaccaccatgatcgtccgccagcaccgcccgttcaaccctagcaacttccaccagggcaccagtggcagtcagaaccaccatggaggtcagcccaaccgcggtgcagctccacgcccatcagtggcaccggcacagtcaggccagcccgcgcaagccaagaaggagactggagcaaaaccagggtcctgcttcaactgtggcgagcttggccacttcgctgacaaatgcccgaagcccaggcgtgccgggccaaggtttatccaggctcgtgtcaaccacgcatctgcgcaggaggcacaaacagcaccggaggtcgtactgggtacgttccctgttaactcaatccctgcaacagtactttttgattctggtgcaacacattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctagatgtcattcttgggatggattggctgaccaagtttaagggagtcatcgattgtgcgagtcgcacagtcaccttgaccaacgagaagggagaaaccgtggtgtacaaatctctagtctcgccaaagaaaggggtctcgttgaatcagattgagacggaaatcccagtggacaccgtagagaagaacttgagaaaattggaagatatacccatagtctgcgagtatccagaagtgttccccgaagacctcactaccatgccacccaagagagagattgaattccggattgacttggcaccgggaactgctccaatctataagagaccgtacagaatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcgaatcgacgatttatttgatcaactgaaaggaactaaagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacatacttatctactcaaaatccgaggaagaacatgagcaacatctccgtctggtactcgaaaagttgaaggagcaccagctatacgccaagttcagcaagtgtgacttctggttgacggaagtcaaatttctgggccatgtcattacagctcagggtgtggcagttgatccatcgaacgtggagtcagttaccaaatggaccccacctaagaccgtgtcgcagattcgaagtttccttggacttgcgggttattaccgccgattcatcgaaaatttctccaggatcgcccgacccatgactcagttgcttaagaaggatgagaagtttaaatggacagctgagtgcgataagagctttgaggagctcaagaagaaattagtatccgcaccggttttgatcctgcccgaccagatgaaagacttccaggtctattgcgatgcatcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaaatacatcttcacccaaccggatctaaaccttcgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgaacatctcaacatgggaattgttgaacacgggttcgtagccgctctggaggcacggcctacgctcgtggatcaagttagagccgctcaagtaaatgatccggaaatagcagagctgaaaaagaacatgagagtcggaaaggctcgggatttctttgaggatgagcatggcacaatctggatgggagaaagattgtgtgtacctgacgacaaggaactgaaggatctgatactcaccgaggctcatcagacccagtactccattcatccaggcagcactaaaatgtatcaagacctcaaagaaaggttttggtgggtcagcatgaggagagaaatagctgaattcgtcgcactctgcgatgtttgccaacgagtgaaagcagagcaccaaagaccagcaggtttactccaacctcttcaaatcccggaatggaaatggaaggagattggaatggactttataacaggactgccccggacatcatcgggtcacgattcaatctgggtagtcgtggatcgactcactaaggttgctcactttatactagtacataccacctatacgggaaagagattggcagaattgtacctcgcaaggatcatgtgtttgcatggggtacccaggaagatagtatccgaccgaggtagtcagttcacctcaaagttttggcagaaactgcaggaagaattggggacccgtttaaacttcagcacggcctatcacccgcaaactgatggtcagaccgagcgagtcaatcaaatcttggaggatatgttgagagcttgcgctcttgattttggtggagcttgggacaaaagcttgccatatgcggaattctcgtacaacaacagctaccaggccagtctgcagatggcaccgtgtcgcgtcccaaatcgactctaaaatctatcctcgaaattgtgcaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataaacaaagttaaaaaggttttataaaaagaaaaccctaaaagaagttctttttttccccctccttccctcttgggccggctcggcccacttccctctccctctctctctcctctcccgcggcccatcggcctccccgcgcgcgcgcaccgctgacaggcgggcccgcccgccactctcgctgacgggtggggcccacctgtcatctccctcctcgcgccgcgcccgccgccgcgcccgtgccctagcgccgccgccgccgcggattgcgccgcatcccgccgtccccgcacgcattaaagagaggggaatcactccccgtgattccctctcccgtttcccccgtttcccctctctctctccctcggattcgccaggatttaat

SEQ ID NO: 28637 - DNA, 2538 bp, Oryza sativa
cccgccgaccgccggagcaccgtcgtcatcgtcatcccgacccgcgccgccgtcttcctccgctccggccgccgttctcgtcatcgtcgttgttccggggtgagccgaagaccgccgttcgccttcccccttccctcctctctctcgggcgccgctccgccgcgccggtggtcgccggcggtgaccatcggggcgcgggcgcgccgctcccgtcgccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatataaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctactcatggtatccctagtataaattttaggtagatgcttcgcaatctaattaggtaaccttaggtggttttacaactttagactttgggaaatattcatatcacttggatactctggaattgttggtttattgtggaattggcttcacaccgccccctctattcaaaatcccctaaaatggttttaggctgggctcggggtgcgtggttttgatggtagcacctcggccgtataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgcgaggggctcagttccgtctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaaccctttatgttataattcccttgtactcccttgcatttattttgcatttgtgggtgtgtcttgttgagtacggtggttgtactcagtcttgcttaattttcccaagcccagatgaggagttccttgaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgttaaactctgaattgtatcaacttttggtgtaccttgcctcctgggacaaggaataatgcacgcacgtcaggaacgcctgttgggtgatttccggtcgtgacaagttggtatcagagcctcccttgaccctaggacgagccgtagatcccaagccttggctatattttccaaaaaaataaaaatcctttattatttgtgaaaacccgctattctctctttgtcttgctgcttcatttatcgtcaaaatctgatcttttaaatgttgcttttcttttgtttttgtttgtagatggccggcagcgttacccgtcgtggtttggacatgactggcttcgtcttggagctgcggggcatgtgcgtggtcttggggtatccacat

SEQ ID NO: 28638 - DNA, 24178 bp, Oryza sativa
aatagcccacctaaacctacatatagtacctcgtggacagataaacaccctagacattcaacctcttttgagaacccaaatagaagaagcccagaaggacaacgaagaaatccaagaggtgaaggaacgcctagctgcagggtttgcaaaggaattttcgaccgatgagaaagatgtcttatggtataaaaagaggatctatgtacccgaaaagggcggactgagaggattaatcctaaaggaagctcacgaatcagcatattcattgcaccccggaagtatgaaaatgtaccaggatctgaaggaaggatactggtggcccaacatgaagagagatgtagcagaatacgtagcactctgtgacatatgccagaaggtgaaggctgagcaccagcgtccagcaggtttgctgcaaccccttaggattcccgagtggaaatgggatgagataggtatggattttattgttggattgcccaagaccgcaacagggtataattccatttgggtgatcgtggatcgacttaccaagacggcaagattcattcccgtcaagaccaattattgcggtgccaagctcgccgagttgtacatgaccaggatagtatgtcttcatggtgtgcctaagagaattatatccgattgaggcacgcagtttacttcgcatttctgggagaaagtacatgaagccctaggaagttaccttgcttttagcacagcttatcatccacagacagatggccagacagagagaacaaaccaggtcttggaggacatgttgagagcttgtgccttgcattttagcaaagattgggagaaatgtttgccctacgccgaattctcctacaacaacagttttcaagcaagcctaaagatgtcgcccaatgaggcattgtttggtcgacgatgtcgtactccactgatgtggtccgagactggagaacgggcggtatttggatgtcacgcccagaaatttagcccaaatttccagactattttgtgtattaaatccctgtccaggaccagccagggtacacaaaacgacaagtaatatacagttccaaatgtaaataaagcgtaaaatacttacagaagaggcacttagtcctcacaccgaaacaaaaacagcagcagtagaaaaaggcgatcctagcgggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggatacaaggaggggtttgtggctatttgcataaagacagttgtaaaacattttattgagcaaaacagtaaaactgttgagtaattaagaaaaattagatctccactgatcaacgctacaccacgttgaacaggcccaaccaacccacctgaactacagtgcattgagtcgatttattaggggtgagactaatcacggtgaatctggtcaatcgcccataaccgcgggcacggctattcgaatagttttactctggccagaggtgcacaactgtacccacaagacacaacgcaccggcatgtcaccgcgtcatcatgtgcccatgatgcacacgtcaccatgtcgagtaattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccatgaaacatggccagatgtctcgagcacgcagctcactctgatactaaaaaggtctaatactgtaattatcccatcaactgagctagtggtaattaagcatggctaagcatacagttctagctaggtcacataagtaacatgagctagtcgattcattacccaaggttgacaaagaacagatatcaagtaaacatggcacaagcgagcagataggtaatgcccggatcccatgtaattagcaaaacatgcatatttatttgtaaacggtaaaacatttataaattgggatcaacatgctcaaggggaatgtgtgacttgccttgcttcttcaaaacgatcttccgaactcttttcctcgcgaccgcgaacttccgaaacgacggattctacacgctggcacgcaaaacgaggaaaaaacctaataaaaaccaagaaaatagtacataaaaactaaacaaacatgtagagctcaattttagatgaattttgcaagttgaatggctcaattcggagttcgaatgaattagatatgaattttagaagttttgagccatttaaatgaatttctagaattattaacgaattatgacgcaattattatttatttttacaaaggaaaagagggttgctgacgtcagcaaggggcgccggcgccgacaggcgggccccacacgtcagcgagacgaggtggcggtccaccgtggaccgggaccacaatggacggtccaccgccggtccacgggttggacggcccagatcggccaaggccgatcggacggctggggacggctcggcggcgcggcctggccagcgcgcacacaaggctggcggcggcggcggcagggaccaaagcgacggcggcacatgggctgggcggccaccggcggcggcggcacggcgcgtgcaagcacgggaggcggccggccaaggggagaaacagggaagagggaggagtgctcaccgagggcggcgacgaggggcggggagaggcgggggagggagctcggcgtcggcgctcctcgggatgaaggcggaacggcggcccggcggcgttccgtgagcaggaaccggcagacggcggccggaaggacctggggaggatgggggagaggttaggagggggagagagggttctcaacggcatgaatcgctggtcggaggggagaacgggcggcggatgctcaccggcgcgaggggaaccgtgttccggcgggatcccggccgtgaaaagcggcggccgaggtgctcctcggcgctgcgaagtgagcggcagcgacagcgcgacttggggtggctaggagcggcgccaagcggcggctggagtcggtggcttcggtgcaaggaggcggtgcgcgtggcgatggtgcttcggaggcggggaggggaaatggagcggacgccgggaggtggcacgacgcggcgaagccactggtggcggtcgcgcggaacgacggtggtgggagcggctgtggcgaccggctggagggtcgtcggcgagcggcggcgggaggtgcgacggtggcggggtggttttcgtgcacgggagggctcgagagagagggggaaatggagaggggggtgcggggaatgtttttataggggaggggaggcgggatcgagcccgagagaggtagaaaccggccggcgacgtgggaggagagagagatgcgggaggcagcgacgtggccggattttgcggggagagtgggggaaaacggcgccgacgtgggcgacgaccgcgtccacgcacgcgcgggagagggagtcgcgcgggagaggcggcgacgtgggaggatttggcggccatggcggcggttggtacgacgggaggttggggaagaagatgacaggtggggcctcgggtcccacctgtcggggagagagagagaggagaaaacgggcgagggaggtaaagcagacttgagggagcgagagagagagccgagcgggccgagggaggaggccggcccgagagggagagaaagggggcgcgcaggccgcgggagagaaaggaggggttgggccgaaaggggcccaaagagaggaaggaggattttaattgttttctttttattttaattgatgcaatgatctttgtgctattaaaactatttctcgagctccgaaaattcacggaaaatttcggagagtattttagggcacaaagaatactccaaaatattcccggccaatgatttttaaagggaaaattttaattctcccattaattcgctcgaataaattgctttaacttttagtataatttcttgaaatgcattattaaatgattttaaaacccgaacgaaaatcggggcgttacattggacctgacattatcaaagaggccgaagacaaggttcgcctgatccgtgaccgtttaaaagtggcacaatcacgataaaagagttacgctgacacccaaagaagaaacctggagtttaaggaaggggattacgtttatctgaaggtttctccgatgagaggcacgaaaaggtttaaggtcaaagggaaactagcgccaagatatgtgggaccttttcaaatcatggctagacgaggagaagtcgcatatcagttacagctaccagaaaatatcgccgatgtgcacccagtcttccatgtgtctcaattaaagaagtgcttacgagtgccggaggaacaagctccgttggaagaaattcatattagcaatgatctcacgtatccagaacacccagtccggatattggatgaagcagaaaaaaggactaggaccaaagtgtggcgtatgtataaggtacaatggagtaatcacactgaggatgaagccacttggaaagcgaagaattcttgaagacggaatacccgcatctattcgaaaaccggtaagaaatctcgggacgagatttatttaagggggtaggtttgtaacaccctgaaaattcgaccaacgaaaatcaaaactctaaaaatatgggccttcaaaaactttttaaataaattgcatcatgccgattttattcacctatttcattggaatttggtttcggagttcatagatcgcgaatagagaataattaatgaggaataaagcctaaaattaaacgggaaaaataaataattgaaatataatttaaaataaagattaggtgaggttggaaataaataaaatattatcgcgaccatattagtaacaattaaattttagtgcgatggaataagaattaattctgattaaattcaagaaaattatataaaaataaaatatgggtaatgttaatctagagtgaatcttttggttgaaacaacacaaatattatgtaaacttcatttgtggaaaaattaggaattaaagaataagatttataaagagaataggttaaattagggttaaataagagctagcactgttcattgcgcactaggtgctcgatgaggttccctagccccgtcccctcccctgccgcgcgcgcctcgcgcccctagccgtcgccatcgccacctgccgccgcgcgccgtctcatcgcgctgccgcgccgcgcctccgtcccgtcgcctcgcgccgcgcgctcgccgcctcgcgccccgcgccgctgccacgccgcaccatcgtcgcatcgcctgtcgccgtcacgccgagccccgtgccaaaccgcgccgagccccgcgccgcgccgcccgcccgtcgcgttgccgctaccgcctgccgcgccgcgcgccgcccgtcgcgtcgccgtcgctgccttgcgcccctcgcgcgtcaccgcgcgccgtcgctgttgcgtctcgtcgccgctgtcacgccgcgcgccgtcgccgtcacgtcccgagccccgtgccaccgcacgcgtcgcgtcgccaatgccacttgccgcgcgccgctcgcccgtcgccacctcgagccccacgcgccgcccgtcgcgtcgccattagggccggccacccctcccccgcgctctataaaaccccggcccccccttctccaccccacacccatcccccttcatttccccctccttctccacgtgccgccgccttcgtaccgccgcgccgttgcctcgaagccgccgcgccgcgccgagtgccacgccgtgcgtcgccgccttgcgccaccgccgccggtaagccgccccccccctcgtccggttgccgtcgccgcccgggtaggccgtgagccgagagagagaggtggggagaagccgggagagagagagagaaagaaagaagaggaagagaaaaagaaagaaagaggaagaaaaataaaagaaagaaaggaaagaaaaagaaagaaagaagagagaaaaaggaaagggaaaaagaatagaaaatttgagagaaattgaggaggtttagaaaatttaaaataattagaatttaattatagattaattaaagtgtaggattgcaaaatattaatataattatagattatttttggtaatctctataagtaatcaattcgcggtaggaatttagatttatttaagaactaaataattatgttgaattcttaggaatgtacttctaaatcacaaaatgacttaggttgaatgacccaaaaatttgaataacgtggtttcgcaaactttgtagtcgatatagaatgatcgattcgcgttcgacttctatttgagtttatttggattttatttgaattctaattgaattcaaatcatttcttcgcacgtaattctagagcccgagggagttgtggatccgagcgagggtcaagacccgcaggactacgagcaagacaagtcatcactattcttgaacatgttgatcccaattgcgaaattaatttgtttacaaataagattgcatgcaatgatgaacatcctacttgtgattatgccatgccttgattattgtttacctttaaatccttgtaaccataattacgtatgggtccttagtcaactatgacacatgcttaagaaatgctacactagattcatgcatgctcataatttatcaaatgctatatgcttgggcaattacctttgggaaggtaattgaaatgcggcatgtggagacatgagcgccacattgccatgataatgatgacatgatttgtgcaagtaggaatgaaattaaacactttttttagaccggggcggacggaggatttgggtggtatatgggaaaggctagtaccgtccccggtcaattaaggaccgagccatgaagttaagcatgaaacgacccttgtacaaacgcacttctcgtatgggtatagacctagcggattagatagccgagcggaggcagtatctctgcatagatggttcaccccctgagtgaggcaggtgcgctaccgtgggacagccgttgaggtagggccgagaggcgtgccctacatcggtgtcgccattggtaggactgccatgagtgtgtgagagagagaacttaacttgaaccataatttaatatgtgtgtgagacttctcttttccgggagcgccataactcctctcactgctagaaacatggacgcctagagtgcatgaggatttaagttcatggagcggatactaccaatgcgaagttatcgaaaagctttgccgtgacgcgtctcatgtgttgggacgaggctcatgagttaggcagtcgcggagtgcgggtaaagtgtacatccactgcagtgtgagtagaccaaatctattcgaatacccgtgctcgcggttattgagcaccaggacgtgtattacacttggctagactctaaatccttaacttgtgtgggatgggatattgcatgatgatttttatgctgctggagccacttcctgagaggcgggaaggtggacatcctcagaaaatcatgacgattcaatggcgggaagctatccttgggatcacaatggatggtggacagaaccgtcattatttaaatatgaacactggtactaaaatttgatcagtctatgctaggtcttaggcttgtgaaaagaattacaaaactggctttgcgcaaagaaccatagccatcctttgaatacccctatcatgtgcattgttgctgtgatggcttgttgagtacggttggtactcacccttacaatatataaacttaatcagaggccggagatgaagcttcggaggatccctacgcgtactaccaggagggtgatgaagacgacggcgctcagtacgtcttagttacggtcgttgcctgtggcaatggcgtgccgctgccttaactccgctgccttacctacttctgcttttggaatgtattccggaccgctcggtctgatgatctaagactatgcctgctggcttatgatgtaataatttgcactagactctcgtgtatgtgcatttggtgtttcagctatgaactcgtgtgtaccagactacttgatccagggaaatggtactgtttacacgattgattcctgttataaaaacgggggtccacaccaatagagggggaaccaagcaaagcggacgagggaggtgaggtcgatcagctgcgcatagacaacgtctccacagcttgtgccgagggcagggagctggagaagagctacgagagcgtgatgacgtggtccagtgagaggggctgggcgaagaaggcgttgtaggctgcgaccgccaaccaagacaggaccctcctgaagcaccaacccgagcttgcgcatcaagttgcgttgtgcgtgcgagacagtgtgacttggcctggcgagcgtgagcttggcaacaatcccgttgctgcgcttcgaaactacccccacaggtgcggcgaggggtgccgaaggcgggcgcagtgggaggagtgccggggtcagaggtttggagcagctagcgaggaaggagcacagtgaggcattgtctgcgactgaagtcggcaacaagcgtgccattggccaaccatcaaggtcgaggacgaccaccggcacgtcgaacaagaccccgtcaggcacgcaatccactgtcatcgaacttagtgacagaggtgtgcagacacctgcaacagttgccaccggccttggcgagaagtgggccaatggtctcggcagaggaggcaagcgctacggcaacggcggcggcagcgattgcggtgggagagaccacggcgcatcggctgccgtcaccggcctcggcgaggagatgcccgacagcttcgaatgtggaagggagagcgatggcggtgttgatggcggcaacaacacgcagggcagtgttggtatttcttacaatcacgcacgtaataccattgttgcacttcccattagagtttccaagggtatcgaacacaaggaacgtgtgtgtatcatcaacgatcaagattcgatcaaggacaacaacttaggagaaattgactctagaggattcttatatcttttaattaattaattaagttcaaggtaaaactctaccggatacttcgggcatcggccctcctctggcctgccagcatgaatattgcatccattttatgaatactcgacgaaattcaccccccctgcgttgtccgcgaagcagtggtgtcggcgcaagggcgggatagggttgagcgggggatttagattgggtgacatagggtaggcatagagtgaatcttggccctccaaaacaaaaccaatgggtgaaattcatccacgtctcgcagaagttaaaattttactgggagtaaaatttcaggagttaaaattttactttcaggagttaaaaatttactggagttaaatattaactcgtgttgatgtagatgaatctcagccgttggatttgttttagagggccaatatccaccctatgtcaccgcgtgtctaccctatgtcacccgatctgaatcctgagtgggacgtgtttgtcgactgtcgcgatgccacgaccaatggtgggagccctacctgtgtcgaggcgtggagtctctcggcgggagctccgtctcgtcgaagcccttttgtcttgagttaacaaatttcagactagcatgataagtcgtcaactacatcctggtaaggacatattggattggaggagacacgctttggttcaacggttggcttatcttctcagacttcttcgtgtaattttccactggtaagaagccaagaatgcgtcgtacatgtcgatatccctttttctcttccaatttttactgacatgtggtgcaaaaaactctcttgtgcagtttgggggtgggttccgatggcatccgtcggcacgagtacaggctttgttgaaatgtcaagccgaaatgaacacggcaaaggcttctggaatcaggagccctggatgcctggtctctcatgtcatgtgtgaacaacgtgcacacacaaaaaggatttatgatttctacctagtttcaaaaaggtcagcgtatgtgtaggacctcttttggacgactgactgacttgagtgttttttttttttactaaatcaccggagggggagagcttccccacctgaattttgtcgttgcatgaaaggagtgaaaaagttcattacaacaggtttagagatcttaagggggaggagaaaatgtttttccaaacagagattacatgtctatcctcaatttttaatttctctgcccagagagctgcctcattgatgcatcgatgtaggcaggatcgaatcgatggagtttgtcccctgaatacaacgtcatgccgatgattccagatcacccacatacatagcaagaagaagacgtgatggtgaagctcagggacaattagagagggttttatttgatgaagtagccgcacatcttggattatcggctgcactctaatacgttcccagaaactctacactgactgagtgtattaccttttgtctggactggtatctcttaatatatattggccggcttttcgccggcccggcaaaaaaggtatttcaatcaatcatctcaaagatgagatccactccggtgccttctacttgtagtagaaaataatctgaaccgttgatctcatttgatcatagggttcagatctatttctactaccatcacacttaatggtagtagaattgtagagggatatttttgtccataaaaaattatttgcagagggatattttcgtctttcccgggctccagctggcgccgccccgcgtgctgctcctcctgctggccatccatgtcgccaccgccacccgctcgccaccgcgacgactcgcaaggggaagcttcatgaactggatcgctggaatgggtttcacgcagaattccagcgagatgggcctattcacgttacattagctcgggtaaagaggaagcaaagcacaaatttaatggaccaggctcacggaagttgagctacttcttttcatagcaaattcaggttcttgattctggtatagcaatagagcatactgtccatgtccaaattaaattcttattcagattcagaatcagattcttgattctggtgaagtcatccacgaaaattaacattaccgtgccctgctgatgctgaggctacagaaaactctactctcccgcaccagcctcctcaacagccggctccacgcacgcctgtagctgtcgtcgcagttgccgccgccgccggcggcgtcgcgcgagaggaggtagaaccacgcggggctcctctgcaccgccgcccctgtgcgcacgccggaagtcatcagggcggcgccagaagctcctgcggcggggaagcggacgccggcagagaagggaacagaacaagagggggcgccggagagtattgccgccggcggaagggaacgtgatgcacaagcgccggcagcggaaggagtcgctctctccacctccgctcgaatgcgatggatgaggaagcggtggcagcgctgcttttcctgaaacatccgagcgatccacgacgagaaataaattaagtgccaaatttatcccaaatctatctcagaactttactaatctacccttaaaaataaacggttcagattagttctactcgtagtataatactaacagtagaaagcaccggagcattgctcctcaaagataggtttcaacaaaaaataatacaatctggtgttggaattggttggggaacttgggatgtccaaagtgcttgtagaaaccgactcgctggaggttcgaagatgatttctcaattagagttcaattgttcggtctacagtccgttggtatatgaatggaaagggatgctaaacaactttttggcggctaaggtggtttggtttcagcattcggcaaatacagtactagctcataggctaactaaagaaggtatctcggttcccccggattttatacgatcgttcgttgaggatgattgtaagcaggcttctttagatcatctaaaggatcagtatagttccactaaaaaacaaaaaataataatctcgtaatacaaaacagttatgtttatattttaattaagagaaaatatcttgtgtacccctgaaagttcacctaatcccttctgtacccctgaattttgctcaatcccttacatacccctgaattttagtttggatcccttccatgccctttccgctagttgaccgttagttgaccgttaaattcttatgaaaaagtccattttgcctttggtataaagaagcatatatataaattaatagagtatattgttgaagtatagaaatttgttatatgaaactattatgtttatgagatagttatgcaccatattatttgcgagaaatataattttagatatgacataaaaaattaatacttatttattagttattaaaatattttttagcatatgtattctgatagtaataaacaaatctgttgtattactatgaaaatacatatgctacgtaaaagaacttttaataactaataaataagtattaactttttatatcatatgtaaaagtaaatttgtcacaaataatatggtgcatcacatactcataaatataatagtctcatccaataaatttttacattccaacaatatacttaattaatttattatgttttttcatagcaaagggaaaaatggactttttcaaaagaatttaacggtcaactaacggtcaactagcggaaagggcatggaagggatccaaactaaaattcaggggtatgtaagggattgagcaaaattcatagaagggattaggtgaactttcatgggtacataggggattttctctttaattaacatgtactctctccgtaaaaaaaaatcatcccctcctaattaacaaatctggagattcattgtactaggagaggtgtctttttttcctgacggagggagtataagcgaaactgatgttcgaactagagacacatgtcagaggggtccagatcccctagagttgagtacaactccaccgggtgaattttactaaatctgtgacatctattgcttcctacggctgagatgaagccatctattcttcctatggtttgaatgggaattactttatttttttcatgttagtaatggttaagtttatgcctaccaaagtaacaaagtatacacgttatcttctttcccaaacacaagaagctacgttcatgtacagaaaaaaagtgttaattaaccacatggtacatgcaaacatacataaaccatatacatgcaaaaatagaggcacatgctcagtacggtctttataccatggatgaatcaaaaaatttgggttatgcaagtaaaatttatattctcagattctctaaatatatatattgtagtcggtgatttgttattgttacaagattatgaggacttatttttctttttcaaaaaagactagtgggaagtgggaactaatggcttcatcccaactgttgataaaaaaatagaccgtaaagattttatcaaattcacccgatggagttgtagtgaactccaggggatccggacaccatgtcagagccttcatatttttgaattttgtacagagcaacgatagtttgtttgtaacggttactgtatcaaatcgattttgagtctctagtgggccgtatcttttgtttgggctcgcacaactgggcctcctctctggagcccaaccgttcgttttccttggttagtgtaaatcatgggcacgtgtaattcattcgcacagagagagagagagagagagagagagagagttcatagctgccgggatggtcgccggcggcgactggagctcgccgcccgccgaacagccaaaatgttccccatttttccttcttcaggagccaatctgcttccaccatggcaacgcccttgaggtttccgtatgatttagctttcctactcctactttcgaggatcgccgggaaggtggaggagccgcgcgccctggtggtgcggtggcggtgtctacccctcgtcagcacgaggtgtttgtggaattgtccgtaagcgcgcggtctcttccccgcgaagcaaggatgtggatgttctttttggagaaaaaggatctggcccgccgccttttctgtgtgcatatgggacacgagcggaaggtgttcgtgcaaatgcggcagacagcacaggtaggcagttcttgctttggatgtggtgggatcggagtactggatttcacacaagtttgatgatgctgcacgattgcagtcaacaaggtcattttactagatctctgtcaacaatatgggaatacagagttctccctgtaactgaaatctagcggttaaagatgctgatgatcctaaaatcaagtcaaatgcggctgttgtatctactttctcaggtaacttcttccctcaaatgcatgaacatggaatctttcccatgaagttaacttaaaactatacgtgtctcccaaaaggcagcccctcccatggagatttaatatatacttataagtagttcaagcatgaactagcaggagtgcaagacattaattagtgggtgcattgttggcatcacctcaaagtgtcatttagcttaccactttttcaatcttcttattcctgctcctttttcttttatttttttttaaagacaaagacaatgggggcctggacctggatagtcttgaactcttgatggcaaggtttttcttttggtcctagttcatcaacacatcagtatatattttttcttgttgtgaacttgcgatgattgtgcgggcagttcagaccttcaagcagcctgtcatccatgtggcagataattggtgacctgctgagaagctgcaggcctgagaaatgaagcaacaaccagatatcagggaacaaactgaacaaacaaaattctttaacctgttccggtgggaaacaactaggattcatcatatcatatggcgttagttgagatatcaaggtcagagtgatcaaaattctatcaaataaattttattctacgtgtgttaacacatcacaagaagaaattggagctgctaattgatgtctgcatgtcgtttcagctggactggctccaaaactagttaattaaaataatccacaaggcaagttaattcacttaattcttcttctctctcgttttatacaagacctggaccttgatagtcttgatgccaggtctttgtttttttaggtcccccttcctcggatcaacacctcatctatataatgctgaaaccagcgttggctgaggtgagtggatcatcaaatatccttcatccttcctaagttgctgctgctagagtaaactgatcaaaggcttgtcaaagtaagttggagtggcaaaaagaagttgagctagctagaaattaaggcttgagttttcttttttgatccatatgtgatgatgtaatgtaatatgtagttatgcactgtcattcgtatacatataatacgtatctagctaggatatgatttacatgttctgtaatctgacaggaccttcttgttctgttcacacatgaatcatgatcgtggtatattggcatgcaggaaattaatcaggtatggttatagaggtgtgttgctgcctggggctggctgcgaatgtagcgcagctggctggcctggacgtcatcacgcttgtcaaggtaatcaagagtcgcgtcgagacagtccgccagaacaaggaggactgcgagctgctcgccgaacgcgcggacatgatccttgatctgctacggcgggttcaggcatccaaggtcatcgaggaccctgacatgtggaagcccacagaagggctcaagtcgacactttgcagggcaggtgcaatcgttaaatcctgtcaggaggagtggagctatgcgtaccgtttctgcaagggcggacgcatcgccagagagctgcgcaaggtactcaaggatctcaagttttacatcctccacctgataggaatgatcaccatcatcaaccacgatcaaaacactcgttactattatatcccggagactgatgttgttaagccgcaggtacgtacctgcatacctacaacatctcattaagagctaattctttttgctaattaatttctgtgcaaactgctaaaacctccatttcatgattctgaagtttgttctaacaatatgagaggtaatgtatgtaagtggacaaatgcctgcttaattactcacttgagcctaactttggtatttcaggatgctacagcttccaacgctggaaagcctgttgctctagaagaaacaggtaggagtaatagtgaatgatttataatattcccaaaattagcatgtaaaacaaggccttcttttccaattccctttgtaatgctgacacgaagtttgaaggtaataatcaattttccatgttacttaaaataacaggccttaaaaagttcactttgtctgagttggaggttgctacagataatttctctctggaaaaacaaatcggtataggtgctttcagcatcgtgtacaaggtaatgctttgctcttggccgacctttgcattcaacagaatggttaatgtttaggcagtgaagtcgtttgaaacatcttctcttgtactcagaaaaatattagattttgtttttttctgtaagtatcatgatcgatttgcatttggtgtttacttcttccagggccaactaaatgaaatgcccgaagttgctgtgaaaagagcatcgtatgttaacagaattccatttgaccagctcgaaaatgaggctaaaataatttcaaagcttcagcatacaaatatagttaaacttctaggatattgcagccaagagagagagaagatactggtcttcgagtatatgccaggcagaatcttagattcattcataactggtagggggttcaattcaactagctttatgcctttatctactcagtttcgagaccaaattctattgttcatgttcactcaatgatgcagtacatacatgtttgtcgcatttgattacaggtgagcgagcagaagagttgcctttggactggtctaagcgctcccaaatagttaaagggatagctgatggagctgtatatctacacaagcaatgtgagccacgtattattcatggcgatctgaaaccaggcaacatactcctggatgctgccttgaaacccaagatttgtgactttggtacatcgaaagcacttaggccaggtcaggatatggactgcaccggcattgtggtgggatcacggtaagactgagtttttcactgcaaaatgtttatccatccacctcctgcgtcacgtttgatctgttgataacttgatatttaaattttgttttcatcttctcagtggatatatggcccctgaatataaacagggagggtgtgtctctctcaagacagatgtgtacagctttggcgctacgcttctcgagatcattagaggaagtcgcatccctccgtctacattggagctttctgatgaatcgcgcgattttgggcctctaaataagtgggtaagtgcacacctctctgaacttcacaggccaaccacagtatactcagagttggtcactgattaaccagtagcaattttcctttgctcaggcgtgggaattgtggagaggaggaaacctgatggagttcatcgacccttcgctgcgcggagagactcattctgcagccgagatacaggggtgggttcagatagcgctgctgtgcgttcagcgtgttgaaattataagcacataatgatttaatttattccataaataaatcatgacattgcatatgtgaactagattgaacgcatcattagatctacacatgtaaactaagcagtaaaacatgaacagatcaaatatgcgcaacatgtcgaacgcgtaccgaggtggcggaaagaccggttgctcggcaggaactactcgcggttgcgagcgtcgacgaagtcgcgaagcacgcgagcggagaggaagacgagccggtgcaggatgtcgaaggcagaggttccggagacctgctctcccgatcgccggtgcacgggatggagtagtctacgagcgacggcgcagtacagagtaggaggcaaaccctagattgatgagccggtgcacgggatggagtagtctacgagcgacggcgcagtacagagtaggaggcaaactctagattgatttcgcgtgtgttgcgtgaaggcggcggctcggtttatatagagatatctgcgcaatgttgaggagccaattttgcggaccattcgacgcgtacgtcgtgcacgcgccgcctgccaggcgaggcgacgcgagcgagcgcgcacgtgtgtttcccctcttctctccaccacacatgcttcaagtggttaggagggcatcctcccttttaaggaggtccccctctcctagaataagcaaggtggtactaaactccacatgcatgccatcccatgaggtgggcttttgtgattttccaaagaattaatcttcgaatgggccttagcctatctattaattccaacaatcccccaccaaatctcaaaatcccaatgagatttgccttttctaatgtactgtttatataccagcggttcgatggagaccgattaaggttgaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcataggtctttagtaagcttcctaaagattcacccaaaatctccatagactgcgaccaacagtcaagcttacaaaggtgagtcctttcaagactactctgcaggaccacatcttcgctaattaaagccaacataactcattaaggcatagccaacctgccttgcagctcacgagagtacatgcatcttcacttagagagggtataaattggtactctcctctagtttactaatggtttgttcttcccaggttctaattcacgggatctccgatcacatagactgggttaccaccatggtataactcacatgggtctcaaacccatctccttcgatgcattatctatcacatttcgtgatagtcccttcgtgaagggatctgccaggtttctagctgtttggatgtaatccaacgttataacttcggagtttctcaatttcctgacagacttcaatcgtcttttcacatgtctagacgatttcatattatccttagaactattcactttgacaattaccgtttaattgtcacagttcataaggatagccggcaccgttttttcaacaataggcagatccattaatagatcacacagccattctgcctcaacagtagcagtatctagtgccgtcagttctgcttccatggttgaactcgtcaaaatggtctgtttgcaagacctccacgaaacagcaccaccacccaatgtgaagatatatccactagtggctttgatctcatccacattagagatccagttagaatcactataaccctccagtaccgcaggatacccaatatagtgaagccccaattccatagtacctttcagatagcgcattattcgctcaagcgcacgccagtgatcatctcccggattagaggtaaaccggctcaacttgctcacagcaaaggagatattaggcctagttgcactagccaggtacatcagcgagccaatgatttgggagtattccagttgattcctagcaattcttttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacagaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaagctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggttcacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaggacttagccgtcctttgtctcttactccttcgaggagcttcacagacatcctcctcagagacatgttcatgtgtatgttcaatttgttctggtggtgtgattgaactgggaattatttcagagggttggctcgaaccactatgtgtatccttcattgggaaaaagctctcaaagaaggtagcatcaagggactccataattgtaccaacatgcatgtcaggtacctcggatttaactattaaaaatctataggcaatgctgtgatgagcatatcccagaaagacacagtccacagtcttaggtccaagtttgcgcttctgcgttattggtacattgactttcgccaagcacccccatgtgcgcaaataagaaagtgatggttttctcccaatccatatctcatatggtgttttgtccttatttctgttaggaactctgtttaatacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactcttcaccacgatcagacctaagcctttttatctttctgtcaagttaattttcaacttctgccttataaattttaaaatagtctagagcctcgtctttcgttttcaacaagtacacatagcaatatctagtagcatcatcaatcaacgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaaaccaaaattaatatgacataaacgtgagtgccaaacattagcctcattatccacactgccacaaatatggttcacagacttattgcagaaatcagaaagggaaaagcggaacaggcctccgcactcataacctttaccaataaaatatccatgtttacacacgactactttattagactcaaaaaccaacttaaatccgtctctagtcagacgggagccactaacatgattcctgtcgatagaagggacatgctgcacgttcttcagctgcacgatctttcccgaagtaaacttcagatctaccgtgccaacaccatgaacagaagcatgtgacccattccccattaggacagtggaaccccgtgcgacctgataagaagaaaacaatgagatgtcagcacaaacatgtacattggcctcagtatcaacccaccaattagtagactgattaactgaaaaaacagtaggtaaattaccatacccgcttccatctctagtgttgccaatggtcacattagcaaacttagaagtctgccctgcaggtgccttcatccccttgcgctgtggacacttcctagccagatgaccaggttgcccacacacaaagcaagtcctctcatcctggttaggattgttgttgttcttctctgcctcttgaagttggtggtctgttgagctttgtatttccccttgctcttgttctgggccttgtgcacaacattggcactggactgcccaccatcgccctcagacgcggcgtctttttcccgagctttctcctcaacatcaagggacgctatcaacccctcaacggggaattcatgtctcttgtgtttaagtgcagtaccaaaacttctccatgatggaggtagtttcgcaataatgcacccggccataaatttatcgggtaagacacacttaaggagttcgagttacttagccatggtttgtatctcatgagcctgttcgactacaaaatggttgtcagccatcttgtagtcatgaaactgctacatgatatactacgaactgcattgtgtgttccctcagtgtactacgagtagcgaaataacgagacttttgcgaatgcctcttccttgatggatcttagcagtgtataaagtacagctacagtgtttcagcaatggattagctagttgtcaaaaactatgatgtattgcataactgtgttgactattgttgacttgtgtatcgagggatagtagtagtagtatcaaacgatactgtagcaattggcatagtgggctagtgggcattgatatctgctggcccattcggttgacgggtgacttatttgggctggaccaagaactaccgttgactttggttgggccacatcttcagaggtcaaccacaagtgacctgtggcacatgcatccgtggcattgcattgcatacttatcctacaaatgcagcatgccagcatcattaaccaaaacaacgcggttcaagcaagtggatttgggaaggcaatactgaaacacaatgatactaatgataattgaggatttgaggtggccaaatgaagtacttccctgatttattttttcgcggagcttttctagcggagactttgcggagcccattttttggctgaattgcaaatcatatgcgtttgagaggattaggtagtaggagatcacaaggtttcattttcacttttgtttgctactccactatttgtcagaaaaattatactactcctgtactatttttctcgtttgccgtgtcaccgcgtgagttgcgcggggtggagtgtggagtcgacttgactcccaagtccacttccctccataaagcgagctcggagcgcagccacagcagtgtagagcgcaagcacagcgacggcgagcaaccgcggtgaccggagaagcgtactacgtgtataccggcgtcggtcgatcgacggcaatcggccggattccggtgtgattggctcaccggcgatatgcacacgaagcgtccgctgccggcacaggcgccaccagctgggcttgtcctggtgcccgcgcccaagcgcccgcatgtggatgctgctgccggcggcggcggcggcgtggcgtcgccgcgggggaagcggcagcttcgctccggcatgctcgtcctcttcttcgtcgcgcaagtgtatggcctcgatccattcgcctttggcttgatttctttatgggcgccaatatggactccggtccaatgaaaagtatttcgaggtatcggttcctgaca

SEQ ID NO: 28639 - DNA, 11402 bp, Oryza sativa
gacttcgtcgagtggtgagcagagcagctctgcatctctccatccgtgatctgtctcaccaccacagcgtcgtcttgaatcgatctaaatcattttccccatcattttatactacgatctttttggtagctcattgcatagttatgtgtttgtctactgtagatacgtggagagaatgctatttcccagcaaagggcaatcgaaacatttgattgtgtctttcagaaagcatttgacaatgccttccagaagcatcttgatccaatttaccggtaagcaagattgatctctcactccctgcaacttggactgaagaattacatacttccattcatggactagtagagtggttaaatatgataacagattaacagttcacctgtcttcttgctcagataatatatctttccactcctttctaactttgttaaatccagaaaaccaaaaccaagagcacgcgcttgaaatttgatttaggatcctaatatagttatttttttatgatactccgttgtcttgtaactttttttttctagtaggtatgcaaatttcctgtttaattacactccttaaaaatttcatgcttaatactccttccggtaaaaaaaagcgtttaagacaagattaattcggtcaaacttttggagctttaaccatcatatttatattagaatatgtttaaaaaattcaataaattttatgatattacgatggtacttttcaagacgaatctatgcatactcttgaccatcattctcttgtttttaaaatgaacacttgagaagtagttaatggttacatttagaaatttgatcaaatcatgtcttaaatattaaatatttatgactagagggatacctctaaatcagacaaattgctccaaacatgggcaactactaatttgatcatttatagctcttctatgttgttatgttaacgttgagaagatgaaatattcatgttgttagaccatacatgagagaaatatgaactacgaaggtgctatgaaatatagtaaattgaatcaaacttattccattaatcttgaagtctccaattttgcgtgttcaccggtatcttatctttctatttgtaagagaatgatgaagttcgttatctatttaaactaacctttttttccacttctttggatttaaactaacccttttccttccacttctttggctgcagctcccttcaatcccttaacaagcgcactgatattctcagccatgaagtggttagatttcaaatgttccactgcttctttacagttcaacacttcaaacccttttctgataagggagtcccttttatcgagtttcattgcaagaagctacttggttgaatgcaactcaaactaaaaagttttatcctatttattttttctaaaaaaaacaaaaggtgtttgcctgacaaacttcaattcttagctcataatgattcttcacccaacgtgcaggaacaaatcaaacattcaaattctaaccatcatgctaatcagcaatacaggtatgatatttgaaattatcaaaaatatgcatagatgacttctattatttctagtaccaatgtttcactggttcttcatattgtttttcttttttcggcaaccagttcttatcaatcacttcaaatgacttgtgaactaccatgtatccatggtacactatctatttatggggcttgcctaaacaactttatgatgttcttttcatgctgttgtgagtctgtgacttgtgatgtactaaagttgtgatttttggaaaatcggaagtactgtcagatgttcaaatgacactagaattaatacacaggggtgtttcatactttttttaaaagagagaaaaagcttttcctcctatatgttgatagagaaggggtttcatactatttgtgtatgcattgtagatcaaaggcaaatcaagagtctgctgccatcactgaggaagtgaatcaagaacaaacagctgctagatttgtcgcgagtgaagctcaggaggggcaaagagttgagttgaggttcctcaataagttgaaccctcttgtttttacaaaggaaaaaattacagcggaggatggtacagctatcaaaattgccatagttagggataatcagataattacatctggtccactttcttctgcaagaattgaaattttggctctccatggtaacttttatgatgttgtccctgataattggaccgaatctgagtttgatcaccgcatagtaagtagttcacaaggtcccgcgttaggaggggtttgtcaagtcaagctgaagaatggggaggcctctccttctgatgtatttttcaatataccatcttcgaagactgaaagtggaaggctcattctagcagcaaaagttcatacaagtgacattggtgggcttcgaattaaggaagctgtgatgatgaatcctgttgtggtgcaggtttaccgaaacaaacgtaagttttccttcagaattgcaagctggttattctgtagtttgcatcattttttttggtcgggttagctgaaaaatcgaccaaccaaattgtattaagaagagagaaatgtgccagctacaaaacaacattatactgtcacagggcataagcccccctcccccctcccccccaaaaaaaaataaaaagagggaaaaaatacatatagtttgcatcatgtatttattatgtaagttttgtagtgtacattcatttttgatgtagaggccggtttaatctattattattatgtaagtattctccacatggcctgttaatacctcctagtgaccgtacaaaatctattctttcattggatttactttgaaattacatattgcataatcttcacgatatgatctattgtcatttactttgtttgcttttccccagtaaatagaagtagtgaccgtccgaagctaaaagatgaagtacatcgtttaaagggaatttcaggaaagggatgccgcaccaaatggcttaaagataatcaaatcaacactgtggaagagttcgtaaaggctttaaataaggatgaagaaaagatccgcaatgtaaggcctctgggattccaattctctctcatatgtgcacgaattaaatccatacagaaattctgtgtttatgttaattagagcctattattcatttcttcgtatatcagagcaaatttacctttcaatgccatgaaacagtacaagcataagtaaaagggtgtagctatatttatggcgccatatttttcatcaaaaaatagtcggcatgtatttacattgtaagtctctaaattacatatgtaattttagtgtatttacaatgtaagtctcaaaattacatatgtaagtactaaaattacatatgtaaattcgaaaattacatactaattacatatgtaagtggggtgtaaatgaggtgtaactactgtgtaagtggctgaaaaaaaatcgactgtagcatatggcgccatatttctagcaactccgtaagtaaaatattatttttgacaaacgaactataacatacgcattccttggagttcaggagtgtttcaagctaaagaaggataataagctttggaaagatacaattaaacatgctaaagagtgtgatcttgaagggaattgcaagctgaaattatatagagctgaagagcagcatgttgtactcttctttaactgcgtgcatgacctcgttggtgcgaaatttcgtgatcactatgttgcaaaggacaatttcagttcagatcaacaggtatgcgttgatattggcattcttctacagatgcaaacctttgatgagaacttagaagattacacttcttttttgttttctcaggatgcagtgaatcgtttgaagaaacaagcatatgatgagctggatagcattggctttgatcacgaaatgaaaaataactatccggtgatgacgctcagtgatgatgcttacattcccttcattgacacagcacaaaatcctccagatttgcatgttacatttcaaggtaagacattggttttgttctcttgtctttcatcagactcaactactgacgatttgtttatttggatttgacagttcagggtattgcaggagctgagatttatcatgcacatgaactgcctcaagcatttcctaacaacaataatgattttggacaacactttttacatggctttcaaggttggttctgcttttttttttctgcttctgctggttttgttttgaggaatacttttgtgttggaactaaagtaatcaagcaggtgctctgactcagatggaccatgactatgcgcaatttggcattgctgatatgcagtgttatactacacaggcacctgaagtaagtggagtttctttttttttggctcagtttgtaagaacacggatgaacttataagcccctgttaaaatttgaattttaaaacctatttttttacctctttcatcatagtttttctaccattagcttttaaatcggtaagaatacatatgtaaaagttttacccacaattttttttgttattattttttagataatggaataaaatctaggtctttgctcaaagagctacagccaattattactccaattcaagcaaacacaaacgcacctcaacaattcataaaaacactggtctaataaaacaagagcacacacaaactactaaatgcaacacaagaaagaatcacaagactatgaattctatttgtgaatctctatccgaagttagtgaaaaactgcataaccgttgactcaagattgtgacatgcagctttaacaacagttaacaaattgtatgtacgccatgaaaacaagactgcctctgattgttcagatcatagtatcgagtatctttgtgttgttccacactccttgaatgctaacgggtcattctttcttcagggtacctcttatggaggcaacaacatgatcggaccagcaaatgtaccgcagaatgttattggtgacggctctatggacatgtttgactgttatgcatacatctttccggacaatgagaaccagaatgagaggcctcatagctctgcatatccaggaccagtttaactgaaggctttgttgccagctagtaatctatcatgatttctgattaatttcattctttatttagataatggatattttattgttttattcttgatggatgtattactttcaagaaatattcttgctgtatgtattagcatttgttgatgcagaaaattgaactgtactagtacttatgtttcagaaaaaaaaacatcgactgttatgttacataattcaactgttgtatcacactacggtttcagaactccttctagtactattatttactagttagcgtgcatgttcacggcatcgcaacatatccaatggagtacataatcttatattgttgtttatagtaacaatggaaagaagcactaccaattcacgaaaaaaaaattgaaactcaacttctgcaatgtcgtaaacactaccaattgtgttgaaaggtaacaatgaaaattaacaatgtggtaaacatcttcttctgaccgttggatttgcttcatgttttatctgaccgttcgattctttttttttctggctgttagatgtgcttctagatatgtccgtgtcctaaaagggcatgtagcctactgcttgcagaagtgacctgagtagcaccccaaggtcctgagttcaaatcttcataggagcgaattttagattgggttatttgagggctaagttccctgtttgataagttaagttcctaatttaaaatggctgtacatatccgattgaatattgagtctgggaaaaaaaatacccttctctgcaaaaaagatatgtccacgttgttgggcctggtggtattcatgtttggtaacggatttgctcctctagcacgttaactttgtgtgggctactgggcttctttctctcgtcgtagctgaacccgaagcaccgcttgtccgcttcacctcctcgatcgcgtcggtgagactcggcgagcgttccagccggccgccgccgccgccgccaggctttggcctcgggtctcctactaccaaccagccatggcgcaggtctttcgggcgcggcggcgaggcggaggcggcagggaggagccgatcgccctggtggtgcggtgacggtgtctacccctcgtcagcacgaggcgttcgtggaattgtccgtaagcgcgcggtctcttccccgcgaagcaaggatgtggatgttctttttgcagaaaaaggatctggcccatcgccttttccgtgtgcatatgggacacgagcagaaggtgttcgtgcaaatgcggcagacagcacaggcagacagttcttgttttggatgtgttgggatcagagtactggcgttttacaagtttgctgatgccgcacgattgcagtcaacaaggtcatttcactggatttttgtctcaacaatatcgggatactgagttctccttatcaccgaaattttagcagttcaagatgctgagcctaaggccatccacaatcggtgtccctgggtcgtccccccgctcacaccgtccgccgtccgtccgcgcagcgtgtctctggagggaggcgcgacccccacgcggggaacccctctagctccccagctcgctttttccagagacactcccttgaagctacgtgttgcggcgacccggtgccccatccctaccttctctcctggtgtttccccttcttgcccctcaccggcggcatggcgacgagagagagagaagagagagaggcgacggcgacgaggatccacgacggtgacgaccagatccggccaccagctggcgacgggctcggcttccgcgacggagacgacgacgaggactggcgatgaccaccagccggcgacgggctcggctttcgcgtctgccacctcgacgccaccacgccagctcaccatatctgcccgcctcgcagccggatctgcctcctccagctgccgccgacactggaaccgacgctggaaccacttcggtgacgacggcgggacgcggctggcggagggaggaggaaggcagctgctagagggggtgaggagggaggcgccgcggcggctggggagggcgagggggaaggccgcggcggcgggaaccgccggcgacacgcctcgcgctcgacacgaccggcgtcgcctttgtggaggagccaaggcggcgaaagaaagagtgagggggcaggaccgcgggagagagagagattagggggtagtttagtaaaaataaatatggggttttgtgggctgggatactcattgtgggttggagtgtctctattaagttgctttagattttgaggagcccatccaagggtatcctccattgcgagctgagtttccctagagtgcctcagttagtgagaacactctaggagtggctcacattgtggatgccctaaaagtgaatcagaagcggctgttgtagtactctttgatgaggtaactccttccctcaaatgcatgaacatggaatcttgtccatgaagttaaagctacgtgtctcccgaaaggcagcccctctcacggagatttgctatataggagtactatgcagaagcatcacgttttaagcacttaaatagttgaagtatgagctaggaggagtggaagacattaattagtgggcgcattgttggcatcagttaaaaattggatttagctactttcttacttcattttcaatcttcttgtttctgctactttttctttctttttgaaaagtaagatatcgtttaaaaaaaaaagtaagaaaaagacaatgggggcctggacctgaatagtcttgatggcaagattttattggtttcttattcatcaccacctcatatatataattgtcttgtcgcgaatcgtgatgattgagcaggtagtttggatggattggctccaaaactatttaaaagaatccaccagttaattcactcaagtgctctctgttttacaacaagacctggaccttgatagtcttgatgcccaggtgtttgtattttaggcccttcctctttcacctcatatatataatgctgcaaccggagtaggctggggtaaggtgcatcatcagatatctcctcatccttgctgaattcctgactgcgcaagctgatttgaaggtctgtcaaagtaagctagagttgggggaaaagtgaaattaagaagctagctatctcctgctaattatttaatggcatgcatgcttgagttttctttctgatccatatgatcatttagtatatattgtgctgcatatatgtacatgttcttgtttagaaaggatttacaagttctgttctgacatgcaccttcctctgtctacacatgtcatggcatgcagggaatcaatcagatatgattatagaggtgtgttgctgcctggggtttgctgcgaatgtagcgcagctggctggcctggacgtggccagtctggtaaaggaaatcaaggagcgtgtccagacagtgagccagaacaaggaggactgtgagctgctcgccgaacgtgcggaattgatccttgatctgctcggtcggttgcagaaatccaaggtcatagaggaccctgacatgtggaaaccaacagagaggctcaggtcaactcttcgtagggcatgcgaggtcatcgaattctgtcgggagaggagctgcacgtaccgcttctgcaagagcgaccataccgccaaagagttgcgcaaggtgctcaaggctctgaaattttgtgttacccatcatcaatggtgatcaaaccacacgttactttctggtccagcagactccagatgttgttcagctgcaggtacatccatgctacactgttacttcaagtctacaacagctaagatcgagcttcatttgctaaattacagtgtactgtgcaacacaaatcttttgtgcattccctaaaaatacactctaacgtgcaactgccaaatgcctaaaataggataattcaaacaatctatccgttttgtgattctgaagtttgttccaacaatatgagaggaagtgtatgtgttctgataaatgcctgcttaatcggttgagcctaacttaagttgttatttcaggatggcgtacaagtacctgctctagggttgcctgctcaacacttcaaatataatgaccggtgagatactgatcacagtatgtatgtgtatctaatggcttgatattaggttatggatgtacatttttgaaaaaatctcaaaagttaattatgctattatatttgaattttattttttttttagttttttttccccccaatgcatgcagcaatgataggggagaaacactgggtatttcagggaaagctcaactggtaacagagccttcctctgttaacgagccaggtacttcatttttatgggccaatctacatatcatggataagtacctgtaggtgcttttcttgatttctataattttcatttgccctttttttgtcatgatcctaaaattatcctccatgggaaaaaacgaagaaataaacctcggtttctggtaatcctatttcatatgaattcatatatttctgcaaaatttcccagcaagggttattttcacaaacgaaaacaggctaaatgaacaaaaaactttcttttcttgagtgctattctatgttcttaaaatattgatgcatttagcacagtaaacttgaatcaccgttttctacagtcctacataatattgttgaagaaacatcagcagaaaagaagttatcaagatgctgttggtggcatccctggaagagcattgctacctcttccaatagtggcatgcttgttgcccaaaaagaaataggtaatgatgaatgatcaataatccaaaacttagtagtgtaaaatcatgactgcgtttccaattcggcaattccatttgtaatgccaagggaagtttccaaatactaaatgatacatgtttgtctaaatgacaggccttaaaaggttcgctttctctcaattggaggttgctacagacaacttctctctggaaaaccaaatcggtgtaggtgctttcagcattgtttaccaggtaaggatttgcatatgctttgctctttgctggcttctgcattcagcaaaatgatttagcgaagttgtttgaaacatcttctcttgtactaagatattagattctctttctatgatgaattttaccattattgacttgtatttggcgtttactcctaggggcgactaaatgaaggacttgaagttgccgtgaaaagagcatcatatgttgacaaaattccatttcaccagcttgagaatgagcttgatctaatcccaaagctccagcatacaaatatagttaaacttctaggatattgcacgagaaagagggagaggatactggtcttcgaatatatgcctaacagaagcttggattcattcataactggtagggttcagttcaattagcactatcaatctcagttttgagaccaaattatcctgttgatattgatgtactaccctcctattcatattcacttatatccatatttgcttctcgcatttacaggtgaacgagcaacaaaagaaccattggattggcctaagcgctcccaaatagttagagggatagctcagggagctgtatatctacacaagctatgcgaaccacgtattattcacggggatttgaaaccaggcaacatactcctggatgcttctctgaaaccgaagatttgtgacttcggcatttcaaaagcacttaaggcagatgcggataaagactgcactggcgtcgtggtgggctcacggtaaggcggttttgtacagcacaatcttcaatggttatactttggagtggttttacagtcctcgagtaggtgccataggttttagtgttaatttgtggtccttctttgtacattaatactgaggtgttaccaaaaggcaaaattcactagaaaaaaatgtagtacatcgtctaggaccttaaaatactctaatatttaaccccgtttgatctgcttttagttgtgattgattaatttttcatctttttcagtgggtttatggcccctgaatataaacagggaggctgtctctctctccagacagatgtgtatagctttggcgctacgcttcttcagatcattagaggaaaacacatctctccatcttcactggcgctttctgatgaatctcacaactacgggcctctaaataagtgggtacgtgaacctttccgagtgctactcctgaagaggacttgaagggtatgcaagcctgacacattattcagagttgatcactgattaaccagtagcattttttctactcaggcgtggaacttgtggaaagacggaaacctgatggaattgatcgatccgtcgctggccgatgagaatcatgcttctgagataaagagatgggttca

SEQ ID NO: 28640 - DNA, 15378 bp, Oryza sativa
catcaagtgtacctaaataacgagactgctgcagaagtatttgcgatttgtcaaaactgcgatttctgcagagctgtgttgactactgtttgacttattgagttacatcagacggtactgtagcagttggcataatgggccttgatatgtacagcccattcaagaactcccgttgacctttgttgggccacactttcaggtcaagcaccacaaatcaaccgagacctgctgcacctgcattttttaaaataataaaaataaatcccagactttactctaaaaaaaatacaaccacttattacaaaattctctcaaagttagcaaaacaattcggccacatcaaagcaaaaccaacacatgagtgaacaattattgaagtctacctcctgcacggctgcacctgcatgctttggcaaacaaatagtactatataaatatttctgatgcataggcaccttcatgaactctggcactgtaaagtagtgtttaaatcaaatgcagcctggatttatactggggtccaaatccacgcggtttcagccagttgatttctgtccgttgaatttgggaggtgatgccaagacattttaattgaacttggcaaatgcaagaagcaagagggaattctagcaaccaaccggcgaggagaacaggccgggactattgcctgaattttccggagcttttctggcatacgactttgtggagcccgtttaattttgggggaaatctactgcaaaccatgcgtttccaaaggatatgtggttacgtacgaaggttctcgtttttcacttttatttgctgtttgctctcttgtcattcagtcaccaaaacttgcatataataatgtatatggctgcgttcggatggacaggtgataatgcgcatgtacctttaattatatttgtacagtttctaatctatcaaagtgcaattatttaatttcaagttcaaagttagctgtttcatcctaaagaacaaagagataaatagccaaaatgagattttgggggacggatgtattaaattgtaaaatattgatctagtaattgaacgaaggaatagatgttactgggggatgtcaatttacaacctagatacacatgcactcatctcttgcatatcatttgcatgaatcatgcatgatcatgaaattttatgaaaaatgtgactttatatgtaaagttatgtgatattaactttaatttacataatttaaaacaaaatttggctggaaattagtgtaaacacccttttatgaccagatttgtctctgtgtttcttttcttgatgctgtgtagattgattctggacttgaaattttgcaagatttgaattcctttcatagtttgtgacatttcatattataagttattttgacttattttctagttaagttattttaggtttggccaaatcttatatacaaatatagtaaaatattcaaactaaaaaataatgactaggaaaaaaaagtaaaaacgacttacaatacgtggagagagtatttaggaagtgagaaacaattgagtgtgcgttaattcacttgagcaagtttaatagtatagctaattacttgctctaaatcatttatagtcaattcatacatcagatatctataaacatatactacactattaatacatgttcctcacctgccatacacacattatatcttgaagtccgtgctacagctggctacaaatatatagcccgttgcttctctatctcctattttatctactggacatatgtatatgtttatagctagctatagcttgttattgtatctgcttgctcttgtaataatccaaatccaaatccatgcatgttccagtttatttttctcactaaccgcgtgagcaagacttcgtgctcggccgagtccactccactcgccgctcgacgacacgaccaccataaaagctcgtcgtcgaagtggagtggaggggccggggcggcacagcgagcgctcgacgacgaccggagaagcgacgacgaagctacctaccgtcgtcggggaggagtaacgagagctctgcggcatcggcgacaatccatccatccatccatccatcccggtttcaggtggcgcgcgcggccggcgagcgacgagccgacggcatgaacccgaaacgtgcgccgccgccggcaccggcgcacggcgcgccgccgccgaagcgcctgcagatcgacgcgttccggagcggcgccgaggcgttcgcgcaacaggcgccgacgtcgtctccggtgaagcggcagctccggcggggcatgctcgtgctcttcttcgtgtccgccgcgcaagtgtacgcacgccggctcgcacgcctcctgtttgatttaattcctccgtgggaagctcgttgtctgatcacccgcgtgctttgcggatgcgcaggaaggaagagcggaggaacaagaacaagaacaacgcgcgccctgctcgagtggcggtgagcagctctgcatcgatctctcgttctggaactgaatcaaactaaatcttttctcccatcatttttgctactcttttggtagttcatttcagtgtcctgtgattaattgtgtagatacatgaagagagttctacttcacagagaaaggcacccgaggatgatgcctttcagagaggcattatgaaagcatttgataatgcccttcagaaacatcttaatcctatctattggtaagatctctcagtcggggtgaaagtagaattggagttgaagaagttataaaatcgatccttgaactagcagagtggtcaaataggagtaggaccacaaatttacctctctagctagttgcttagataaatccttttttttttttgttgagattgctcatttgcagtttttttagtaagcatcgaacgtgtaaattccctgtttaatacctctaaaatacttgtttggacaactaatgatttcatcatttacagttcctctatgatgtttttatgttaactgtcaagctgatcaaactttaatgctgatataacacatgcaacaaatctgatctatgcagatgctacgaaattaaatcacacttattgcattgatcttaaattgtccagttttatgtattaatcaatatcttatatctttctctatgtcctagaaatatgattttttaataaaaaataaactagccttttttcttccacttctttgattgcagctctcttcaacaccttaccaagcagactgggactctttctgagcgaattgatactgtcagccatgaagtggttagatttcggatactttattacaaggacactactttatactagtttaattaacccctttctgatgagagagcttcttttattgtgttttatcaggaagttacttggtcgagtaaaattaaaactgcaaagtgtttgcttacattttattatgatgaaaaaaaaatgtttgcctgagacaaacttgcagggacaaataaaaaagttaatttctaaccgtgatgctaatgagcgctacaggtatggtctttgtaactattgagaatatgcatctctgacttctgttatttccagtatgcaatcttacatatcaatgtctcacacacacttaggttcttcctattgtgctgatcagttcttatcaatcacttgaagtgacttctgaattactgtcaactgtgtattgatggcactatatatttatagtgatgttcgtttcatgatgttgtgtattacagttgtgaatttcagacaatttaaagtactgccagatgttagtatgagactatagttaatacacaatggtgtttcatactatttatgtctgtattgtagatcagaggtaaatcaagagaatgctgctgtcactgaggaagtgaatcaagaacaaacagctctcagatttgccgcaaatgaagttcacgaggatcaaggagttgagttgaggttcctcaataagctgaaagaccatcttgtttatacaaatgacaaaattacagcagaggatggtacagctatcaaaattgccatatttagggataataagatagttactgccggccaactttcttcagcaagaattgaaattttttttttgaacgactcgcacgagacggtgcgaagttctattgatagagcaggaaaaaattacaaggttacaaccctggagagtcgtaaccaggaaaaaggaaaaaataaaccaccacccacacggcgacaacgccatcacacaagcccaggagaaggctaacactggaccggccgccgctaagcgtgaccgaccgccactaggccaacaaagggacacagacaaggtcaccagaggggtgagacagcacgacaacgctctcaggaggggggataaccatcgttgtcggtccgaccaaggccggactgggttttcacccgccgctcgccacttgcgaaaccacgcctgacgcaccgatgctccaccaccacacaagctttgccgacatgtgggacccctgcaccggcgtcccccgccggccagtcttcgagcgctgaagaccgcgccacacccaccggcagctcctcctcacccctaggtcgcctcctccaccgccggccgcgccactctgcgccaagccggcctcctccaccggacgcgcctcgcgccaatccggtctccctccatcggccgcacctcccgcgccaagccggcctccatctccgccgcccgcgcctctcgcgccgagccggcctccgctgtcatcggctgcgcttctctgcgccaagccggtctccgacccctccaccaaacgatgccgcgccggccagatgtagtcgcctcccacgccctcagctagccgtttgaggccgccatgcctccagtgactgtagacacggtcaccaccactgcagccgctgctgcctaacgcccagctacctcgccgtcgccatcctcgcctcgccgctgatgtcaccaccgcctccacaaacagccgccgtcgccgctgccaccgactccagcccccgcatccgcaacctgccgctgtgccgtcacccttcaccagcatacggctggctgccgcccgatgccatgtgtgccactgccgccatcgccagccgacaccgcagctgccaactaccgcgaccgccgtcgccgtcgccaactgccgctgctgccgtcgccgcaccgccgccgcaccgccgccgtcgtcgccgcacagccgccgccaactgccgccggccaccctccagatccggccgagaggcgcggatctgggggacaccgccgccgccgccgccgaggagcaccgcgccgtcgccaccacaagctcacacgggaccaccaccaccatcttcgtgcccgcggccggttccttccccgctaccatcgccatccccgccgccgcccggcgccgcgcgcccctgccttcgccgtcgccatccccgccgccgtggccgccgtcctccccgccgccagtcgccgccccgccagatccggccggagcggcctggatctggcggtcaccgccgtcccgcctggcggctcccctgcccgcccggtgaaaggtcggcgaggggccccgccgccgccgtccttgcggccggccggctttgccggcggccgctcgagcggcggcgaggcggaggggaaggaggggagggagaggggcggccgggtcgtcgcctcccgtgccgccccaggggaggacgacgcgagagtcttagtggattaagaattgaaattttggttcttcatgataagttttatgatgctgcccctgataactggactgcatgtgagtttgacgcccacatagtaagtagttcaaaaggggcggtgttaggaggtgttcttcgagtgaagcttaagaatggggaggcctccctatctgacgtctctttcaatatgccatcttcgaagactggaagtaaaaagctcattctggcagcaagggttcttagcagtgacaaagctgggcttcagattaaggaagccgtgatgaatcagcctgttgaggtgcaggttaatcgaaacaaatgtaagtttttcttcagaattgcagctggtgtattcagtagattgtttgcctgatgtttctattttgcaagtattctccacattgtttctcggtacctcccaagtgccaatgactatataaaaagtcttccttcgtaggattatctttgaaattacaggttgcatactcgaatcaactggatttgtatgttctgttggcatttatctctcttgtttcctttttgtccagcaaacaaaaagagtaactgtccaaagctgaaagatgaagtgcatcgtttaaagggaatttcagggaagggagagcgtgctaaatggcttaaaaataatggagtaaagtccatcaccggtccctgaacttgtaccgctgtatcatcccggtccctaaactcgcaaattgatcgttcagatcctcaaacttgttcgactgtgtcatcccggtccctaaacttgcatatcactcgtttaggtcctccaacttatttagttgtgtcaccccggtccctaaacttggatttgaatatcatctgggtcaaataggacggtctaaagactttatatttaaaaataattcataactttttcatgtgaactctaatgaagacaaaccttatatcaaacttgtagccctcgacgcgatctacaactttttagttgaattttttttattctaagtcattttttgtcccaaaatgtaattttaaaattaaaatttcaaaatctataaacatgcaacaatattttgggaccctgaacagttttaattcaaaaacttttcaactacaaagttataggtcgtgtcgagggctacaattttgatataaagtttgtcttcattagagttcgcatgacaaagttataaattattttttgatataaagtttttagaccgtcctgtttagggaccgggtgacacaattgaacaagttggaggacctaaacgagtgatctgcaagtttagggactgggatggcacagtcgaacaaatttgaggacctgaacggtcgatttgcgagtttagggaccgtgatgacacaacagtacaagtttagggaccggtgatggactttactcaaaataatggcatccataccgtggcagacttcaaaaaggctttaaacaaggatgaagaaaagatctgcactgtaaagctcctggactcccaactaatctctctctctctctctcttacatgcaatgtactccctccgtccaaaaaaagacaaaccctggtttccgtgcctaacatttgaccgtccgtcttatttgaaaaatttatgaaaaaaattaaaaagacaagtcacgcataaaatattaatcatgttttatcatctaacaacaatgaaaatacgaattataaaaaaatttcatataagacggacagtcaaagttggacacggaaacccagggtttgcctttttttgggacggagggagtaggccctttcattaatatgtaggacccccaaaatattaggtgcctctttggtatgttgcccttgcatgcaacgttaatttttttaatgataatttttgcatttaatttgggatgtgaaatattaatgaaaggagcacatagtttttttattcaatataataaatcatgaataatcaacagttaggatgactagtatacctcttacctctatagtagtagtgcaaaatttgctacaggactgaaaatttgcagcatttgctgtgagacacccaaagaacatgtatctttttgtggacaccgttaaaatgtggtaattagctgttggacactgctcgtattattttattatatcaggtcaagatggagagagaaaggacattgaaagtaccattttgcccctcggctcgtttggcttgtaaaggcgagtgccaccatctctctgcttgattcttccttcgctgcccgaatagccgcttgattccgccaccacaccccactgctcgaatccgccgccctgctctgccttaatccgaaagcgtcgctataatccgccgtcagcatagcttgcttgtcacaccccaatctggcaccgccgtacaacggcacctgacaggagcgtgtcgtgggaaaaacggcgcgaaccgcttcctacgaaaccgcgatctcagtaccagtcccaggacatagcgctggtacccacggtgacaaatatgaatcattgcaatccttaaaataaatagaggacttatttaccttaacttaggttgcagctcagaacagcccgagattgcaaccgacgacgtggacgaggaaacaccaacaacagcagcagcagcagaaccaacggactaacacccaacaccacaggtgacggctgggaacctggacgaaaccctaatcttcactttacttcatcttcaacttccgggcggaggaactacatatatttatatagagcaagggtgagtactttcatactcagcaagtcacgggaatttaggtgtttaatgcaagcttggaagagaggcaaggttgtttttgcaaatcttttgttttgaaatcattttgaaatcacaaagtgatttatttctttctaagtttgggtcgaaaagagacttgcgtctcgattcgaccttaagagatgtttttcaacagctcatttggtaatgtaccgacctcccgggtcagatcattacttctcggctcctagagccattccacttgattaatcggctcccagagccttttacattttctcggactcacagagtctagctgcccagcagcacaacaatccgcttccactcgggaagcctagtctatgatgccggtagacatcccgaatcacacagattcatttcttgaccactcaggtcatccatctgccacataggctgattctggtaacaattcccacaccacaacaacttttcacaaagcacaggcaaacaaatctacgctacaggaaacacctcacatccgcccatgaccgcgggcacggctgttcgaacagttagttaacctctgcagagggggtacactttacccacacgacattactaacccggatcacccagcccgtgagattagccacgtcgggagaccctaaggctttcataacaaggcatttcgaaagccgacacaggtttaccatatgccaacgagaggggtcccagaccaacaccaggttaggtcccagaccataccgtgccaggaagcccgagggttctccctgacaccaccccgttgaatccacatgtctcttggcatcatggctcccccgattagctaattactcagccaggggcgtcccattgcacccgtgtggtcgcacttattatatgctcagatgaatttcccacaggaatcggtccttatatgcgaatacaggacagtaccacataggcacaacccccgcatcgcgagttttttcaaacacaccgacgccacatgtcgggttttcaaggcttctcaaacccatttcccaaattatcgacaaacaacggtgtatgtggaatagttggtataagtgctcagagagcacggataccgaagtaccacaagggtggagcgacaaggaatcagggtaatacgacctacaggaattagtgcgactactgggtaggtccgtcggtttggcacgcaaaccgaggccaagcatgttaagtgtgtgattctaataatgtgagctgcaatcaaaataataatgattttccaattataggagcaattggtcaaagggtgacttgcctcgctcaaggtcttcacagagcttcacgaatcttcgagaaaacccgcgatcgacgaaaatccgataaccgcaactttacgcaaacaaacaaaaacctaaagaaaagaccaagaaaaagaccctatttagactaaataatagtgccattaaatagatctcaattttacggaattactggaagttgaacgaagtcaatcgggtgagcggttgagaagatatggattttctaaggattatttgattttctgtctaaaggaaaaggaattattaattcccttggaaaagaaaaggaaggagggatcggatttagacttcctcgggcgacttaggcgcagcccgagggattcacaaggcttggccggccattgggccgagcgcggccacggggaggcggcccattagggggcgcggggagagagggaggcccaacggggtgggcgcggtccgccgcgcggggtcccgagatgggcccgcatggcagcggtcgggtgtatggtggggagggcgcacgcggggacgggcgagacggatcggtggattgggtgcggatgcggtgcgccggtcgacaaggaggcggtgggcccacgtgcagcctcatggctcaccggggtccgcacgcacggggatgaaggggcgagggcgagcggctgaccggcttgactgggtcaagccgacgtggcacctatgccaggccacgtgggcggcgagaggaggaagaaggggggatgccgagatggacggcggacggtggccgagttcaccggagtttgatgcagaggtctagggccaaggggagcacaccggaacgatggctaggataagagggagtgagcctccggctcggattcgccgggggggattcgatggcgacggatttcgacggtggcggccggcggcgatcaaaaggggaaatcgcggcggggcgacgagaggtcgattcaaggaggagggagcatctccggggcgcggggaactcatttccggcaccggatggggcggaggactgccgaggagggctgacgacggcggcggcctccgggagcgggcggcaacggcggcaagcctatggcgggcggcggcgagacctggggcggcgtccatgcgtgttcggggggctagccgagctaccacgcgagctagggagggagagggcgagcgagaagggagaacggagggtggcactaccaagccgggacgggcgcagtgacgagcggccgacggctcgggagcgagctctccggcctcgggccggggaaggggaagaagagggatggccggagtcctcgtctcgcgtccacgcatgcaccggcctctgatgcgtgcgacggcgaagagacgaaggcaagaggtgggagtggcggcaaggcgtcaacaatggcgcggtgagtgtgaggcgagcgaaaacgagagaggaaggggtttgggggcggcttgggttttatagtggaggcgatgtcggtttggggagggagggaaaccgaccttggtggcggtcaaggagagcgagctggcggtgagctggtgcagtcgcacgaccagcgtccgcgctttggccgcgagcggctgggaccatggatgatgtcacaccccgaagttttcctcccaggccaaaattgtaatttacaaatgaccccaagaaaatgcaggtgaaatcaggagaaaaccctaagaaagtaatgcaaataataatcggacttgacatgtggaatttttcttgagttctacatgtcaaaattcattaacaggatttttagtggaattttcagagctctagaaataattttaaccaattaaaattgagcaagcaatattttattccagggaaaatcctttttcctttttctttttctttttcctctctttttcctcctttttgtcaaatgggccgtcggcccatttctcctttcctccccccccctctccgctgggccggccgcaggccgaggcccagcccggcagccaggccgccccgctgcctcctctctcggggtcgccgacaggtggggctgtcacaccctgaaaattcaaaatatataaattgttgtttaaatggaatttttagaaataattttaaaagtcttgaaaagaaaatctaagtttaattaataaattccaatataaaatggggccagataaaatttcattaaatactttgcttaattctataattcctagatttttctgggatttatttgagctaagaaagtatttgtaataaatggaattgcatttaagaaataattttaattgaaaaaggttttaaaaagtcttcttttggctttgggccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcggcgccgccgagccgccgccgctgtttccttccaatccggccgttcctttccttctccggccgatttgttagaggggaaacaatctccgggatctcctctaccttttctcctttggaatctttggctcaatcggtttggaatgagtttgattcgagttcgaatcggatcggctttcctctctccaagccgcgagtttccttcgccgttgccgtcgccgtgggccttcgccgccgcctccgagcccctttaaaaggacccccggagtcttctcttctcgccgccaccctcgccttcgcttctcgtcgccggaagagctctagcgccgtgtgccctagctttgccgtcgccgccgccgctccagccgtgtgccgccgtcgtttcagccgtcgccgtcgctcgggaaggacgtcatcgtggtcgccaagtcgtcgccgtcctcgtccgccgcttcgccatcgtcggagaccgccggagcatcatcgccgtcgtcaagccgaagaactccgccgtttcctcctcgtcgccggcgccgtccgttgcttctccgccgtcgttttggtcgtcggtgagttcgccgtgccgcccgcttcgtcccggtgccttccgtttgcgttctcgcgccgccgttcgccggcgagcgtgcgccgtccgctccgccgagccgccgccgctgtcggtgacgtcattgctgacgtcatcggggtcgtccgccgtgagccgctgtggacccgatcgatctcggccgtccatcttggatcggttagatctcggccgtccgttcgcgtgaaccgccgcccgtgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgggaaaggctaatgttgtagcagacgctcttagcagaaaaggctattgcaatgctacaaaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatatttaagagatcaagaagaatatgagaagaggaaaagctattggtttcttggaggatgagcaaggaactgtatggttgggtgaaagaatttgtgtccctgacaacaaagatttgaaagatgcaattctgaaagaagctcatgatactttatactccattcaccctggtagtactaagatgtaccaggatctcaaggaaagattttggtgggcaagtatgaagcgtgaaatcgcagaatatgtagcagtatgtgatgtttgtcagcgagtcaaggcagaacatcagaaacccgccggtttgttgcagcctttgaagattcctgaatggaaatgggaagaaataggtatggattttatcactggtttacccagaacgtcatcaggccatgattctatttgggtgatagtcgacagacttaccaaagtggctcattttattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctctagatttcggtggaagttgggataagaatctaccttatgcagaattttcatacaacaacagttatcaagctagtcttcagatggctccttacgaagcactgtatggtcggaagtgtcgcactccacttttgtgggatcaaacgggagaacgtcaggttttcgggatggatatcctaagggaagcagaagaaaaggtaaagatcattcaagaaagattgcgtgtggctcagtctcgtcataagagttatgccgacaatcgccgtagggatttgagttttgaagaaggagattatgtgtatcttcgtgtcacgccttttcgaggagttcatcgttttcataccaagggaaaattggcaccgcgttttgtgggaccttataagattgtcagtagaagaggagaggtcgcttatcagttggagttacctcaatctttggcaggagtccataatgtgttccatgtttcgcaattgaaaaagtgtttaagggtacctaccgaagaagctaatcttgaccagatagaagtccaagaggatctgacctatgttgaaaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctaagtttaattaataaattccaatataaaatggggccagataaaatttcattaaatactttgcttaattctataattcctagatttttctgggatttatttgagctaagaaagtatttgtaataaatggaattgcatttaagaaataattttaattgaaaaaggttttaaaaagtcttcttttggctttgggccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcggcgccgccgagccgccgccgctgtttccttccaatccggccgttcctttccttctccggccgatttgttagaggggaaacaatctccgggatctcctctaccttttctcctttggaatctttggctcaatcggtttggaatgagtttgattcgagttcgaatcggatcggctttcctctctccaagccgcgagtttccttcgccgttgccgtcgccgtgggccttcgccgccgcctccgacccctttaaaaggacccccggagtcttctcttctcgccg

SEQ ID NO: 28641 - DNA, 5897 bp, Oryza sativa
ttagatctcgcccgtccgttcgcgtgaacccccgcccgtgcgcccggtccaccaaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagatttagtcgtttccggagagtccgttttcgcagaagaagagtttgaagaattccaaggccagcaaggcaagtcacacagatcccaaacaaccctttgagcatgttgatcctatttaaagctattgtttctattcaactattgcatctattttcgaatgtcattgggtggaattgacctatcctttgttatggccctttcgtacttgattaccttattccttgataccttgggttattataatttgactagttgagctttatttatattggtccaactagatactagatataattgcttagccatgcttagaaacattagtacatttatgggataactaatgactcactattatttcatgatggcttattgatagttcacgatggtcaatcgtgattagttaattaattaatgtgccaactaaaacctagtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcagagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgtttagctcctggtttggaatggtacattcctggtttggagatagaactgtgcagccgggatggttgttcagaatggttgggcctatacaacagggtatgttgtatagcgttggattaatattgtttaattacttaactgttttatcaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttttttttccgcttagatttttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcccttgaccctaggttatgccaaatggttacccatagaagccttctaaaaatattggaaaagtagaactgttctcctccctttctcttttaattaaaccaaactaatggcacatgcacttcataatttttttttaatggttctcattcaaaatttattccagtgttattagtactgtacatctattactgtactaatggctcattttatcagcaaaagttttacaatgttgttttatttaatcttgctgcaataaaataaatttagcatgttgattttataattttctttcatttcttttgaaaccagttattcaaaattacaaaatttgtaacttcgtttccaactgtttcaacttatcctgcaagtttggtttactttatttacttaccttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggattcgggactgcccctttttatgcccagattcctcatgatcgtcatgaagaaaagtgccgagtcaaagtcactttgaacagtaatagtgaagatatcccctcagtgatgtttgaagctggaggaagaaattacatccatgcatgtcaggaggtggcaaggatcgccataggagagctccgtgatcgctacagtgatcaattggccgacactgagtatcgttaccatcctcgtcaaccacagggaagtgaccgtggcagttatcttgagactgaaggaattgagaatgatgctaccacaaggcatttggttgagatgctgtgggctatggatgaaagtcgtgcggagactgtactagcagctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctttatttgtccctcgctatcaactggcgccaaaggttcgtgtggtggagaaagaagttgccccagctcaagtggatcctccgatcatcatcataagtagtgatgaagaagaagaacccaagcgcaccaattccaagattgagtgggaagcaacccaagatgatgaagacgacccgaatgagccttccatcgaccttcgatgcttggaagaactagagtgacttgttaagtcgttgtcttagatcgttgtgttagtttgcttgcttaaagtttgcttgtgtgtggctcgcatgtgatttacatcagtggtgggatgtaattgcatgcgtttgtttgtttttgagtgttaggaagttggagagtttagtggtgtgagagtcttcagtttgtaataatgaaactcagttaagagcaataaaagttaaagtaattctctatcttaagtagtttccccggtttctcttcttgtgccctgtccatgtcagatggtgaacactcgcagcaatgggaatggtcccaacaaccccaataacaacaacaatggagagaatcccactctggcccaagttcttgctcaacagacacagcttatgaacatgatgatgcagcaatttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcacttccgcctgaataggattactgctgaacctatcacttggcttgaattcaccgctgctttccggaagacgcatataccatcaggagtagtgtctctcgagaagaaggagttcaggtcgcttactcagggatctcgctcagttacggagtaactgcacgagttcaatcgtcttgctcgttatgctccggaagatgtgcgcaatgatgaagagcgccaggagaagttttttgggaggacttaatgatgagctttcttacccactcatggttggagattatcctgatttccagaaattagtggataaggctatacgtcaggaggacaagtacaattgcatggagcagaggaaacgtcggattgctcacttcaaggcacaacaggggagtaatcagaagccgcgtcttactttaggaccccagcccatgtcacagggaggttcttcgtctgttgttcgtccgcagcgtcagttcttcaacaacaatgctggcaacaacatccgtaatcaagctccacgtcctgttgcagctccagtacagcaacaacctgccaagagggagcaaggcagcaagcccgtggtgtgtttcaactgtggagacccaggacattatgctgacaagtgtccgaagccccgtcgcgtgaaggttgtccctgcccagagtaactctgctgtaccagcatcaaaggcccgtgtcaatcatgtcgctgctgcagaagctcaagatgctccagatgtgattttgggtacgttccttgttaactcagttcctgcaacagtgcttttcgattctggtgctacacattcattcttatctatgagttttgcgggaaatcatgggatggaagtggaagatcttagacgtcctttgatggttagtaccccaagtaatcaagcactctctttgcaacgtagcccctctgtcagaatagaaattaaaggagtaccatttctggccaatcttatcttgttagaatccaaagaccttgatgtcatcctagggatggactggttagccagacataaaggtgtgatagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaactgaaaggtgccactgttttctccaagatagatcttcgatcagggtatcatcagttgagaatcaaagaggaggatatacctaagacagcttttaccactaggtatgggttgttcgaaggtttatagagaattttttcaagattgctaagcccatgacacgactgcttcagaaagatatgaagtacaagtggtcggaagaatgtgagcagagttttcaagagttgaagaatcgcttagtatcagctcctattttgactttgcctgatccaaagaagggtttccaagtgtattgcgatgcatccaaacttgggttaggttgtgttctgatgcaagatgggaaggtggttgcctatgcatctcgacagttacgtccgcatgaaaagaactaccctactcatgatcttgagttagctgcagtagttcatgcgttgaagatttggcgtcattatcttttcggtactcgtacagaggtatataccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacaaaaggacgacagttgccattggaattaggcaaggaatttgaaagattaaatttgggaattgtcggtagaggtttcgttgcagccttagaagcgaagcccactctaattgatcaagttaga

SEQ ID NO: 28642 - DNA, 867 bp, Oryza sativa
ttgagtcgctgaccagtgggccccgcatgtgggcgccgcactccccccctgtgctgacgtcagccctggttaatattgcgccataaattatttaaggatttttgttatagtaataaacacagtgaatcttctaaaattcataactaattcatccgagctccgtttaatcccactcaagtctcagtaaatcaagaaaaatgtgtagaatccattaaaaatggttttgttctctgtttcagtagtcttatagcctgtttgcaatgtttgctttgtatgccgctagattccgatccctccgacgctccggtgtacttcgagatagtcgccgaggttcccccagcagcagagcaaggcaagtcatgcttgtcacttgaacatgttgatcctatattgccaatgctctattgtttcctttcaaatattgtattgttttataatattactatgggatggttacctattgttacagccatgctttttggataccatgctcctttgttagcttgggttataacatgattagagtttggactaggaattgcttagccttgcttagttcaactagatcacaatggggaaaatcatattaatgtttagactgttagttctaatggtaatgttggtttaataccaccgctctggtgttggttaaataaaatgaaccacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctttagtcgacgcatccaggcaagggtgggcgtgatggagcggggcgggccctgcgacggcctc

SEQ ID NO: 28643 - DNA, 115 bp, Oryza sativa
  unsure (1)..(115): unsure at all n locations
ttgaagcacagccgctgcggacctgaagcgtccctgcggccttgatcgggctgccccgctggcgtnggaggacggggcgcacgagtcccttgctgattctgctgctgttgctgct

SEQ ID NO: 28644 - DNA, 6967 bp, Oryza sativa
  unsure (1)..(6967): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataagtataataatagtatgtgcagtgttactacacacattttagtatgcgtctttttttttcgaggtgaaatagtatgcgtcttatgttcataaatatatatatttacatgcacagattagcagcgcaacgttttagtgacttcgtatttatgtacgctctaatttttcacattatcacagattcacagtgaaataattttacttatattttttcatcataaagaataaaaaaagatgtaaaatgtcaaatctagtactagttgcgcacataatagatgtttccgtttatttttcacagcttctctactgttctacagtggtatatatactggtatctatcagaccatcactagtattatccctggagaaatgattaatttgagctacagcattatctcgttccacactagcttgggtatttttcttgccgatgtaaccccttttgtactttgtttttccaacactaaatcttaatgaaattagtaggcccttccttcggccgacccgagaaaaaaaaatctgtatattcaattctgatgagtatagaatggttgacggacaggttgactccatgtctccatcacatgcacaacagtaaaaagaaaaagacaatacgagtttaatttttttcttacgtaccccgatcctacttttgcacatcatcgccgatctgggcggtggcctcggtcgatcgggccaatattgctggagttgttgactactactttcgtttcaccgtataagtctttataacattacccacatttatataaatgttaatgaatctatacacatatatatgtctaaattcattaacatgtactccctccgttttataatagatgacgccgttgactttttctcacatgtttgatcattcgtcttattcaaaaattttatacaaatgtataagatataaatcacacttaaagtactatgagtgataaaacaactcataataaaataaattataattacgtaaattttttgaataagacgaatggtcaaacatgtggaaaaaaaatcaacggccgcatctattaaaaaacggagggagtatatgaatatgagcaatactataaagtcttataatatgaaaagggaagaagtagttgtcttcgcccatgcatcaaggtggcatcgttttattggagccccaggcgcctccctgctgcaacgactactcctgctcgttaaattcgaccaaattaaccaccagccggtgaagccgacgcgtatagtaatttgcaaattaaacttgtctgtaacttcttcagagtaaatgtcttagaaaaattgtaaaacctgtctctaggtgcatgcatgcatgacagataaaatataccaacaattaataacacgcaaaagtcctagctagtggtggtagatagatcgatgattaattattagaggaggaggagaagattaacaagatcacctgcgctgcacaggcaatcgtgtgaccactgcaaaaacgcggtttcactttcacgtcgtctcgtactaacttctgtatcctgattcattattggacgtactgaaattggcccagttttattaatgtgggagtagtttccctgatgttttctagaactttcttagctccatcgacgaaagtggactgaaattaattagggttgtgtttagatccaggggtcaaaagttttgacgtgtcacatcggatatacggacacacatttgaagtattaaacatagactaataacaaaacaaattatagattccgactgtaaactgcaagacaaatttattaaacctaattaatccgtcattagcaaatgtttactgtagcaccacattgttaaatcatggcgcaattagacttaaaagattcgtctcgtaatttacacgcaatatgtgtaattagttatttttttcgtttatatttaatactctatgtatgtatccaaatatttaatgtgatatagtgaaaacttttgtcatgggatctagacatgccctagagtgtaatcgaacgattaacagcctagctagctagtgatcagtgttgaccgttgactgacacagaaacgacaacaaccgtgacacggttaaaccgttaaacgcgctgccacgcggcttacacgcgtatcaagaattaaactacctagctactcccgtatatatatataaccgtgcaggacacccatgatcaactagtgattaattacactgagctggaagctagccttgacctgtccgtctcgaggtcgaggctacgacgacgatatatagagatcgattagagagagataattaagaaacagggattacggacagctagctagctccggcgacatgccccccaagcgtaagtcgccaccgccgccgccgccgcatggccccgtcgtggtggtgcctcccccaccgtacaggcggcgcctggagatcatcgatcttccccagggagctgctgctccgacaactccaactccggggaagtggcagctgcctcgggtgcccatagctttcattgccctctacttcatcgtcctcgtgtacgcctccgatctcgatctctctctctctctctaagtaagaagggtacaagctttgttcatcatctgatgcgtgttctttgctattgatgtgcagcgaggggaagtccaaccgccgcattcgtcgagtggtgagctgctaacaaatctctgaatatatctctggatccgtcacaccgcggcgtccccctctcgtgcgctcatgctagccgcatgctcgctcacgggggatactcagctcgctcggcctatctggccttctttgtaggccagcactcttttgcttgcgtcgacctactttggcaggccaggggctctgcgaaatgtaaactttttcattggcttgcgttgctgcatgactaatcttcttctacagaagcgagatatagacagccacttagcttgccctttttacgcccagaaactaagaaacggtgaatcacattcttctcgactgcgtgtttacccgcctacagatctggcaccatgtcctttccccctctggctgaccaaaccttgccccctccaacggctgctctcttcaagtttggtgcccttcgtctatggtttgtttgccggagcatcatcttcataaaggttacgactccctggttttactggtttcctaacagttgtggaaggagtaatactctggggttttcgacttctctcttttttcggtcttagtgattttggattcgtcctgtaagagagccgtctgtggtcggcagcgggcgccgccacgtttggggatctgttggagtctagtggagtacaccacaaacctccctttgtttaggagcagccttttcttagttgtaaaagtttctttcctttttttcggttttccttttttttttctccattgtctcctagtaagggccattctgccggttatgtcatgtaattgaaactttaatttcttgctgtgcaatccttttgcgcgttcgcgaaaacaataaatcatgtgttcacacatgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggggatatttatatagagcaagggtgagtacgggggtactcagcaagccatgggaattaagtgtttaatgcaagcttcaaggaaaggctgtctgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatcgaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaatgatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgggagggaggagagagagggccggtggaccgggctcaccacgcgcggtcccgagtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggtcgggtcggcttatctggtcgcggccgaggtggcgccgacgtggcgcctacgtggcagccacgcgggtcggcggaaggtagacgaaggcccggccgaaacggacggcgggcggcggcggcgatcggcggagcgagccacggcgacacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctatgcggccacgggaactcgatgctagcgtcggatttggagggaacacgccgagggaggctggcgacgtgcgggtgctacggaactgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaggaggaggggagcggggcgacgcggcagagggagggggcgctgcctccgtccttggcggcttgcgcgcggag

SEQ ID NO: 28645 - DNA, 3808 bp, Oryza sativa
taaaaagccaacggtgtcaaacattttgaaacggagggagtacgtactttcatcaagttctcgtacacaaaattaattggtttctatgcatgtcctaattaattaaggatctcttaaacatttattcttttgctaggtaagaatctcccaacaaaatctgcaggttcgatggctaatctgctctgtaccgctaattaattagtttatttttttttctcttccgacaaatttgggtaattgggttgtacgtcgtgctgagttatatatgtgcaatatactactagtagtcatttacctctaagttagaactgaatattaattaattaaacatttttaaaacatgtattataaatatgtacttggcttctaaagtcacatacataatccatcctcacatgtttttcattagacttgttttaattgttcagtattttcataattaaatataaagttgtacttaatttgcttggaatctgaattttaattttataatactataataatgaaattggagtgaatcattaattgtgaagttgtacttgctttgactcaagtttagtattttgcagatttttttggaactattttgtaaactaacaagtctaaaaaatcaattaagaagtgcaaagttgcaactgatgtgaactctctcttaatctgagctagtattataattcggtgtcatctagagatggccatatgcattcaatttttttccaattgattaacatggatgtttgctcagattaatttattaatagagggaggatagcaaacaggttaattgtaaagctactatatgttttcttttttactaaacactgtaaaactagtatagctggaggatttgtttatttttctctattttcttcctttaggtaatttgtctgttctgtgcttgttaaggtacgcaaagagaatattatttcccaggaaaaggtgctccaagcatttgataatgcccttcagaagcatcttaatccaattcatcggtaagatatgtcaatcaaagctagggtgatttttagaacaattatgattcaaatatactaaccctttttctccttcacttctttggttgcagatcccttgaatcccttaccgaacgaattgatactctgactcatgaagtggtattggatctaacacatttcactctattaaaaataactactccgtacctcattaaaaataacacatttcacctcattattgatttttatcaacaaacaagtttgtacataaactgcaatttcttagggtttgctcgagacagacaaatgtcctagcttataataattttccttttaatttgtagggacagatcaaacaatcaaaccctaaccatcatgccaatgagcattacaggtatgtcatatttgcaactatgcataaatgattcctatcagtcgtgcattattaattctaaattatagaattatcaagtaaatgaactaaagcatttaaagtatcggtaattcttttttttttcaaaatttggaactgtctaataaaattaaattacttatgccaaaatttaatactccataattaaagaacaataaatgtgaatatatatgtacattccataattaaatattatgaattaataattaaaatataagtttttcatatatgagtgcattgaaagagaaaactattcaataattttgttaagtaggaatcaaatcatgggttaacatttttttcctttcttgtgagtgacgcggtttaacaaataacaattaatccatactaatcacttcagtgatctactatagtaccatatatgttcgttaaaaaaacattatcctttggaatatacttaatgaaaaaatagattcgttcaaaaaaaaactcagtactatatattgatgacgctatctatttatgtagtttctttaaactattttgccatgttcattccctgttctggtagtattgtagttgtaaacttcagacaatttgaagtaataccatacatttcggatgacattggtgtttcacactaaaaagtactgtgcttgtgtctgtactgtagatcagaagcaaatcaagatgctgctggatttgctcattatggggaagctgttgagttgagattcctcaataagttgaagcctcgtctttattatacacaggaaaaaattacagcagaggatggcacggttatccaaattgccttatttaaggataaccagatagttaaatccggtccactttcttctgcaagaattgaatttgtggctcttgaaggtgactttaatgatgttgcccctgaaaattggaccgagtatatgttcaatcagaacatagcaagatccccaaaagggcctgtgttaggaggagtttgtcaaatcaagctgaagaatggggaggcctctccttctggcatctctttcgttgtaccatcttcaaagagtagaagcggaatgttcattctggcagcaagagttcatagcagtgacaaagccgggttccggattatggaagccttgatgaatcctgttgaggtgcaggtttaccgaaacaaaggtatatccttcagaattgcatcttgctgttctgtagtttgttttgatgcgtgtgctattatgcaattctgaacctctcagtcagtgactgtagaaaaactcttctttcatagggttatctttgaaattaaagagatcgcataatcggcattgtatgatctattgacattttctctcctgtttcctttttccagcaaatataaatagtgacactccaaaattgaaagatgatgtataccgtttaaagggaatttcaaaaaagggaactcgcttcgattggcttaaacataatgggatcaacactgtggaggatatgttaaaggctttaaataagaacgaaaagaagattcgcactgtaaggcctctgggattccccaatcattctatttctcaagcacacaaaaattaggcccttagaaattagcattgctttgcgtgtttatgcaaattagaacctttctttgtatatcaggacagcaagcaatttacctttcaatgtcatgaaatagtagaaacataagtaaattaatgtctcaactccaattctaaaatgatatgtttatcatgcagtaaatattcgttttgacaaaatgaaattatcttatacatttcttgacgttcaggagtgcttcaagctagagaagaacagcaaggattggaaagaaacagttaaacatgctagaaagtgtgatctcgaaggcaattgcaacctgaaatcatatagagttgaagagaaacatgttgtactcttctttaactgcgtacatgatctcgttggagcacaatttcatgatggctatgttacaaaggacaatttcaattcagatcagcaggtatacattggtatctgcattcttctaccgatccaaactttgacgtgtgaactcagaacagtacgtgcaatttctatttcaggatgccgtgaattgtttgaaaaaacaagcgtatgatgctctggatgacattgccttcgatgacaaaatgaaagacaactatccagtatctttgtcttcagctatgaacacaagcattactgatggtgatgcttccattcccttaacagacagagcaggaacaaattatccagatctccatgttacatctcaaggtaggtcaatggtcttcttctcttgtctttgatctcagacataacgcgtgatgatttactgtttggtgctgcagcagttgggaattctcatcatgctgagatttatcaagaaccttgactgcttcaagcattactgaactataatagtgcctgtgagatagaacca

SEQ ID NO: 28646 - DNA, 14597 bp, Oryza sativa
ttaattccaacagaagaatactgcaggatttatttgaagaatatttttgttttgataatgatgaggtctgtaaaaaaatttcagatgaaggttatcgagcaggtgctgtggctcagatctacggtggattttctgaagttgacatccctattgggtgctatattggtcagacatctgaagtaagtgttgtttctgttcaatccactcagtatgtaacatcctcactttctagaaaatggattaaaagccagcctctacatcgaaaccagacatacacagccaactgtaacattcttactggaacagagatgaaattattgtcgatttgtcatgctactagttgaacataactcctgaaatcatccaattgctagctttttcatcccaatataagttataagttatttttcctgatgccaataaggtctacagcttgaacatatgtaaggcatacccatgaatatgagtctgtctctaagtattattatttttttaacgaaccggtacgagatcgtgccattttcattgaatagagaagaaaacagttgcatcgccaagggtccatcagtatcaatctattcgtgatagactgtgtctgtctcttattattgagatcactgcatttctgcatctttctcctatcacgcccacactcattgcatgctaacgagtcttctttttttgtagggtacttcttctggaggcaatgccttgatcggactgatgaatatgtcacagaatggcagcgatggcagcaatattgcagaactgattgacaacgacattgatccttatcagtacatcatttaactgaaccagaacaggggcgcatgctcacaactctaggaccgtttttactgaagtctcgtcgctctgcatatccaggaccgtttttactgaagtctgaaggatctgtttctagccagtacgcttgctggctatttatcttctccctgttatttaccctaatgagcagcgggtgtattagcatatttatatatacaccttgaactgtaattttctgacaatggtttcataaattaaattgttagtcatcgctggaactttttaagcaactgtaagcatattacaaagtatttcttccgttcttttctacacatggctgccttgcctccatcaccatctcctgaatcactggacgtggccccatcatttcatttatacttatacttatcttttttttaagtaaacggattttttccactacaaatatcaaggaaaagtaacataaggagaaaaatctaagaaatactattgacaaacacccaaatccaagaaatatcatcgatgaagtgcaagttccataaaatgctattgtacaagcgatttggttctagaaataacatcgtcattagagttctatccatctcgcgtcgttaatgtatatacattgtttatcctatagcacttaatggagggctattaacaaaaccctagtagcgatgatatttctgggataaagtcttgcacaatggcattcatggaactcgtactcgtcgatggaatttctttttggaattgagtgcttgtctatagaatttcttagattttctctataaggagaaaactcggaggaatagaaacccaggttataaagcaactagaagaaacaccctcctgcgctagcatgtgtgctaccgtgttcgccgttcgacggacccaacaaaacttcgtctcttggaaaccaactaaagtgtacttcaaatcttgagtggcttattagcaacaaaaaaaaaatgatttgtgggtaaacttttatatgcgtatccatagcaattcaaaaataaattatgtaaaataaataatgataaaagaaccacaaaaccaactcttgattcaaatttgggcttataagcataataattgttgtgcgttgggtttagccgtatttgaatttgatcatctcaaagttaggtttccaacaaaaaaaataactatttcataattctatgcattcatatttatattttttttactaacatataaaaaccaaactgatattcagaattagagcaccatatcagagattcagggcttgtttggatgactactccaacttgccaagccacaagctagctcgtgccacaagtttggcgaatgatttgagagccacaacttaggctaagaaatttgtggcaaagtagttcatgagcacctaatttcttgtggcaggctaatgtgtggtaagcaaacaaacatatgctaactacctgtggcacgccgaacttgaggcgcggcaaactgtggcacctatccaaacaggccctccgagcctttgttttggctaagatgacaaaatcgattttgaacctaatggtgggccgcatcctttgtttgggcctagttgtcggcgtcacacaactgggcccccacactggagccaagtcgacccggtggtggggcccataacgcgatccctctggcctccgttgcgacgtggcctcatcgtgacgctcggatttgtttgaaacgtccacctgtcgtgtgattcagtgtgtgctcctctatctccgatctcctgctttgttttctctgctagtgaggaacacagagttcgccggagcgagcttgcgcgggagaatggaggcgcggcccagatgccggcgggagggttctcagcgtcggcgccgccgcctgcacggagttcgaggcgaagatcacgccgaccgtggtacctcctgcgtcatggcggccggccaccggcggcctcatatatattcgacatcggctacgacgacatatgaacaacataggctctcatcggatggcctaatcagctaaaaaaaggcaaattttaaattttcaaacttagttttgaaattgattttgtgatatttttaacgtagtttctttttcaatattagcttttaattcaccaagaacacatatataaaagttttatctacaaatttatttttattccctaataatttatgttttgatttattggggaaaaagccaaacgatggggccaatagccactagcacagccccagctagtacaccgatttttttattataaaaaatgacatacacaggtaaacaaaagatgataatagttggagaatggaattatggaaacatgtagaatgtctggttccacatatatatatatatatatatatatatatatatatatatatatatatattaaatttgtttggtgtcctatatatatatcgtcaacattgccatcgagctccaccgcaaatcgtggagaaagcacaccaagtatatgaacaattaattatacacaacagaatgcattaccagcttaattatgtacttatggcacaaatattaggagttatgtattgaaaaaacactgaacatgaaagtaggggttctcatatcggaatttgttgagaaaaacgaggcttgaacttgagctggctagctgatctctggtgctagcctgaagacctccagaccttttctcaaaagttctgtattggggcagtttgtcataaacagctaacttatactgcaccattttactggattaaggaagtcgttgctaacttatattcataattagaactcgtccgcgtctaccggcttgtgaccagtgttcctttttgccgggccatgaccgtgaccagtcttctttaggggcaagggtagtaagtaaatttcatcagggcaccagtcttggctagaagttgatgcttcatacatattccaaccttcttcaaaagatatgccattatccattacaaaaggcatgtccatgtgtggatgaagtacatgtggattcatctcccaatctgacgaagccatcgccgctttattagaaattccctgcgtaaaatgacgtcggcgtaagctgtgctggtgcgccaaccttgggctcagcaggctacacttactaaatcatgttgaatttaagattacgtggagatattattgatgcataaaaaaatatttaaacgcaaatgagtcgggcgatataaattgaacttgaagcatactggatgctaattaagatatagaccgaaataactaaattaattctcagttactgaaaacaactaattactaggactacttattagctattacaaagaggacaaattttacttaacaaaggcaagttgctatctgaaatccaagaatcttccatacacaatcctgaaatgaaaacaacaaacaaaaactccagtcactctctgtcccttccctatggctatgagtcaatgctcaagaatttgcacgtactttataaattatcgtttacctctcaattagtatctttgttcattaccactctacaggaccatttgccgccaaaaatgcaccgtaccctataagttctttctaattctgtagccaacttactgtaagattttattatcaaatcttggaccatatatatgcctatactgcaacactctttttgttttcgtcaaaaaaattgatctgatgtactagtgatcgggcattcaccgttataaattactcctcgcctcaaaccaccgaggtggtactaaactttgccacaatatacttctgctgctggctgttgccgatctgctgctgctcgcgaaatgggccaaggcccaatgcccgctgctgcaccactactgctcctgctgctgcaattgatgtttgctgcctgggaaaaagtccactttgactcccttaaatataggtaaaatctaattcgtacccctcaactggaaaaccgggtaggacgactcccccaactattgtaaccggtgcaatttgactccctcggcggtttcggatagcggttttgctgacgtggcgctgacgtggcgaaattgacccagtcttcgtcccacgtggcattcgaattaaaccaatatatgtgggacccatctgtcattcacagaaaaaaaaatatattgtgggacccactgacatgtggggcccacatgtcatcatctctctctatctcttcccttcatcggtttgcagggacgggagctagacaagcggcggcaggcaggcaggcgacactagggcggcggcggcggtcgagggagtggacggcggcggggccagctcttcctcctccctctctctccctcatctctttctcccccgtttgtcttcacaggagcaggggccacataggcattggcggcggcgacggacgggggtcgggttggcggcagcgacgaacgggggtcgggttggcagtgacggcgggccggtctccatcgcgccatcgccatctcgtcgctggaatcgtgcttggcggcggcaagaacctccggggtgaatggcgacggcttgatccaccgatctaataaacatgtatgtgctctgatgttattagtgaggtccctagggtggttcatgcgcaaggaattgacgcgagactcactggagcggcgggaatcgaagatttacgccggcggccggagttggagaagacgaagtcgatctccctcctcggtgcgccattctccgggatttttgaggggaaacggagaggaggacgatgcgaagtcgacggcgcagtggcttggctccggccctcgcccgcccgtcctcccgccgccgccgccgccgccggctcccgcccaccgccgccgctgccgctggccctcgtcccactctcgtgaagagaaagagagggggaggatgaagaaggtagagaagagaggatgacatgtgggccccacatgtcagtgggtcccacaatataaatttttttaatgacagatgggacccacatatattttttaattctaatgccacataagcgccacgtgggacgaaaaccgggtcaacatcgccacgtcagcaaaaccgcccccgaaaccgccgagggagtcaaattgcaccggttacaatagttaggggagtcgttctacccggttttccagttgaggggtacgaattagattttgcctatatttaagggagtcaaattggactttttccttgctgcctgcacgctagctaggttggcccaccaaagcagcacaagcccactaactcagcagcttttatcttcttctccttttcttttctctaattatcgtggggcgtcatacatatcttctcttttatcatcctctgcttgataaattcacacagtcatttattatttgccactgattttaatggaatgatgagtagcaaacaaaagaacagtaaaatttcagtggcattgagaaattcagctccctagtgtttggcgcagcagcaagtggaagtggttcttgactgcttgtgggtgctgtacatagtaacatgggtaatttaactatctttgagaaggtatgtaaatcttggtacaggtaacaaaatttttaggtactttctcaagtagaaagtaccgtaaaatttctttagaaatattatataggatgggggatgaatgcattgtaaaagtcaaactattgcaagacgtagataatgaagagaaaagatacgataaaacattctgtgaccttgttgatgcgctgcattgtaatcagaatgatttggtggttgttctgcttcttgcattggtacaaatggttccccatgaacacctgtattctcaaaaatattaggcttatagttatataatatgagttaagcgataaattaagagagtgacttctataaactttttgggtttatcccgtcaagaaatcaggtataaagagcagtttatgggagagcttaccatcactgacagataggtcattctcagagtcagcaagcaaaggatttgatccgccacctcctggaactggaatacgtgcagcagtgttgcagttttcaagtgaaggacatgtttgagagacgtgagtaagcccggggataaaattattgactgttacaaaaaaattgtaaatgtcaaaactattttaagatgtaaatagaagaaaaaagctatgataaaacactttgtgaccttgatatgctgcattgtgattagaaggatttggcggtggtgctgcgtcttgcattgacaaagataggtcttcagaaacatttctattaggggaaattttagtaggggcgccattttcattcattatgtagtcaaatggaatgctctctaatgcattgtatgcttcctttctctgactatctactatggcctgcaaccaaataacatcaggacagagttaaccgcaattgtagccagagcaactgtagggtaagatttagagtttaacataaaccttttgatatcgattgaaattctcctttgcagtgtacttgccattaaattctgctcccacaatatcatgtacgcaattgaagaagatcacatcattaatttggttacctacaaccttgtatgctttcaggtaatgattttctttgagatcacactccctggcatgctcgataatggttttccagtctttatgatcttcctttatacctagtaacttcatgccaatgaataacaattaacaagtgtataaattactctattgacaaaaatatatacataggacctacagggtattcgcatggttatctgaaaacaagttttttttttctttttctaattaagcatggaattttagttgttcgcaaagctatattgaaggagacggggtactttttgattatggtttaatattaatcatattaattaataattttatgtgaggatgtctatatactaccagcacaaaaatacttccgcataggaaaacttgtcctctttgtaatatatatggataattttatcatatttgagaaggtattgagaggcatcatattttctagtgtaaaacttaataccaaaatttttagcgtaaaatcttagtatcagcaggcactttcttaaaaactgtaaaatttttcaatatatataagtagaaaaggttgtagatctaacatttctttaaaagagtagatgcattagattccgactataatataagaatgcagagaaacataaaatgggatatttacatcattgagctcttcaggatttttgttgtaagcccttagaaaatgcccgacagtcgtgatgttctatgatcggagcttcgggtagtatattcctttctttgcaattttcttcagtctatatatctcatcatcgaattttggggcgttactttttgcatttgctgcaagaaaaaaaatatgtagctgaagatatatatactactataataagaattaaaggtgtttaacaccagttataaacttataataacacgtggatcagtggaatcttttgctacgcagtgaccttttaagattggtgttcccatgatctatactttctataaagttacaacccactgaatctaaaacttaacatgcaaaccatgccacatcgttattcactaggaataattacatatcaaatctcatacgagcatgcaacattatttataatttattgaattctacaaatcaacatgtaagtatatccaattaacacagctcacatcattttcacaatatatcaacatatctatccattatttttataatatttaatatataattatcaatatattccacatcaaaaatttttacctagagatactttctcaataatcgtaaaatttctcaaaaaacttacgcttgtttcggtttgtttgcacaacgacaggacccatgaatgcttcttgaacccgatggcctccagtggcctcgttcctattaactcttgctgcaatggtgaaggttcttctcaagctcccttccctaaactggattccagggaaggagcaagttccctcgacaagcctgcgagcaacaactcctttcaatacagaaatatgtccatctcgggtcttcacttccttttcgtccaactgctccgtggtgcagttaccaacgacgtcgcaagcgaaatcgtcccgtagaaccaaaagctcgatttttgctgaagagagtggaccggatttgatcacatttccatcggagttgatcatccgaacctccagttttatttgacagccggtgaaaaggggactctccaggttggaagtaaattggagacggtagtcgtctgaagccatttgtctgcatgcggagcataaaataataaggatggaaagtaatcaaagtgagatatatatgtaaatttaactcatctatatgccacatctactttaaacatgagtagtaagacatgatttctaattaatgcattcatcctcctttttcctctaaaaaaaccgctaactctaaaaacccaatcatcatgcatggaaaaccagcatagaaaaaaaactgaatcacttttctatctcctaatcctgttgccaataaagtgtaactagtgtcaataaagttgatggaaaagattttgtggttgctaagaaaagattgtagtctatgaaattaagaaaggaaagtatgtatgtaacccctacataacggaaccttttaacaaaacccttcatcagttaaaagggtaataaaaaatctgaccaaaacatatgggattatccaattcgacaattatttgatcccaactgaaaagtgagagaccatcggattcaaaaagcgttttagggcaagatgatgagacaacttaaattgaaagagggaaagcatgcaaggtactccaccttggaagatttgaaccggtatgtatgaatcgtcctctcaagccccgatggacgtagaatctgctaggatgtaatgacttaattaaggaagagatcttgcatgttcgagcacaacgtagtactaatacttaaagcaaatctgaaagggcgcgcatacttactctagagatcaataatgtttgaagtgatgttgcaacataggagtatatatatattattagcttccgaggggagaagcaggcggatttaaaggaggagaaaccgcgtattcataaccttattaggtttttctcatcaccttccggtagttttccaggcattttcgtggaaggcaaccaaccgcgacgatatatatattaattggtacagataagtatcgatcgcgagtcgcgactgctcacgcaatatagtgctgtaagttgttaaggaaaaggacacgcgactacaagtggtaacgcttcaggcctaaacagctatacgcaaacgtacttacaaaaataaagcatcatgtcttcctcagacgtagcttcgttgaaaaaaaagatgtgtgcactagtaaacagtaaacatgctaacagagccgagcatcattccactagtaattttaaaacctttgatggcttatatcttttaaacaatatattgtttttaagatctgattaaaccaacgtactctactgaaaatatatgacaaaacgagtccaatattgaatatattcagaatatttacttgtgtagcagtgttgttaattcaaaatctatgatgaagagttaattctctctaccagtgcagttatttctaacaccataaaatgctagttccattttttcagttactttcttataggaatgtagcaacttctaatcctttcttcctatatagttggtacccactacaagtcatttatgctataaagctcaaattctatgaggccacatcatcaagattatattgaccattagatcatctcgcgtctatgcaaatcaaccgttagatcaagttcttgtcattcgatggcatctgagaggaccaatgcttgaccaatgctttttatcttcctcttaattacctcatgcatcattatatcttcctttatcactaaccactaatacatctcccacccgaaagcctacaccactatatttgtgtgtacctctttctcattccttttaatttttctaatgcatctactagccatatctaggttgatccaatggattttcttggaatatttatgcttgaacgtgcttcctcaatcatctaaggaggaaatgtcaatggtccaatgaaatttggtttgtcactgtcatagatgacatcagaaatttgtttgtacagattacaacattcgatgatctttaccaattgcaaggatgtttatctcctctggtgattggtttttggtactctatcatgatcttgcttctttttatatctgatttcttcgttcatcaccaagcttcatatgctaatgtaacacaactatggtaacttcaatttttggtaactttaagtattgagggattggtccactctcacatttgactatctacatttgattaaaaggctatgccatatctttgtgcttttcataccgataatcactaaatttgtttctccgtagttcctcccatttacttataggtgaacatttttcttgaaattactagattcatgcacccaatagttgttttttttaagatcatataccaacatatgcatgcagctttatccatattttctctttgttttctcgcaaaaagaaatattttattagttgtttaaaatatctgaatgagatgctaagtcaatttagtacataataaaaatagtgtcctctttgcttaccgttcatggttcttcgaattgggagtatctcaattggaatcatgtcatttctattcatatagcaatataatgtaaagatcgaacgttcaaccatgttgatcatgcaattttgataaatttacaactatttgttcccttctgtgtaatgataatataccaatagtcaaaagttctagaattacatcttccaaattcacgatatagctatcccgcagcaatgcgcggggtatcaactagtattataaagagttacttctaatactgtgaatagttacttctattttttttcgtgtgcggatctcccgcccatctgcaccgaagtgtctgcaaaaatctgatttttttcgtgcgggtctatttctcgcgtgcgggtggcttatgttgcctgcactaaaaaacctcacaaaaaagaactccaaaccctaacccgccgccgggggagcatgaggccgcgctgccgctgcccgccgccgctctcggccggggttagccgtcgtcggccgccccgtgcccgtcgcccgccgagcctgccgccgcccgtgagggacgagagacgagaaagagagatagaagaaatgatgataaaaaaggagacttagtcgagcttgacgagcgtaggggaatcacgctcattgctccaaatgaaacgatgaccgtggagcggtgactcccaactcaacaataagtagatggaagcggctcatcatgcgccaattgaggttcatcctgttcttgtattgagcctcaataattaaattgaaatcgcatgcgaggacccacggtcctatgcgagaagagcacaatgaccagagctcgtcaaggaaccgaagtttctccgcatcctcctttggttcatacactttggagagccaccagggagtatcatcggagtggtgtcgaaccagtgctgttaaagagaaatcaacgaggtgaacatccgtaactattgatgtggaaacacggcggcctgggagatctgcttaactccagtgcaggtccaaggctagcctcgagtgtgtccagggcgtgctagctgatttgatcctgcaatcagcaagaaaaaataagggcagaatcagtcagccgatagccgatcggccgaaatgccaatagagtattgttggtggtcttagccgatggagtcagaccaaatcggctatggattgagtatatcaaagaatattaagctctaaacatgcctaatcggctgtaataccatctatcaagtttaataaattggtttaagacaatattatgaaaataatagatgtgacaatgtttagagcaagagagataatgcactagctaatactctagtacaaatctatataaatttactctaaatagattgatccatataaacacatcaaatagaaataaggcatgagggtgcaaggatctagctgatactgactaaaacttgatatgcttatataaaacgatctatctatataagtggcgaatatacatgaaacaggtattgaaacatgcatattaggtatgatcagctgaaaccccgatatactatcctcattatgcctaattgcaggctagtttgcacggttcaaagcacgactagggatgatgcatctcaaagtatgaaaagaaacatgcagtctagataatcaagcaattaaacacttttcaggatgatagatgccttagctaatctaatctagcaagacaatttagccaaaaccagcataaatcctaaagcgagaagcagccgatagagctaaattgagaagctaataatagattaactaaaacatatgaagcaatgactcacgatatcgagcctaacacgtctaaagcgacattttagcctcgatagaacgggccattgagatgggttatctcttgcgaagaactcgccaaaaacgagaaaagtaaaagggtggcgatgcaccgaagttgtattggattggcccccatattataatgctatggggttcatatttataccccgagtacaaacttagtctattatggacacgactcaaacctttctaaaattaaggtacaaacaagaccatatacgacggtctcttgccaaatatctaacaaacctactcaatatcctaactaatagatacaattgccttatccgagctctatctctaactggcaatgatgtttatcccaatctaggcccaagtcgagcccaagtcatgttgtatcggccgtatcggccatcagacttctcaacttgttcagtcttcaacttctatttccagccgatacagtatccagccgatgcgcaatccaatactgagtccaactcgattcaacaccaaatctgtttcaatcttccttcttcttctctgaatttgatgcaaaattccgttgttaacagtaatagaccagacaactttccgctaggcaagtaacatcccccacctcagaccaacaacagggcaaaaagtaatattcaaagttcaggcttaaggtgaacaggcaaaaagtatccactaccacggattgatgatctttttgatcaactcaaaggagctaaggtgttctctaagatttaccttcgatcaggctaccaccaactgaaaattaggaccggggatatacccaagaccgcgttctcaacacgctatggattgtatgagttcacagtaatgtcgtttgggttaaccaacgccccggcatactttatgaatcttatgaacaaagtgttcatggattacttggacaaatttgtggtagtattcatcgatgatatcttaatctactccaaagacgaggaagagcatgcggagcacttgcagttggtactcgagaaacttcggaagcataaattatatgcaaagtttagtaaatgtgagttctggttaaaagaagtcacttttctaggccacgtaatctcagccggtggagtagcagtggatcctgccaaagttgaggccgttacggaatggaaggcacccaaatctgtgactgagattcggagttttctaggtttggccggatactatcgaaggttcattgaaggattctctaagatagctcgaccaatgacacaactactcaagaaggaaaagaagtttgtgtggtcagaacagtgccaggaaagctttgagcagctcaaagaaaagctgacctctgcgcctattctagttctcccaaacaatgggaaagactttgttatatattgtgatgcatcaaggcaaggactaggaggggtactcatgcag

SEQ ID NO: 28647 - DNA, 161 bp, Oryza sativa
atatatatatatatatatatatatatatatatatatatatatatatatatatatatatatatatatatatatatatgtgtgtgtgtgtgtgtgtgtgtgtgtgtgtgtgtgtgtgtgtgtgtgtgtgtgtgtgtatctaagaaatcaaactaattgtaaat

SEQ ID NO: 28648 - DNA, 689 bp, Oryza sativa
  unsure (1)..(689): unsure at all n locations
nnnnnnnnnnnnnnnnnnnnnnnnnnnnnnnnnnnnnnnnnnnnnnnnnnnnnnnnttggtcttccgccgctcttttggtcaccggtgagttcgccgcgtcgcgctctacccgttggtgccctccgtttgcgtcctcgcgccgccgttcgccggcaagcgtgcgccgtccgagccgccgagccgccgccgccggtggtgacgtcatcgctaatgtcatcgtggccgtctgccgtgagccgccgtggacccgatcgatctcggccgtccgttttggatggatcgatctcagccgtccgttcgcgtgaaccgccgccgtgcgcccggtccaccgcgaaaccctagccactgatgcaataattccctttttccttttcaaaaataattcattattgcgtcataattcaattaaaatcaatataagtgttttaatccgaattaatcttcaaaaattcataactaattcatcttagctcggatttagttggttcaagtctctaaatttttctaaaattgagatctacatgttaaaaatatccacatgtactggtcatgcttggttatgtgctgttttggtgattttgctcttttctgcttagattccgtcgtttcggagagttcgttttcgccggagaagagtttgaagagttctaaggcccagcaggcaagtcacacagatcccaaaccaccc

SEQ ID NO: 28649 - DNA, 288 bp, Oryza sativa
ccatcccaactaactaaacgcacaataatagaagcagcattaacactcaccttatgcccgtctcctccggcgtcggcagcgccatggaaggcgacgctccccgtgctcgactgcgacgtcttttcgtactccgacgccgacgacgccgacgcgcacttttcctcctccgtcgtagccagctcagcctctgactcggccatgtactcacactccgacgaggagcagctgctgaccaccggcgacggcagcccgagcgagtccctctcgtcgacggcaatgtcgtcgtct

SEQ ID NO: 28650 - DNA, 270 bp, Oryza sativa
gtgtccttcgtggatgtctgtctgacgatgaggatgaagaagaagatgacgatgatgatggatcgcttggttttggtgtaggattacgaggtcgtcggctggattctcgagaatcctgtcgtcgccctccgttgttgtcccggcgccgatctctgtcgtcctcgtcgttatggcggtgtcctcgaccagtatcgccctgcattcgcctctcacgatcatcatgatcgtggcgattgcgagatgaattttttaagcctaattgtgccatga

SEQ ID NO: 28651 - DNA, 713 bp, Oryza sativa
  unsure (1)..(713): unsure at all n locations
aagggtccgatcgatcgaggaagttgtgtgtactctagctgtagctgcactagtatcaggtattcgatcaggtggaattgggatcgatcgatcgatcacctgcgctggtgcggagaatgtttgtttgtagaggaggaggacgatgatgctatgaaggtttggctggccttagccccagccccagggcaaattaagtactatgtaggtgctcgatagctttcgttttcgcaagctgttgtccgaagtatttttttgaaacgtaactattgtccgaaagcagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttttgatttttttctttttttttaannnnnnnnnnnnnnnnnnnnnnnnnnnnnnnnnnnnnnnnnnnnnnnnnnnnnnnnnnnnnn

SEQ ID NO: 28652 - DNA, 483 bp, Oryza sativa
aacggactgaaggaggaggcggcatgcacagtaggaggcgtatataaaaccgaccggtgcgagaggagaacccgcatcacatccacctcctcctcgctcgatccgctcctgtaggtactcgtactactccaattctttctctcgcctacgccttcctcccaatcttgttgtttcggcggcggcggcggcggcggcggtgagggagatggcggcggagaggaaggacgtgggcattctcgccatggacatctacttcccgcccacctgcgtgctccaggtcagccaccaatcgatctcatctcccgattcttccctactgatcaacctcgtcgatcgtatcatatttctcccactacaatccgtgtttttcttttacaaatttagtcccatgttttcaacttttcataacttgcaaacacgagtgcaatcaaaacaagatttggaggaagaggaatccttcaaatatttttagaagaaaacatg

SEQ ID NO: 28653 - DNA, 649 bp, Oryza sativa
aaaatcagtgtatataccaaacaaattgaagcacacaaattcagtgtatctaagttcagagtatgtatgcgcaaaaaaagtcagtgcacataccaaaaattggcatctacccaaaaatcagtgtatataccaaacaaattgaagcacacgagtttgtgtaaaatcagtatatacactcaactttactagtcttgaaacatgcgtgctcagagtttagtgcttgggaaaaatgtagctagtgtagtatatactgatgtgtccttttagcaagaaatatatctatctttactattataaaaattgaaaatgtttttgctgaattttttgtacatccgtatttgaatcggttttcggttttaattgaatatattttattgtcccatctatttttttcgacggttttttaaatctccgattgggcttctttttttttatccatccggttttttcatcatcgcatgtttccactcaatccgatacgatcgcccctttttaccgctctcagggcccgggcccaaaccctagcaccgccgcgatatcgatttgtctccccgcacgtttcatcgtattattgattgtaaaaatcgattccccactcctaactcattatttttcctatgatttcttcctttaaatctccaattgaaga

SEQ ID NO: 28654 - DNA, 2536 bp, Oryza sativa
  unsure (1)..(2536): unsure at all n locations
nnnnnnnnnnnnnnnnnnnnnnnnnnnnnnnnnnnnnnnnnnnnnnnnnnnnnnnnnnnatagatattgcaaggaaacttgattgatataccatgtttcacgaaacttatagtgtgcagacataagggatatggtaccttccaattgtattgtcaacatagaaaccatagcccttgtcagatttggcagctttatgcatttcagctagtttccttcccaaagctgactgaaaacaaatggtttgttaacctcaaaggattttaggaaaaggtagcaatccgaactatatttgcataactttacctggtcacctctagagcaaccgaattcaataaactccatgattataaaagaaccaccagttggtaatgacccaacctatagcaacagggacataataaataagaaataaaaactgaagaagcttaagtcctctgaagaagaaaaagaagctgactaaggtaactggtgaaaaaacaacatagtatatgcctacacagcctgagccatctatgtaactggttgcctgtcaagtctagtccaatcagcaaataccaggcacccaagatgatgtaacacatatcaatattcacatgagaagaactagaaacatgtactttgatgctaataaaatggtagaactcttagttttttttttagacaatggaataaaacaaacaagtagaactcttagttaggtctggatattaacaaatcatggatatacatccatcgtgtatgtgtaggacaataaaaccactcatgtgcttacatgcaatgtactgtgctgttctatgcattacggaaaaaaacacacttgttcatgcatctgatcctttactaacccctttttatttagaggaaaaacctttactaaccttgtatggaatggaacacggattgaatttgtgtcatacatggccttcaaaccaagagcctccccttcaaacatagatggaccaatacgcctggcacataatgaaatgtacattttctgtcattgccactataaaacccagaccatgactaatcgtgccgctccaaagacatcattgattcaaagaggaagttagcacacccattggtcttcacaaagaaggaactggcatcggtcttgtagcactgagcagagttaatgcagccaccgccgatggaactgaccccggtgatcttcgtggccttcccttcagttagaatccattgcctgattggatcctcgcccaatgcagccactggcaaattcgtgcaaatccggctaagagggaaacaagaacaaaacaacatggtgcataacatctacagctattacagtattgtaattgtgcaatgccattaaactacccatggaaactggaatcaacagccaccaccccaccactatactacttgcgactgctccgtccgagtaaacccagtcccctatccaaatcttaaggccctcacttcatctcgaatactggagttcgcatctcctcaccagaaccagcactagtctagaatcgacaatacatccatacacgagcccggcgaatctaaactggaaaatttgggcgcacaagtagaatgccgagccaagtgaagaggtgaggtagggaaccggggggaggcggggcttactgatggagagcctggaggccgcgcttcgggggcagtcggaccggcgagacggccgacggcgacgacgtggcggagccggggagcggcggagtaggtgtagggcgaggcggcggacagcagcgccacgtttgccatctcgtccgtcgcgctcgctttctgcacaccgagttcgccgcgcgccgcggtgcggttggcttgccacgaaataacatagggtcttatctgcaaatgtacattcgctgtgtctctcttccattaagggctcctgcgttcaggagaatcaggagtgagggttgggctcgcacggaaaacggagcagcgattagcgcttgatcaattaaatatttactatttttttaaaaaatagattaatataattttttaaagtaacttttgtatataaactttttaaaaaacacatcgtgcgcgtaaaaaacgagggagagactccgaacgcagccttatacagtacggagtagtagttagtgagcctttttgagacggagcccaggactgatcgctatctcttgggcctataccgtacaggttgacgggccgcagatcagcgacctgtgggcctggacgttgtaatcggctttgaacgcagaattctcagacgaacatgaaaacataaaaagagagtagaaatagaatgccacgctctttgtcgaaacatgaattcggcaataataaaagggggtagcgtacgggacctaaagtggatggatgcagagacaaaggatttagacaggttcaggccctctcaatgagaggtaataccctactcctgtttggggatttgaatccgccgggtgtgtattgatctgacgatcaggttgtctcatgcccctagaggggctccctgccctccttatataggttggggggcagggtaccgagctcgaattcgccctatagt

SEQ ID NO: 28655 - DNA, 153 bp, Oryza sativa
caccgccggcctgcctccgtcgccgccgactggtgtccccgcctatacggtcggttggtcacaccaccattcatgggcgtccacgtcttcaccgaccggctggccttcgccgactggtgtttccgcctgcacggctggcctattatgccgccg

SEQ ID NO: 28656 - DNA, 629 bp, Oryza sativa
gcttggttaatacgcacggcgagaactcttacacgaccaggtcttacatggtctttcgtctctacaggatccgacaaggccttatcggctctgggcgtccccagctgaagatcccttaggttcctcggaggccttgtcaggacggcataaagggacatgaggataggtttcaacgcaaggtgtcatctgggtaaggggtcatcaggcaggaacactgtgattgtaatatgcgcctgaaaataggctttattgatactgtaaggtgtcttacaggtatggattgtattgacttatacatagaatttacgtagttggtcaatgttccaagaatttgccaactcgcggccatcgccgtctgcaattttgaatgcgcctggccgcaagacttgtgtgatcgtgtaaggtccttcccatttgggtgagagcttgtttcgccctgcttggctttgaacccgtcggaggatgtagtcgccgatcgaaagtatgcgtgctcggatgcgcttctcgtggtaacggcggagggcctgttggtaactggctgctcgaacggcaactcgttcgcgatgttcctcgagtagattcacatcgtcgtttcgctgctcctcctgatcctcgtcggaatacctctg

SEQ ID NO: 28657 - DNA, 43625 bp, Oryza sativa
  unsure (1)..(43625): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgggatcaacatgctcaaagggttgtttgggatctgtgtgacttgccttgctggccttggaactcttcaaattcttctcctgcgaaaacggactctccggaaacgtcggaatctaaacaaaaaggagcaaaatcaccaaacagcacataaacaagcatgaacagtacatgtggatatttttaacatgtagatctcaattttagaaaaatgtagtgacttgaaccaactaaatccgagctaagatgaattagttatgaatttttaaagattaaatcggattaaaacacttatatggattttaattgaattatgacgcaataatgaattatttttgaaaaggaaaaaggaattattgcgtcagcggctagggtttgcggtggaccgggtgcacggcggcggctcacggaaacgaacggccgagatcgatcttatccaaaacgaacggccgagatcgaacggtccacgaccgggccacggcggacggcgacgatgacgtcagcggtgacgtcacctccggcggcggctcgagcgcgcaagctcgccggcgaacgacggcgcgaggatgcgaacggagggcaccagcacgtagagagcgacgcggcaaactcaccgatgaccaaaacagtggcgaaagaagaacggacggcggcggcgtcgaggaaaaggcggcggagaccttcggcttgacgacgacggcgatgctccggcggtcaacagcgacggcgaaggagcggacgaggacggcgacgcgacggcgaccacgatggcgacctccccgagcgacggcgatgactggaacgacggctgcacatggctggagcggcggtgacgacggcggcgcgaggctacacggtgctagggcgctaccgacggcgagaggcgaaagcaagggtggcggcgggtagcggcgggcttgggggtccttttataggggttggaaggcggcggcgaaggcccacggtgaccggcgacgcgaaggaaagattagggttcggaggaaagggttcgatccgaatcgaactcgaatccacggatttccaaacgaaattagccgacgattccaaaagagaaaaggtagaggagatctcgggaaacatttcccctcaatcgatttcaccggatcgggaaaggcgcggccgaatttggaaggagacggcggcacggcttggctagggttcgggcagcggcggccgaaggaagacgacgagtccgacaggtgggacccacctgtcagcgacagcgagcgcgcgcgtgagcggctcggctgcggactgggccgacttgggccggggagagagagaaggttttgggccgactttcggcccaaagccaaaagagacttttaaaaacctttttcaattaaattattcatgaaatgcaattccatttattaaaaatacttccttagctcaaataaatcccagaaaaatctaggaattaaagaattaagcaaagtatttaatgaaattttatctggccccattttatattggaatttattaattaaaattagatcttctcttctagacttttaaaataaattctaataattccaattagacaacaatttatatatttaggatttttagggtgtgacattctatcttcagatagagaattcggatcctgtctttgttgttcctgaggaacaaccagacaagatttcgtcttggaccgcaaagcctaccttgacccctgcccttcggttcttcgtcgaggccatcgatgacctccgagtacgaggtttgtcggggtatgaagtcgctgccaacttcgttggtaggcgaatccagccgctccaggctcgagctcatccagcctttgactattctgggccggaggacacgacccgggtttctcctcggggtatttttcttgtgtttgatttgacctccttataggcatgctcctcctggcttaccgaattccggttcttgacttgcaggcttgaacagcgaaacggtggagcgctgcgtcggccaactgatgatcaacagcccgacaacggcaagcgacatccccgtccccctttgtgagaaggaggcggccgatcgtgaaaccgcaatcaacgtgagtgtattcggcgacccctctattcttgctcctggatcggataacgacttcatgcggtgcaggttctccctctgactgacgtcatcggaccgctcgtggatcaccaggcggtggcctcgctaaaagagggtgtcgcgcagggggcatccaacgcggccgctgctgctgcctcagcgactagcgggagctgccccccaaggaggggaaggaagttcacctccgtacttggcagtcgccggaaggcgtcctccccccggtaagtttcttgagccattaaccttgtaatcagaaaagtcgttcctcaaatcatccttggtttactaaggcctccgacgcgtctccgccacctccacgacggcagaagttggtgacgctaggcgagaagtaagtaggtggagattgagttctttcctttggttggagatctggcgactagtctagatattcggatgcgatgatcttttgtaggtaggcgcgagcgaaggcggcgcaggatgggtttggtgagacctccagcgcgtctcctgcagcggtctccactgacgtcgtggtcgccccacgaagtcgggaggcgacaccccacggcctgtccggtgatctcgggcctgttcgcggcccgcctgccgacgtccttagctggggggagctccaagtcgagattgggcgcctcctcgaagctggcgctcgcggcataagttgcgagattgctgaggcgaggacagcggcggcgtcgtcggctaacgagcgcgccgacaagctggagcgcaaactggtggaagttcgcgaggacctccagaagatgagggagctggtggccggcatcgagcgacagcggcggggtcttgaggaccgcatggcggaactcgagagtaacctatcggagctccgtggctcgctgcgagtcactttcactggcctacaccagctcgccgggcaatgtggtgtcacgaccacgatcccggcgaaccccgacgagttctcgctgacgtcttcactcgcagaactggctacggcgatggaggcgataccctccaagcacgcggccaggatcaggaaggagacgtccaacgggatctataccggggcatgtcatgtcctcgcgtgcgtcaagttggcacatccgaaacttgatctccagcggatcttggagcagggggcgacgaacgacgcgcgtagaggcgtgatggaagaagtcggcgatctgggagagtctgttctcccgctctttgaagagtaggaccttagttcccctgtgtcttttctctagttacgctttgtaaaaacatttctcaacctttttgcgtgtgcagtcgtcgctttagttttccccaacattttttatcccgagcacttgttgtcctttgtagagatgtcgatgtcgaggatgtccagcagcgtgggcagcctgagtcatcagtgatccttccggatcttgcatctgaggaacccatgtcgctgaacgatgtggatgaaattttacccgcgagaatggggacggcaacgacttccttaggttggtggtctcttcatcccgtttcgctcctccgacttgattagccgtgttctcgagagagaaaagcagcttgacttagtcgtttccatattaaacagatctcgagaatgcacttgctgaccaagatcatcgtatccaatattggaagacaaaatttgaagtggcggaactcgagagagctatgttggaagtgaagaaggagcaggccgtggaaacactccgaggtcgtgaggtgtggttcaactcgtatctgaagagttgctgcacgtccatggcccgagtttgtagagagctccgagtactccgcggagatcccgaggagtcagcggccggatacatctcatggctgaatggggcctgtactcagctcgaaggcatcggcaagcgcatcgatgaagccctgaagcaggaatgccgtcgatcgagccgatatgctggagggcatgtgttggcttgcatacgagatcatcgtccgcaactgcacctcgagtttctccatgaagggttcgctcgttctcggaggactccggtggagatagaccacctggcgaagtagatggcgccgctggcggagaaggtcttccagtctatggactggcgttggccttcctggtagtctttgtatcctgtgatagatatcttaggaaaaaggtgtaatatagttccggacttgtgtggaattgtaagaagtatcttgtgaaatagaaaagaaatctatcttaatgagtccttcttactctggatgtagtgtgtaagagtgcctcctcagttcccgactttagctagtcgtttgagtcgtacactctccctagcccccagccttgtcgtcgaggaattcttctcggaggacaaggctcttggacctttgacctgcctcggttgagaaagcactgattctagcccccaaccgtgaagttggaaagttaatttctgattacacggcttggttaatacgcacggcgagaactcttacacgaccaggtcttacatggtctttcgtctctacaggatccgacaaggccttatcggctctgggcgtccccagctgaagatcccttaggttcctcggaggccttgtcaggacggcataaagggacatgaggataggtttcaacgcaaggtgtcatctgggtaaggggtcatcaggcaggaacactgtgattgtaatatgcgcctgaaaataggctttattgatactgtaaggtgtcttacaggtatggattgtattgacttatacatagaatttacgtagttggtcaatgttccaagaatttgccaactcgcggccatcgccgtctgcaattttgaatgcgcctggccgcaagacttgtgtgatcgtgtaaggtccttcccatttgggtgagagcttgtttcgccctgcttggctttgaacccgtcggaggatgtagtcgccgatcgaaagtatgcgtgctcggatgcgcttctcgtggtaacggcggagggcctgttggtaactggctgctcgaacggcaactcgttcgcgatgttcctcgagtagattcacatcgtcgtttcgctgctcctcctgatcctcgtcggaatacctctgtattcgtgtactttgatatcgtagctcgctggggagcatggcctcagagccatacacgaggaagaagggtgtttccttgttagatgttgtcggtgtggtgcatacggcccatagtactgatgggagttcttcgacccatttcttgtcgtgtgacatgagcctgtcgtagacacgggtcttgatcccttgtagtactatgccatttgccctctcgacttgtccattgctttaaggatgagaaaccgaagcgaaacatatcttgactcccagcctgatgcagtaatcctggaaatcggcgctgatgaactgggagccgttgtcggtgatgatgcgatgtggtagtccgtatctgcaaaatatccctttgatgaatttgatggcgttgtcggccttgatttcccccgtgggtatcgcttcgatccatttagtgaatttgtcgattgccacgaattggaacctgtagccgccctgtcctcgtgggaatggcccgagtatatctagcccccagcacgagaatggccaagtaagagggacagactggagcgcttgtgcgggtagttttgtgtgtttactgtggaattgacaggctttacaccgctggactatgtcgcacgcatctttgagggcggttggccagaaaaacccttgtcgaaaagctttcccgaccaacgtccgaccggcggcgtgtgacccatagatgccttcatgtatatcaaggaggaggtgtctgccgtcgtcggacgagacgcatttgagaagtaccccgtttggcgctttcttgtatagatcgttgccgatcgtgcaatagattttcgctttacgggttattttctcagcctctgcgtcgtcctcgggcaactcttcgctgttgatgaatttgatcagtggggtgcgccagtcgtctatggtatcgatatcggcaacggcgcgttctgcctctgtggcctccgagctgatgtcgggggtgtctgggttaatttcgccgctgacctctttcactgatggctttgtcaggatgtccagaaaagtgctaggctcgagtggttctcgtctggacgcacgccgtgctagatcatctggctcaatgttgtccttgcggtatacgtgtcggacctcgatcccatcgaaccttttctccagcttcctgacttctgcgagatacttggataattcggggttagagcatttataatctttgtgcacctggttcgctactagttcggagtcccctttcacgatcagtcgtttgaccccaagtgcggctgcagctcttatcccggcgagtagtccttcgtactcggctatgttattggttgccctgaagttgaggtggattgcgtgcttgaattaatctccggaaggagatgtcaagatgaatcctgcccctactccttggctgttgagtgcaccatcgaacgccattgtccacgtttcgtcgtcgatttggttgtctgatttgttatcaggcatagtccaatcggctacgaagtcggcgagtacctgggacttgatggctgttcgtggcacaaagtggacgtcaaactggcttagctctactacccacttcgcaatgcggccgacaatgtctttgtttctcacgacttcaccgagagggaaggaggagacaactgtgactctgtgggcttgaaagtagtgacgcagcttccttgatgtcatgattaccgcgtaaagcagcttttgtatctgtggatatcttgtctttgcgtcatggagagcttcgctgacgtagtagattggtcgttgtactttctctctctcgacagcaatgacggtgctaacagaataaggcgtggcggcaatatagaggaataattcttcattaggttggggagcaacgagtacaggggggtttgataggtagcgcttgagtgcaatgaatgcctcttcagcttcctgtgtccatacaaatttgtcttgcttctttagcagagcgaagaagggttgtgctcgttctcccatcctagcgacgaacctgcttagcgctgccatgcatccggttagcttttgtacttccttgagtcttttgggcgacttcatgttctcgattgctttgatcttctcgggatttgcttctattcctctgccagatacgaggaaaccgagcagcttgcccgacggtactctgaacgtgcacttctctggattgagcataaggcgatatcatcggaggttgtcgaacgtttcccatagatcgtcaatcaatgagtcgcttgtcttagtcttgacaacgatgtcgtcgacgtatgcctcgacgttgttgccgagctggtcgctaagtgcgccctggaccgtgcgctggaaagtattccctacggttatcagtccgaatggcatcttaacatagcagaataccccgaacggcgtgatgaatgctgtcttctcttcgtcctctttcgccatgctgatttggtggtagccagagtaagcgtcgaggaagctcaacagctcacagccggctgttgaatccaccagctgatcaattcgaggaagagggaagtgatccttgggacacgccttgttgaggtcggtgaaattgacgcacattctccattttccgttggccttccgcaccatgactagattggctagccactctggatgaagtacctctctgataaaaccagctttgagaagtttgtcgagctcttctcgtatggcttgttttcggtctggtgcaaatcgccacagtctttgttttactggcttggcatcaggtcgcaccaagagtttgtgctcgatcacctccctagggacccccggcatgtcagacggctaccaagcgaacacgtcagcattgtcgcggaggaaggtgatgagcgcgaattcctatttctcacttagtgatgccccgatcttgacggtcttgtcggggttggcactagagagtggaacgatcttgatcgcgccatctggtttcggcgtcttctttgtcttgctcactttcttgggaggctcagttgtagcgggtgggctgggcatgtgctcgaccatgtcgaggctccgcttgtcgcattgtaccgctagcttggcgttcccttgaatagtgattgttcctttcggtcccagcatcttgagcacttgatacgcgtagtgagatgcggccatgaacttcgcaagtgcagttttcccgatgatggcgttatacgctgtatcgaattcagcgacatcaaaggtgatctgctccgttcggaagttgtttgcttggccgaaagtcacaggcaacgtaattttgcccaatggtttggacgaggactggggagtaattccatggaagggttgatcggtgggtgtcaactcgctttgtgggattcccatcacgtccaaggtgctggcgaagagaaggttgattgagttgccaccgtcgatgagaacccgcgcgaccttgatgttccgaatagtgggttcgaccacaatcggatagcgtccttggatgacggcagtcttgggatggtcttcttccgagaattcaatcttctgttcagactacttcatcttgggtgcagccccctgccatgtcgaacagacttcatgttccactttcttgtattcttgctttgaggagtacactgtggagcctccgaaaatgtgcgagacgtggaggtcagagtctggatatgctgagtccgattcctgaggagtcgcctccgcatccttctcgaccactcgtactcgcttgcctttttccaacgccatgtgcttctcgagcgactttttgaaaacaaggcaatcttccaaagaatgtctgtccgtcttgtgtatggggcaccatgctttctttgcgtcgctaccttgtgggtctgggcgcttgggtgggttcgcgtattctgctgcgagaatttccgcttgagctttccttttcccactcttgcgatttttcttcttgcttgactcaggtgcgtccgtggctggtttcttttctccccggttttcagcttgttgttcttgcatctcagcgcatcgtctacgtgggtgcatcgctcaacgatctcgaataatctccgagtagttgtgatgcgtcttgtcgccaactcctgggtagtatagcgatctcggacaccggacttgaaggcgcgaattacagaagcgtcggtgatttcggggattgtatttctgcactcgttaaagcgccgaacatattccctcaaggatccacctgagttctgtgtcaacgcatgtaggtcgcttcgatcgcgtggcgcttgtaagttccttggaagttggcgacgaactgctgccacaggtttgcccacgaagaaatcgagtagggcgggaaatgcgtcagccatgaacgtgcagagccttttaatgcagttggcagataatttgccaacgtgttgtcgtctgctccggcagcgtagagtactgtggagtagacttgaaggaattcttctgggtcagtactcccatcgtacttctctattgctccgggtcggaatctctcaggccatcggacatcacgcagggaacgaccgaaagctctacacccagcgctaggagcagtgggttgtcggcgatcgtgtgtccttcgtggatgtctgtctgacgatgaggatgaagaagaagatgacgatgatgatggatcgcttggttttggtgtaggattacgaggtcgtcggctggattctcgagaatcctgtcgtcgccctccgttgttgtcccggcgccgatctctgtcgtcctcgtcgttatggcggtgtcctcgaccagtatcgccctgcattcgcctctcacgatcatcatgatcgtggcgattgcgagatgaattttttaagcctaattgtgccatgatttgacaatgtggtgctacagagtacatgtgctaatgacagattaattaggtttaataaattcatctcgcagtttacaggtggattctgtaatttgttttattattagactacgtttaatactttaaatatgtgtccatacatccgatgtgacacgccaaaactttacacctctggatctaaacacagcctttgattattattgacatagtagactgcttaagaaatagtacagttaaacttcaatcaccgcgatattacccggtgcaacgcacgggcattttgccagtatacatataaactttgtatttcagaaatacaaagtttatacgtatgtatataaaatatatacatatttgtgtgtgtgtatatatatatataatttttgtgtatactataaaattgacgtataaaaaatgtacatatatgtgtatgtaaagtttgtatacgcatatataaattttgcatatgtgtatagaaagtttgcatacacgtatataaactttgtatatgtacatattaaaaaccgaaagaaaaaaacacgaatacaaactttgtatatgtacaaatacaaaacttggtatacatactagtacaaacatcgcatacatataacctaaaaaaactggaaaaaaagaaagagaaaccgaaaaaacccggaaaaacccgaaaaaaccagaacataaagagaacagcaaaacggaacaaaaacagaaagaaaaaaaaccggaaaaaaccaacaggaagagaaaaccgaaaaaaaccggaggaaaccaacagaaagagaaaaggaaaaaaaaacgaaaaccccgcggcgcgccgtccgccgccccctctccgcgcgtgacacgtgtccagtcgcacgccctccccgcgcgactgatcgctagataggattttggcccccccccctccccactatctatccgttccccttcctctcctctattctacgccagcatcccgattcaccgccgtgcccttccgcggaggagcaccccctctccagcgccagagaaagagaacaccagagttattgaagtagcacttaatttgtagccaactaattaattagtagcactaatagtactactggatgactatatcaccatactacctcatgcacgtgcagcatgcagttgtgacatgcttgatctgaagtttctgaacttctatctgaaccggccagattttattttagaaaatagattaaaacggggcctctacatataaaacagatgtacacagccaatctaaactaagggtgtgttcgctaacagcagatgggaactttgcacagtgcacacggaaaacggagcagctcattagcacgtaattaattaagtatttgctattttttaaaaaaattagattaatatgtttttttaaataattttcgtatagaaactttttttaaaaaaacataccgtttagcagtttgaaaagcgtgcgtgcgaaaaacgagggagaggggatgggaactttagcatccgaacacaccataaatgaggtgcgagatgccaaaagcgcaagcatatctctccattattcagagttgcagatgaggatgaggtcatgaggaggagaggatcctgaattcctgattcctccagccttggagattgatgcacgagggaggccaccatcgccatcgctatgctttgcttggctgcaggaatgtgcacgacaggaatctccgtcgtcctcctgctcctcccctgcgtcatctacgtcctcttcgttgccgttccggtaggacgcgacagcgcccgagagggcgagaggtcgacccaggagcggcgtctgggtttgagagtgaaaaagacaaaaataccccaacacatataattttttttggactaaaatatccctccacaattctactaccatcaagtgtggtggtagtagaaatacatctgaaccgttcgatcaaatgcgatcaacggttcagattattctctactacagatagaaagcactggagtgggacttcggaagttcacacacctgacaccttttgagctagcgaatgtgttgattgagcattattagtaggattgtttcccttacaacgaaaatggtggttgcatgggggaacgagatgggaaagcaaccactttgaaaggagagtgccggagagacggcgagatcaccggagttttccgacgatcggggatgcgatagagcatgcgagtcgctgggctcccgcgggctggcggtcggcatgggcgaagacttcgcaatccacagagatttcgtcagatttcaggagggagacaggggggtgcagttcactagaggaacctcaacttaacaataaattttttttaatatcctttaaccacaaaatcagaaatatatacccataaactcactcaaaccgtttcagggaggtcccatggcagtatcgactcaatttttacctttttgttaacataacatcctagtaaaaataaaataaaataaataaatatgtaggacccatatgtaagcaagaaaaaaaaagtgagatcaacaatcctagtcagcaatctccgtagagagggagcggcactggcgcgcggctggaggcaggcggaacggcggtatcgacgagcgagcaagacggcggggcgtcggcggcggcaagcggcgagcaagtgttggtggagcggtggcggcgggcgagcgacggctccgggctcgggaggagcagacgggcttgggatgtggggggcgcggtaggtgagtgcggctgcagagggggagaggcggccggagcaggtgaagcggtggcgtcagagggcgagcgcagctgcgatggcggtgagctcgcggcgcgcggcgagatgcatgtgcggcggtgcagcacagctcggcaggcagcgctgcgaggtgcggcgacgcggcggagacccggcgcaggcgcaacggccatgcgggcagcacggcgagggggcggcggccgtgctggcggcgcggctggcaggcacagacgtcgcgctagtgcggggcacaattggcggtggttggttcttcggagcgatgcaggttaaggcgtgcgaaactctgcgtgggatggcgtcgctgtcgtgcagggtagcatggtggccagtcgatgcggtcgccgactcgccatgcgtaggcgacgcggtggctcgggataggggcgacgtcgtgcgcgaggctatgcggcggccgttcagcggcatcagccaggcgtcgtagtggtcgtgcataggtggctcgaggcgtgacactgtgtagggtgcgtccgagtggcggccatgtgtggcggcgtgacggtggtggtggccatgtggggtgtaggcagcgcgcgggcacggctcgagcgatggtgtgcggcagccatgcgaggcgccgcgcggcgggacggtgcgcacgggagagaagagaaggagaagaaaagggaagaaaaaagatgtgcagctgacatgtatctatattgttataggactttagtgcacgatttgcatgtgtttaggagtacacgtttttggttttgtttaagggactaaaaagttgagggacctccagtgaacttattcttttccaggtcgacaaaatccccctagtcgcgtctctcgtgagcgccggcgttccgctctgtcctcgcgactctgcggcggccggcggctccccttctcatgagccgccgccatcgctgcgtgacgtccccctcccacgagccgtcgctaccaccggcggtgcctcccctcctctcacgacgcatccatgccagtgccgcccccttgtcactagccgccgccggcgggcattaccctcccccgagccgtcgccaccacagggcctctccctcccacaagtcgccgccatcgcagggcctctcgtcccgtgagacagaggtgtgtcttctccttctcttcctctccttagggcttgttcgtcacgtggtgagcattttccccaggggaaacgccacctggggggtattggatgaatcccctcccatcacccaatcccctccatcccagggatttggttcccttggtcattcggaatgcaaatggcggggaaggttaacgttcacttcagacattaactcaggccaagcaacattcaacactgatatttaaatttcatatcactaaaaatacaaagaaaactaaacatatagtcctgaaatttaaaaatagcattaccgaaaatttgaaatattgtaaataaaaaactaaaatttctggagaaaataagaaattctgaagactgtctaaaaagattatgaaaattctgaataccacatagaatgtactaaaaattgcttgcatcatatccattcagtcaccacaatcagtcacgcattcacaatacctgatttactcatttaaacatcatatccatcaccacaatcagctaggataagccactgaagactaattacattcatttcatacaaacagaaactaagagtcccaaaaatccaaattctccgtaagtgcaagagcagaagggcattactgcaaggctattagtagctccattacctgctgcgagtgaaaaatgagttatcatcagtgatctgcattaggcattaatccatgctatgaatagaactagccctatattttaattcaagaggcagaactgttttggaatatagtataaaaagtagcagaattacaaggaggaaatatacatcagtagaagagcatttccttgaacaatcgatgtcagaagggaactatttgtatagaaatatatataaatataagtagatcacattagcagtatagcatcattagcaaaataggatcagtgctcaagcttatactgagttcatggcaaagcacaaagaggccgaggggggctcctgagtatttactccgtacaggaaatgacatcgatctatctatgactagacctacagagattgatcgaaatttttacacattccatgtagtagtgcatccaattcatcccaatcctttgaattagcacatctaattaatgtcagattgctaatagtatggaaaaaagaaagaactaatcaagaattatgaactattttctccatatgtttgtaacattatgaactcttttcagccaatgaattaatcaagaacacactaaagtatccaatattcagtctaatgtaatatgcaggttgcagagtttttgagacaactttttacagaacattatctgaaatcaagaacaattaattttcttttgctagtcaaatcaaggccaaatatgataggaataggctcatgaatcatgataaagtactaataaaaagtgtctaaccacagcacaatgtataaagctgtgccctcctttgtagcaaccattattacaattatattgcaacagtgaattaggaaatttttcataaaatcgagatatccaatatatttgatcataagtcaattgttaatctaataaataagagggcaatgaaattctgttacatcactttgtaaaatgaaaattcatggttccacgtgtaaatgttaaatgagctaaaaagaacaaggatatactaaatactgctagtctgctcatccctaacacaagctctatggagaataatgaccagctattagcccagtgatttctttttttgctttaatacattgcaaacagctattgtgtttccgaagaccatatttgacaataaaatctcttaaaaatctgttaggaaacgatatgcaaacaaacgataaaaaataatagatcaatcacagaagacacgagatttaacatggaaaaccctcccaaaacaggagaaaaaaaaccacgggcgtcagccagcaaaatatctttactatatctgggtgaggttacaacgccgcacggcgacttacaagaggtatatatatggtggaaccctaaaagggatgacgatccgtttcgcgggggctccgccctcgcacccccgggcgtccccaggtgcacgacccaatgggccagcttcagcctccgctccactacggcagaagctggcatttattaagtgcaaatgaatttggatcacaactcaacaaactccaccttgagacaaattacttcttatagcatgaatcaatccttcaccctgaacacaacaaagataaaaaacactttcagcgccaaatagcctcttgggctaaaccactatacaaactaagcttgagcaaagctcaaacttagcaacaggaacaggctttgtcatcatatcagcaggattatcatgagtgcttatcttgcatacctttagcttaccttgcacgactacatcgcgaacataatggtacttgatatcaatgtgctttgtcctctcatgaaacatctgatccttagtgaggtatatagcactttgactttcacaaaacaagttaatgcaagaatcaactccacaaagctcagcaaacaatcctatcagccaaactgattctttacatacttcagcaatagccatgtattctgcttcagtggtagactgggcaacaacaggctgcaatgttgccttccaactcacagcacaactaccaatggtaaacacataacttgtgagtgaccttctcttatccaaatcggcagcaaaatctgaatccagatatccaacaagccccttatcagtcctgccaaacttcaagcaagcatcagttgtgcctctgaggtacctgaaaatccactgaacagctttccagtgttctttaccaggattagccatgtatctactaaccaaactcatagcatgagataaatccggacgggagcaaaccatgacatacatcaaagaaccaatagcactagaatatggaactctagacatgtattctacatcatcatcagtactagcacattgtaaagctgataatttaaaatgaggtgcaataggagtactaacaggctttgcatcatgcatgttaaaacgctgaagaaccttcttaatgtagctttgctgactaagaaataacaaaccagaatttctatctctagtgatttccatacctagaattttcttagcagcatcaagatccttcatatcaaactcactactcaactgtttcttcaatgtagtgatttgttccttgctcttggcagcaatcagcatatcatcaacatataacagcaagtatatagatgatccattaacaaatttaatatacacacatctatcaaattcagaccttttaaagccatgtgacaacataaatgaatcaaaccttttataccattgatggggggactgtttcaaaccatataaggatctttttaacatgcaaacataatcctccttaccagctactatgaacccttctggctggtccatgtatatctcctccttaagctctccatgaaaaaatgctgtcttcacatctaactgctcaagctcaagatcatgcatagcaacaatactgaagaatgtacgaattgaactatgttttacaactggagagaacacatcattataatcaacaccagcaatctgactgaaaccttttgctactaaccttgccttaaaccttggaggctcgctgggagataaaccctcctttctcttgaaaatccatttacaacggacaggcttcttctgttttggcaagtgcacaagctcccatgtgccattcttctcgagagactgcatctcctcctacatagctgagatccacttctcacgatttccagaaacaacagcttcagtgtatgtggctggctcaagagtattctccacctgttcagcacaactaaaagcataataaaccatatcacattcctcaataaggcggactggagctccacaactcctctttgttctgcgatgtgcaataggttcatcttgtggctgcaaaacaggaggtgagtgctgaacagtatcatgaacatcattaccaacaatttcagtttcctgatcatcacgtgctccacctgcacgttgacatattgctgctcctcatcagaaccacctggtatgacatctgtgggcaagctgtcattaaacataatagattcattaaaaacaacactcctactcatgaaggtcttattagtttcaggattccataacttatatccttttactcctgaaccataaccaagaaacagacacttaatagctctaggctctaattttccattatcagcatgagcataagcagtgcatccaaaaactctcaactgtgaatagccagcaggcataccagaccatacctcaatgggagttttcttattaagtgggatagaaggcgacctgttaatcaagtagcaggcggtgttagcaacctctgcccaaaaacgcttgttcatgcgagcattggacagcatacaacgagccttggagatgatggttctgttcatgcgctcagccacaccattctgctgtggagtgtacgggatggtgtgatgccgaacgatgccttccttcctgcagtaatcatcaaaagcatctgaacaaaattcaccgccattgtcagtgcgaagtacttttacctccttttcagtttgcctttctatcataactttccactctttaaaaacagcaaaagtatcatctttatgtttcaggaaataaggccacacttttctagagtaatcatcgataatggtaagcatataacaagcgccactaagagagggcttacgagaaggcccccaaaatcagcatgtacataatcaagtatacctttggtgcgatggactgaggtattgaattttacctttttatgcttaccaaaaacacagtgttcacagaaattcatgttaccctgagtgcagccatccagcaggttcctcttcatcaattctgccataccaagttcactcatatgtccaagacgcatataccacaggttagtcttactaggttcatctttagaaacggcagcagcggtaacagaaccatgtaatgtacttcctctaaggacatataagtttgcagaattcatatcaccaatcatataaacgagagaaccttttgatacctttacaactccacctgaaccggagtatttgtatccttctgcatcaagtgtgctgagtgagatgagatttctcgccattcctggtatgtgtctcacatctttcagcgtgcgtgtcgtgccatcatgtgtcttgatctaaacagagccaatgcccacgatctcatgtgggttatcatctcccatacacacaacatctccattctgcacagacttgtaagaactaaaccaatctctgttaatgcagatatgaaacgaacatgcagtatcaagtatccattcatcatgactagcaacacaaccagcaaaaacgacaagacaatctcctgaatcagagttttcggcactggtaacaacagaggccttaccatcagattttcttttctccttattctgcagcttccaacattcttcaatgaagtgaattttctttttgcaatacttacagaactttttacttcgggacttagaacggcttctactctagctcttgtcacgatcattgctgtcgttgtaggttctttgttcagatctgcctctgacctacaatgcttcgcccttagaggacgaggcatcagactgaaccataactttcatcttctccttgttttggagtgcctcataaacttccgcaagggttagttcatcacgacttaaaagtatggtgtcacgaaaatttgcatatgaactaggcagtgaacataacactagaagacctaaatcttcatcatcaaaatgtacctccatcgacactaggtcggcaacgatctccttgaagaccgatatgtggttcaacacagaaccactctcctgtaacttgtgcgagaacaacttcatcttgatatgcatcttactggttagatctttagatatgcagatcgattccagtttgagccaaagttctgcaacagtcttttcctacaacacttcttgcaaaatatcattagatagatgaagttggatcagcgacagagtcttacgatcttttcgcttctcctcagcggtctattcagtcgttttcttcttcccgaagctttccagcgcctcatcaagatccgaagtttgcgctagaaccatccgcatcttaacttgccacagcgggaatctcgtcttgtagtctagcagcggtagatcatacttcatcgacgccatcgtgaaaccctaatgtggaaacaatgctctgataccacttgttaggaaacgataggcaaacaaacgataaagaacaatagatcaatcacagaagacacgagatttaacgtagaaaaccctcccaaaacaggagagaaaaaatcacaggcgccagccagcaaaatatcttcactatttcggcggcgtcaactttcgccttcttcgttgcccttgtgcgggcagacggtggagcttggtgggaccttgacttggaaggtgccggacgaggagcttgaggaggagttgacgcaggagcctgaggtggagacggtgctggagcctgaggaggagatggcggagccagaggagatggtgcatgagacgccgcttgtcgcctagggaggatgatgtaccgcttgcgccatagtataatggcgtggcttgtgtctcgtagatgcgtctcaccgtctcctccagggtagtccaactcgaggtccttgtacgcggcttccaccaactcaacttcgaccttcgagtatcctgctggaatcggcctgcagtggtaagtccctgaagggtccgttgggatggccattcccgacgccaccttcacgtggtgagaggttatctattagtaatcaacataagcagcaacttgcggaatggacaagtcaaaaatcataaaattacgagcataccttgattgataagttcttgaagggaatatgcagctcacatggtgtccgctgagtgatctcatcaacggggcaggtggtttcgtcctgagtttgcatggcgtccatgctctatgatcctacctgtcccgttgaggcacagctgctacgattgcctgatgggctgaccattgcaggaggaatgtacagctggggatcttgggaccgatgtgcggacatgcgtttatccaccttccttgccacctcctctttcatgctgagctcatagctcgataccctgtacttaagatctgcaatcttcgcctcggtatctctcttgctcctcatccgactcctgtacgtgtggatgtcctccttgaatccaatcttccaaggaatcacccctttccctcgtgttcgtcctggatgctcgggagtctgtagggcaagtgacagctcgtccttctctctgtcgggtcggaacgtgccctgagaagaggcttccactgcgtccgttagtcgactggcagcctcgcgtatctgatcgctgaagaccagggagccatcaactgggttaagcgttccaccatgagcatagtaccagaacttcgatcgatccgaccatttagcggtggccggttcgatacccctctcaagcaagcttgcctccatctcctcccacttcggcatcgcgacgctatagccgcctgaccccaagtggtgatggtacttcttcttggcggcattttctttgtttctttccatcatcgcctgcccttgttgccctgtcttgtaagcaacgaactcgtcccagtgatcccttagcttcgggaatatgttgaagttcgttgtctgccccttcaggatgtatttctggtagagatctccctcgaagctctgaaactgttctgccattttctttagagtccaaccttatgtgatggcataaggttgtagaattgagtccaagatctgcttattaattcatttcatctgtgctcattgttttcgagaaagaattatgctcttattataaaagaagggattgctcctgtagatttcttaagactatattatctagtacttctgttgttaaatccaactacaatgtacatgaaaacgcacatggaagttagagaatctatttaattcgtacgaacaataaacatttgactatagtggtctgccgaacccaattccgttctacctatatatgagcagccattaattgttttgcttagtttcagcctaagtggatttttgttgccccatagtccaattattcttgatcagcgatgatcatcaccatctctggttctgtatcctggtttccatttgcgatgatttcggctaactgtcgttacaattgttgtttatttttgttcactgcattgcagagtggaggaagaaactggtcatagtatattaatttgggcgggaatcatggctggtcgattgagggaagattagttttgttttactagcagtagtttcctgtactgtatcgagtaaatgtcctgttttactaatcttcctagacaatccttctttcggcatactttcttcaatttgacaaataatactatgcatgtatcctttctttagttctctctcggaaacttgttgtttcaggaagctatactagctgtagcaaatagctgtcatactaaagctgagttcggcatatggggttgggaactaatcccacccgtacgcaaaacggagtctaattaggtattagctaatatttttgaaaaataaattaatatgatttttaaagcaactttcatatagaaaacttttataaaaaatacaacgtttacgcgtggaaaaagagaaagatgagttgggaaagaagggggaagaacacaacctaagtagttggttcacttcgctatacactgtcatattggttctggttcagtcagtaagtgcccataatctatgttatgacactctgcattctctcttgaaaacgaacatgcttttctatttattttgatgatgccatcccagaacaattattcttgtaatggagaggatgattgggagattcaagatgccttattggatatggttggcacacatgcatttcatcaagtttttgtacctggagaacatttggcagattttgtacatacttttatccaatcgtgatataagcaaacgctagctagcatgggttctctatagtctggtctgtagacttcagccctatttatttgattactcatcattcgttcttgttctagacattataaccttgtatgaaatactatagtatttgcatgtgttgatgcatggatgtcattgatacttcttcgactttgatgatatatagtgttgttacatcataaagctcatcatgagctcgtgatctcgtgatctcatgatctcagtatgttttttttttttgaatcgatctcagtatgtttttagatcaatttcttttatgatcttgtaaaaagtacatcattttcatatgactgtattttctatattcttgttgaatatttttatttttatttttattctagattttctgctgttttttttcaatttatctagattttccctttttattttttctgcgatttttcttatttttcgagattttatgtgatttttatttttttgttttttggctacatggaaaatttcccatagcatgttttccaaaatttttcccaaggtctttttcccttggctcccaaatgagctctcactcgattaaccttggaccacgcacccttcaaattcaagcttccactaaaattcccccatcacaaacttacctccttactggtagcatctttcggtctaagtacaggaatttgtgtgtggttttggtttgctgttatggtggcgtagtgggttgttctgtgcatctattttggttaattgaaagcattttgttcaactaacaccatgtgatgcgatgcacctgttggtatagcctgcgaggaaaaaattcctgataatgagaccatgatttcctgatacaagcatacatgttatgcatgctaaaattaaaccctttatcttggcactacctacgtactccctccataaaaaaaaagtgaatctaaaactagatgtgatatattttaatacaacgaatcaaggcacattcaatactaggttggtttttatgggacagggagtatatttgactttttgtattatccacggatcttctcaagagtaaatcttaatcttctctcttgaaaagaaaggcttatctctgtcctaggtttgtccaagttttggtccggatatcaccaatttaactcttttgagtcaatctccaaagacataggtcaaacccaatttaaagttcaaaatcttttccaaatgccctcgcaaaattccctcaaattcaaatttaagctcaatttcatagatcaaattaaaatccaaattctcttactttaattcttcaagatttgcatgtgtgcgcttgttggagtgagtgtgtgcgctattatttttctagaaaaaagctttttgtaagttcaaatattcctcaattaaagatctttgtaagtgcccaagtattgaagatctttcctcaattcaatttcccatgatgatgatcgagagagccgcaccgacgcttcagcgagcgtactcacgcgggatcatcagacgtacgcacgcggacgtcgcacgggtatcgcacgaccgacaatcggaaatatccttatttaggttacgttattacgagttcgctaattcgtgcgagtatttcataattgcaattggccaatccgtgtacataaatatatatagtgtttaggtgaattttttatcatgatcgattagaatgtttaagtgaaacttttcaacagaatgtttaattttaaaattgaaaattttgaaaactttcaactcaaattatgaaaactttccaacagtaattgaaactttcaactcagaatttaaaaagttaccactcagtatttgaaaacttcagtctcacacagtagcaggcaaattagcgtacagcaaaatgaatcaacactagcacttgagtccctagaaagacttatacgaattgataattgcagcgtcatcctgcttccagctaccaaactttgtggattcacatcttcaccatcgccgttatgaaaatggcgctcagaacagaagctattgcaatccgtttcacgactagctttattctgtcagtaatggacacacaaaggcaggagatgagtttagaaaaaaaaaatgtacagcacgttacatacatatattatactattttagtcagcaaaagaaagaaggcattattaacacgagattacaatcagtagtgcaaatttacttacccgtaaccattaactaggtgcttaagttcacggtatggcggaagctgcctgagtatcctttcgtcctccaggttggagttctcaccactatattccagctgcgatagcagatggaacagctcgattttcttctcctcgacttgtgccctaaggctagcaggttctttgttgctgataccagactccccgttcacagtaggttctgcgtgaggaaaatgccggtcataccaggtcttgacttgtggcctaatgctcgcagggatacgagacagctccagctccacatccacgatatgttttgattgaggcaaatgatcatgctggccatacaaggagttgtcagcatgaaggtagaaaagatatatatgagaaaaataaactaaacatattcgatcaaagttgtcagcatgaaggtagaaagcttgaatgcttggttcaaatttgttagctaaatttctaatgatcaacgagtacatgaggcaatttgtgcacaaggttagagaaggaaacatagagtgcaccttctctttattaccaaatttgttagctaaattttcttctaatgaccaacatgaatagcttaggcagctttgcacaaggtcagagggggggagtgcgtggaatcatttcagtattaacatttaagcaggtaatattgaaatcgatgtcctaaaaagctgtatgcgggtagaataaggaggattgtctcctcaatgtccttatagtttggaactaaaacctaaaactaaaggcggcggagaatgaagaaacataccctacttcaacatttaaagaagagccttgcaggttaatgacaagatcggcttagaaaaagggaacagctctagagataatgaagctcgaagtgctttccgatcaatcagtagcaattaataccagttaaatcataacggacggggcctagatgagtttatagtactaagttttcactactgtcacagggaggtgttgtgaggtagagtgttgtttactattgtcattcatctcatgtgttgttactagaggggcttttagcaagctagctcagatgatttagcttcaattaatataattctgctttctacaatttaatccatgttacttgttactaagctcctaatctggtcacattttttttccttggtagtgatgaagtcctcattgggtggagatggaatgacaggaacatcaactttaaaagaaatagatttgtgaccatgtgttgtcaatagagcaatgttatatgcaagtttgtgtgtaaactgtagttagtatatgatgccaactgctatagatttagtccagttgacgtcaactacagatttagtcgagttgttgcccatggagtaccaaaggttgtgttgttaaattggaggtcattaagtcaaatgtttgcaatggcaagcactaattacttattctgcttgttttaaaagtttgagaagtttttcttgtgactatattggaatggtttactggaataattactaactgaaatattttggtcctattttatttttttcacgcttataagttagtttttagaaatatttttattttctttaaagtttttcaaattttctgtgggttgtaatttttgaccttgtcatactatttaaattcgatttttttgtgtatattaattcaaattttgggtaacattactgctacaatccctgaatgttatttaagttatgaactttacatgagacatttctatgtgatccaaacagtaacgattcctacacccacagtggagatggattgggaggggattaacccaatccccccacctgggtgtatctccacagggaaaattcacaatcccccaccagggtgtatctccccagggaaaattcacaatcagcagcaattaaaataccagttaaatcttaacggacggtgccaatcgtgtcattaggtcttaaaattgttcagttatatttttatttattccaaatcgatagataccaaacaggatagctcgtcatctattgccgagagaggacgacggtaaaagggaaatcagggacaaacgagcacatacctttttattgtttggagcagctccggcggagctgaatgagcggaggagcggcatccggccgccggcgccggggataagcctcggcaacaaccgccgttgttcctctctaaccgccggcgacggcggtacgaaagccgtcgcctgttgaagggcgcgaccgctgaccttcctcgccgcaaatcgaagcgccgccgccatggacgattccgctgcaagatccctgggcggtcggttcctaagctcctatatttactccaattcctcgatccctcctcagatctgaatttggggccgcaagacaccaggtttgctatatatgtacgcacactatcagatacaagtcggatacaaggagccgagaccgacgccgtgtcgtgaccaacccgcattcgacttactacatatccagtccagatacaagtcggaactcggtaagtaattactactatttcgtgaacaacttatcttgttatcttaatactaaatatcaatcttatcttatctccatctatcttctctgtacatgccaatgcgttgcaacggaaaaatctaccacgccttgagaatctcaaatcggtaagaatcaagtctaatttgatatattaccaaattaatcgatagaatcgagtctaatttgatgaattagcataggatttagaattcagccttagatttatttttcgagcctacttagaaatttatccaacggagtttaatttaaaaaatatgaaccatatttgataaatattttagtcaaaccagggaattacattgcaatgtgacggaaaaaaaatcatattatataggtacacacaggatgatgtgacgaacaataacaactaatttcaacactggtgagaaaaatattgacaaattaaaacaacaatctctgaattaaacatcgagtttaaaaggaaaaagttcacaataaaatgatattgcactttgataacatttattataatatactctacaagtacagaaaaggtaaaggaaatcaaaattggctcaaaataatgccaaagaaaattctgtaaatgactaaatgaattaaatcaacaggaattaaataaaatcttatttcagcccattacttccgtaactggcccaaaatatcggcctgacccattcagcacgagcgcgcagcaagcggtgcgcgacccatctaccggcgatagctcgatgcaaggcgaactgagtgcggcctagttatcttccgcggcccaaagactgcgtggcccaacagcagtggtggctagacgcggggccgatctgagccgtctgatctgatggacggctcagatcggtcccgcgtcgatgaaatcatcggccggaggggggatgggtccgaaaaccttaaccctaatcccctttctcacctactctccccgatgcaaactctggcgacgcgagagagtggatggcggtgatggtggtgacgacggtccgttgaggtggagtacgcacgcggcagcgagcggctatggcttcacaggctgggaggcgctcccgagggcagcgccatgcgaagccacggcgtcgggggtccgacgaagcgggtgcgcaagtggcgacgggctccgagagcggccgggcttcgtcgatggagtgtgggggtggggcgccaagccaacgcgaacgcatgggacagaggaggaactcctagatctgcgggctctaggagcttgacgcgaccacgaggaggtgaagtgtgcggcggtgctgcttctcggcgagacccacacagtggtggggtttgccggtagaattagggctccaaatctactaagaatccaaactcgagcttaattttcttactttgatttggttttggatttgattcggatttcggggcttatgattcttttcaatttggggatttcgggaaaattgaaaccgactgatctcattcttcccttcccataatttattaattctactgacataaaacatgaaatttaaaataagtctaaacatagcagtgcattatgaaccctaattcaatattattaacttaatttgaacatgaacaggagctaatctttactaagcagtaaagataagaagctaaacagattagattaaacttatttgactcaaaattgttcatctcgaatcaagatgggaccgatggcttctaatcatagggatgatgtgaataaggaattgagtaggttaaagttaagctctgacagcacaatgttagagttctaattcaagatcttattgttttaacctataagcaatcacctttcaattacgaaaattaattctctgacctaagatgaagccattgaagtcgatgtctggtttagaaataatttcatttagaagctgaaataattttttagcaactttatttggctaagaaggcttataaacaaatttcttaacattataagcattaaaattggcgggatttagttaaatttgcttttggcccacgtcttccgaagccaacccgtcttcgcgcgaatgcactgtgtagcggggacccatcaatttgatggcccgcaagtcaagcaaacaatcgcggcccacatacgcggcgacgacccgatgcacctccgcgctccagtggctgcgtaattagcagcggcggcgatctgacgcggggcgaatctgagctgtccaatctgatggactgctccgatcatcccggcgccggatgaagcgtgactgggagagaggggcaaaaccgtagctcccaaatccttctctcctgatcctctttctctctggcgacgagcgagcggaacaacggcgaaggcaacgacggcggtctggcgagctggtgtacgtgcggtgacgaatgccaagcggctcctacttcaccggctaggaggcgcacccgaggacggcacctagccgtgtcacggcatcgatgatccggtgaggcgggcgcgcaaacgacgaggtcctcgtcggcggggaggggggtgggtgtggggggagggtgcgacaccaagccagcgcttcccgtctccggcaagggacaatggcagggtgctccaggacagcgcgtgcacggggaacccgacgcgactccgaggaggtgaaggtgcggcgatgccgcttcccggaaagctccggttagcttaggggcttcaagtctggtaaataacccgaacccttaccataattgatttggattttgactcttagggttcttacctgaaattaggatcttcgaatttgggggaattttgtcgggaaatttcagtctattttattccctcttctcgagtttggggagtttcaatctcgtttatctcctctttaattttgggaatttcaatctagtttatcccttttctcaatttggggaagctatttgtggacccccgtttttataacaggaatcaaacgtgtaaacagtaccatttccctggatcaagtagtttggtacacacgaattcatacctgaaataccaagtgcacatacatgagtgtctagtacgaattattacatcataagcccacaggcatagttttaaatcatcggaccgagcggtccggaatacatcccaaaaatagaagtagataaggcagcggagttaaggcagcggcacgccattgccacaggcaacgaccgtaactaagacctactgagcgccatcgtcttcatcaccctcctggtagtaagcgtagggatcctccgaagcttcatctctgacctctaattaagtttgtatattgcaagggtgagtaccaaccgtactcagcaagccaccacagcaacaatgcacatgacaggggtattcaaaggatggctatggttctttttgcgcaaagcaggttttgtaattcttttcatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaagaaagataaacggcgcagacggctccacttcacaggcagcttgaccaaggctacacctaatcctccacaccttcagcatcattgtagaactcttcctctgatgaatgattgcaaggtgagtatatgacatactcagcaagccacgcagcaaaaatgcaagtgcacaggataacaaaggatggcatagtagggtttcatttgcaaaagcagcatttagcaaatatttcagaatttaataaaacagttaagtaataattaaacaatattaatccaacgctatacaacataccctgttgcataggcccaaccactctgaacaaccatcccggccgcacagttctatctccaaaccaggaatataccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatcaccgccacttctcagtctggtgccctgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaataattaattaaccaatcacgattgaccatcgtgaactatcattaagccatcattaaataatagtgagtcataaattatcccaatagtgagctaatgtttctaagcagggctaagcaattatatctaatatctagttgaaccaatatatataaagctcaactagtccaattatattaacccaaggtatcaaggaataaagtaatcaagaacaaaagggctataacaaagaataggttaattccacccaatgacattcgaaaataaatgcaatagttgaatagaaacaatagctttaaataggatcaacatgttcaaagggttgtttgggatctgtgtgacttgccttgctggccttagaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaattcggattaaaacacttatattgattttaattgaattatgacgcaataatgaattatttttgaaaaggaaaaagggaattattgcatcagtggctagggtttcgcggtggaccgggcgcacggcggcggttcacgcgaacggacggctgagatcgatccatccaaaacggacggccgagatcgatcgggtccacggcggctcacggcagacggccacgatgacattagcgatgacgtcaccaccggcggcggcggctcggcggctcggacggcgcacgcttgccggcgaacggcggcgcgaggacgcaaacggagggcaccaacgggtagagcgcgacgcggcgaactcaccggtgaccaaaagagcggcggaagaccaacggacggcgacgacgacgaggttgaaacggcggcggagatcgggtcgacggcggcgacggtgctccggcggtctccgacggctacgaagaggcggacgaggacggcgacgacttggcgatcccgacggcggtcttcccgagcgacgacgatgactggaacggaggcggcgcacggctggagcgacggcggtgacggcagcgctagggcacacggcgctagagcgctacgggcgacgagaggcgaaggcgagagaggcggcgggtagaggagagctcgggggtccttttaaaggggctaggaggcggcggcgaaggcccacggcgaccggcaacggcgaaggaaacttcgggaagaacgaatccgaaacaaactcgaatccatcgatttccaaaccgaagtagaggatgattccaaaagagaaaaggtggaggagatcccggagattgtttcccctctataaattcggccggaaacggaaagggagcggccggatttggaaggaaacggcggcggcggctcgctagggtttcgggcggcggccgacgcgaggaagacgacgactgacaagtgggacccacctgtcagcgacagcaagcgcgcgcgcgcggctgcggcctgggctgggccgactgggccgagggagagagagaggaggttttgggccgactttcggcccaaagccaaaagaagactttttaaaacctttttcaatttaaattattccttaaatgcaattccatttattaaaaatacttccttagctcaaataaatcccagaaaaatctagggattatagaattaagcaaagtatttaataaaattttatctggccccattttatattggaatttattaattaaaattagatcttctcttctaggcttttaaaagaaattctaaaaattccatttaaacaacaatttatatattttgaattttcagggtgtgacatttcacaagcctaagacctagcacagactgatcaaattttagtaccagtgttcatattaaacaatgacggttctgtccaccatccattgtgatcccaaggatagcttcccgccatcgagtcgtcatggttttctgaggacgtccaccttcccgcctctcaggaagtggctccatcagcatagaaatcattatgcaataccccattccataccagttaagaattttgagtctagccaagtgtaatacatgtcccggtgctcaataaccgcgagcacggctattcgaatagatttggtttactcacactgcagtggatgtacactttacccgcactccgcgactgcccaatacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctcacacacactcatggcagtcctaccaatggcgacaccgctgtagggcacgcctctcggccctacctcaacgactgtcccaccgtagcgcacctgcctcgctcaggggtgaaccatctatacagggatactgcctccgctcggctatctaatccgctaggtctatacccatacgagaagtgcggttgtacggggggttgtttcatgcttaacttcatggctcggtccttaattgaccggggacggtactagccctttccagataccacccaaatcctccgtccgccccagtcgaaaacagttgtttagttttatttctcctttcgcaaatcatgtcatcaatatcatggcaatgtggtgctcatgtctccacatgccgcatctcaattaccttcccaaaggtaattgcccaagcatatagcatttgataaatatgagtatgcataattctagaatagcatttctaagcatttgtcatagttgactaggcactcatacgtaaacatggttacgaaggaataaggggtaaacaataattaaggcatggcataatcgcaagtaggatgttcatcattgcatgcaattttatttgtaaacaaaacaatttcgcaattgagatcaacatgtttaaggaatagtgatgacttgccttgctcaaagtcttgcgggtcttggccttcgcttggatccgcaattccctcgggctctatagttacgtgcgaaaattgatttgaattcggttagaattcaaataaaatccaagtaaatccaagaagatatcaagcgcgaaagtcggtttcatacattatctattttcgttcgtgaaatagagctacttcgtttgtttaactccatccatccccaaactattttgtagcataatcattttactagcgcaagtttttaatttaatccgcccgggtattatatccatataataggttagaaatttctatcgcgagctaaatatcggacgaaatccaagaaatattatacgatttaatttagtctatgactaaatgattaaatataatacatggctaaaatccctagtaattaaatccgaattttctatcgtgaattgattacttatagagattacccaaaaataatctataataatctataagaattcatctatttgtttagttattaattacatctaaatcactaccgcgaattgatttcttatagaaattaccaagaataatccataatctatattaaattttgcaattcttcgactataatcaacctataattaaattctaattattttaaatttctaagcctccttaacctcttatttattttcctttttctttttttttctcttctctcttttcttttctttttctttatcttcctctcttttctttttctttttccttctctttctctctctcggcttctcccttcctctctctctcccggctctctctctctctcccttcccgaggctgcggcggcgacagcacgcatggcgggggaaagggcggcggcttaccgacggcggcgacggcgacggtggtgcaaggcggcgatgcacggcgcggcggcttcgaaggcggcggcgcggcggcacgacgacggcggcacgtggagaagggggagagggagaggaggagggaagggagtggggtggagaagggggaaggggccgggggcttttataggggagagggggagtaaggggagagggaagagagagggggcgggtgacgcgacggcggcacggcggcgcggggcgcgaggcggcgatgggacgcgcgctcggcgacgggacgtcgacagcgacggcgacagcggcgacgtgacgggcggcgacggcgcgcggcggctcggggcgcgaggggacggcggtgcggcgacgcgtgacagggcacggggcgcggggcggtgagcgcgcggcgcggcaacggcgatggcgacggtgcgcggcgcagcggcggcggcaagacgcgtcggcgacggcagaggagaggcggagcgacgcgcggcgcgcggggcgcgaggcagcttggcagaggaggggctgggttaggggaaccgcgtcgagcacctagagtgcaatgaacagtgcattttcctatttttctcattttagtctatttcttttataaatttgattccacaattcctaatctttgcatatatgaattttactcaatatttgtgttatcttaattaatgcattctcccgagactaatattacccatattttatataatttatttgaatttttaattagggttaattcttattccatcgcatttaaatttaattgacacaaatatggtcgtggtaatattttatttatttcaatccacacctaatctttattttaaattataatttatttatttctttaaccaacctaatttcaaggttaattcctaattaatgtttcctctatttgtaatcgatgaactccgagatcaaaatccaataaaatcatcgaataaaatcggtatgatgcaatttatttaaaaagttttcgaaggcccacattttttttagagtttagatttttgtcggtcaaattttcagggtgttacactattgaagctgatgtctggttttgctttttggtttgtcacctcttctcaatgccttttcacatttttatttgtaacttgtgcggctcaggggcaatccagatagaattcttagtttgttaccaccgatcatggtaacatttaaatctatctcttattttcttatttgattcgatctctgatctcttttttttttttgcaaaattttatgtgtgatgatcggaaagttacgtattttatgagtagttcagattgtattatactagaaaacatgcccatgtgttgcaatgggaacaaattttgtaccaattattaattatattgtacggaatgatgttaaatattttaaataatgatacaaaatggaattgctaaatgtccattggtagaaatttgggtcaatatcttgcaaatttctaacattaggatttgcttcatgatttgtgctttggtgatccctggtccttttcccccagcttcagcgatcaacgatggctcgacgagttagggtttaaggtttcgggttagagtgagggtgggaagggaggttgggggagagagaagatcggcgagtataggcctgtagggggatggtcgtgggaggcagtggaatgggcgggcggtagggcaacggcggcgcctcaaggtcgagaatgggtggtgggtcggtgctagcgttaggggcaaagcagaatgacgggataggaggtagcggtctatggtggtggatccgctgcgcgggggcagctcaacgccgctggcttgcggaaaaggagaggaggggagggaaaggaagagggggacactcgtcggcactgttgacgcatttcagccatctagcaaggccaaaaggcgacgtgctagggtgacgacggcggcgcagaagggggagtcatgatcggtgctggtgatagtggcggcaacgtgaggagggggtcaataaagggagggaagaacggggttttagggttttgttgtcttgcacgtatctcaaaacaatccaacggttcaaaattcgcattatttttggggtggtctctagtcaaatgatatgtcatatgggtagacagtaaaaaataaacatacatgggcaatcgcactgctaccgctataacccaagttgagccagccgacgtggacatgtattgcgcaccatttgctgcccatcgtcagtaactgatcaataggctttggttaaaacttcggaaagcaattgagtaataggattgtcatcaatgctttttcaagagcatatggttgtagtcatttagacctaaacttgttgcaacaacgtggtaaaccataaaatacagaaaaataataataataactcctacaaggaatctgttaatccatgatgaaaaatttccgtcacggatcatcaaaaaaccgtcactatgcagcatctgtgatggtttcagagatggtcacggattgagcgtcatggattaacctctatgacgatttaccaaaaaccatcacggattaatggaatcggtgactgttttaaaccatcacgatagagcccgaggcctagttagcccagcccaagttcatttctatgacgaaaaataaccgtcacggattgaatgccacatcatcatggatgcggacatggttgcttacgtagacactacctcaacctatttattaacaggccaaaatcaaagatgggccaatttttagcccaatttcatccattttcgcagctccttttcagccattttggcagctcattttcaatagctttacaacccatttcagcagctttgcagcccaattttgtcaccattttttagtgcccttttcagcccactactacatcgcttacagcccatatatacagcctaatttcacaactaaagcccatatacacagccagcagcaaatcaaatagaaatatcatttttccattcaatatcatatcacatgatttttcatccaacatcagattacaacattcaaagtgcatacaaccttgcagtttaccatggctcaagccaacaacaaatagagattccaagcaatgcatacaagtctaggagcttaatgaatgctgcggcagcaaaatgcaagcatgtatagcttagcttagtcaaaattgacttgacacaagttagcagcagcagcaaaatgcatgtagtagcaaaagatatagcatcatgcatgaattaacttgatcgaacttgactgagcaaaagattaagtttcgcttccatctcagattgagtcctcttcatcgaacttgtagacagcttgttttccatttgagtctagcaagcaaggagcaaacattgttgttgatgagagaattaaaaataagcattacaaagagcaaaaagtttgaaacttatcttacaatagcctcctatacagcagtggtgtagcaatttttttttcttgctgtagtggaactccttgaacaaatcaaatgcattaggttcttcttcattgtatttgtcaccctgaaaacaacatatatgcattatgtccagcaaatgtgtacagtgttgaacttaaaaaaaaggatgaatctagatagcatcaaatcaccgttgagctgatcaaatcaagcatgatccatggtatcccccaagtaagctgttttctgcacctctttttctttttgttggcaaatggattaaaacactattcagttttgaagatctctgaaaatagcagtcgaagttggggcgcttcaccaatcaccagcgcccctctcacagtagcaaatcccgcctccgccctcctgcacatgggtgaggcacatgcgtcaaaactcgccaagaaaactaatgcaagaaacaaagaaagaaaggcataaagcaagaattgaagactggcgcctctcctcttctttttcatccgtgtcaaaccgtcctggcccaccatgatcgcctgccgtgctccctatgctcacgcgtgcagcagtgcggcgtcctcatcgagcagcctctcgatggacggagctcgcgagatgtaggaagcaggcgcgctgctgggaggggatctgcgccctgacctgctgccggagaaggaggaggaggaggactcgtcggagctctctctcgccggtgcttcttgcgcttcgatccacgtcgccggtggctgctccggatgctgcgctgcacgcccccaccaggcccgagaggcgccggcggcagcggatccacagctcccgcgtccggcagcggtggagacggatgccggcacggcaagcggcgaagggggaggaagccggcgcggtgagcggcgcccggcggcggcggagacggaggccggcggtctcatctgcagtagcgcctcgcgtgtggtggcggcttatctgatttggattggctattttactaaaatacccatggtgcatccgaagttaccactaaaatatctggacaaaatggtcatttcacattgaaattttgatcaacatcctgccacactgaaagtttggcgccagctgctccttcgggccgccggcccagcgtctgtttttcctccctcctctcaattaatttcaaaatattaaaactgcaaatcgaattttatcatattaaataaacttatgtgaaaaaattgttaaaaacaaagttatataacttaatgagatctacaacttttgtttgggtcgttttgctatatgactttgtttcaaaattttgaatttgaattttaaattataacaacttcaaacaatattttcaaataataaattatttcaaatgaaaaggtcatcaacaacaaagttgtacaactcatcaatatttacaacttttgttttggtcatttttctatatgacttggtttgaacaatatgaatttgaatttcaaattatgacaacttcaaacaatattttcaaatactacatgatttcaactaaaaaagtcatcaataacaaagtggtataactcatcaagatatataacagttaacggggtcgattgctctgctatcgaagtcctgctgccctgagatcactcaatgtacatatggctaattcagcatacgagctatgataaagaaatataaatttggtttataatatatctgtaacttcgtcggatgaatcaatgaccaaaatataagttatagatattgatgatttatacaacgttgttattcatgactttatcagttgcaatcatttaggatttgaagctattgttcgaagttgtcataatttgaaattcaaattcaaattattgaaatgaagtcatatagcaaaatgacaaaaaaaaagttgtagatcttgataagttatacaactttgttgttgacaatttttttcatttcaaattatttactacccgaaaaattatttgatttttcttatattttaaaattcaaattttatataggttaatcaaactcggatggagaaataaccataataaatttgatagatctcattaagttatacacctttgtttttgatactttttcacaaaagttaaaattcgactcggagttttaatgttttgaaattaattaagaggagggaggcaaaatggacttctcggcgagagaggagtaaatgggcaaggccggcagcccgaagaaggaggaggggatggggaagccggcccaaggatcaggagagaggctgcgggctgagggagagggagagtaacacttgggccgaaaaggcacaaggatagggagagggattttaatttgttttctatttattttaataggttaaatgaactttgtggtattaaaactagttattgagctctaaaaattcacagaaaattttagagaataatttagaccacttagaattttacaaaaatatttctggccatgatttttaaaggaaaattttagtaaggtgatggatttaagtggaaataatattaatattcagtccactttggattctatggtaccttctcctaatactattaataatggtaagaaaggtaaaaaaagaaaaagaataataaaaattagttttaaacgaaaggaatcttttggaattgtgatgggttcaaggacccgaaaaaacataagtttatttcaaacataagtttatttctaacttaaccaaagaacatcaacttgactttattgctttgtttgagactgttaagaaataattttctacaactgctcttaacaatctttgtgctggtgaagattttttgtggtattgtaaacccactagaggtagatatggtggacttctcttgggcattaatttattaaatgctgatattggtttgattgatgagggtgatttttatattaagtttcatttgcgaagtaaggctgacaattttaagtgggccttagttttagtgtatggacctgcacagaatgagtttaaggatcaattccttgcagaattactgcacagtcatgagactttaccaattcttaatggtggtgatttcaacatactttgtagccctaatgaaaacaataatgacaattataatgatagatggccctttttttaatgctattattgatgggttgtgcctcaaggagttacaaatgtctggtaggaattttacttgggcaaataatttagcacatccaacctatgaaaagctggatagggttttagtgttgacggaataggagcaaaagtaccctttatcttctgttgttgctcttaatagagatatttcggatcatactcctttgcttctaaataaaaaatcttcctcttttagtaatgctgaacatagttttaggtttgaacttggttggcttttatgtgatggttttgttcatatggtaaaggaagtttggtctagtgttgatgaaggaaatactcctatggagcgttagcaggcggaaattcgccgcttaagatagcatcttaggggttgggttaaacataccagcggtatataaaaaagagaagacaacatcttaggggttgggctaaacataccagcggtatatacaaaaaagagaaaaagcagattttagataggttggatgcgctggataaaaaggcagaaactgttctcctgtctcaagaggaaattgatattagatggttttttaggaatagattatctgctatcctacgggaagaagaaataaaatggtattagaggtctaaaactaaggatattttggagggtgattctaatacaaagtattttcatttagtggcaaatggaaaacataggaaaactagaatttatcaattacaggatggtgatcaattaataaatggtgatgtcaatttaaagtcgcatgttaccacttattataaaggtctttttggccctcctaatgagtctgaccttcagttagatgagaataatattgctgacatttctcaagtctcacattt

SEQ ID NO: 28658 - DNA, 4135 bp, Oryza sativa
attttacttgggcaaataatttagcacatccaacctatgaaaagctggatagggttttagtgttgacggaataggagcaaaagtaccctttatcttctgttgttgctcttaatagagatatttcggatcatactcctttgcttctaaataaaaaatcttcctcttttagtaatgctgaacatagttttaggtttgaacttggttggcttttatgtgatggttttgttcatatggtaaaggaagtttggtctagtgttgatgaaggaaatactcctatggagcgttagcaggcggaaattcgccgcttaagatagcatcttaggggttgggttaaacataccagcggtatataaaaaagagaagacaacatcttaggggttgggctaaacataccagcggtatatacaaaaaagagaaaaagcagattttagataggttggatgcgctggataaaaaggcagaaactgttctcctgtctcaagaggaaattgatattagatggttttttaggaatagattatctgctatcctacgggaagaagaaataaaatggtattagaggtctaaaactaaggatattttggagggtgattctaatacaaagtattttcatttagtggcaaatggaaaacataggaaaactagaatttatcaattacaggatggtgatcaattaataaatggtgatgtcaatttaaagtcgcatgttaccacttattataaaggtctttttggccctcctaatgagtctgaccttcagttagatgagaataatattgctgacattcctcaagtctcacatttcgagaatgaagcattaactaaggaatttactgaaaatgaggttaaggatgctattttccaaatggagcacaacaaagctccgggtccagatggatttcctgctgagttttaccaaattttttggaatgtcattaaatttaacctattagaactgtttaaagactttcattctgggagtttgcctttatattctctgaactttggtactatgattcttttgcctaagtgtgtagaggctatgaagattcaacaatatagacctatatgcttacttattgttagctttaagatttttaccaaagttgctattaatataattatggatgtcgctcaaaaggtaattactcccacttaaatagcgttcattcctgggagaaatattatgaaaggggtggttattttacatgagacattgcatgaattacatcgtaaagataaaaacagtgtaatttttaagattgattttgagaaagcttatgacaaagttaaatggccttttgtacaacaaacattgagaatgaaaggcttttctcctagatggtgtgagtggatagcatcttttattcaaggtggtcatgttggtataagagttaatgatcaaattggtaattgttttcaaacttacaatggtcttaggcaaggggaccctttatctcatattctttttaatatagtagctgacatgtttactctattgattaagagggctaagaaggcgggacttttgaatggggttattccccatcttgttgatgatggtttgtctatcttgcaatatgcagatgatactatcatctttttggaccatgacttgcaactggcaaagaatctgaaattgattttatatgtatttgaaaagttatctagcctaaaaataaattttcacaaaagtgaattattttgttttggtcagtcaaaggaatgttatgatcaacattctgatatctttggttgtaagttaggttcctatccttttaaatatctaggaattccaatgcattttaggaagctttctaataaacattggaaagttactgaagagagaattgagaaaaagcttagtagttggaaaggcaagcatttatctgttggcggtagattggtgttgattaattctatacttttaagtttagccatgtttatgacatctttttttgaggtaccgaaaggggttcttcgtaaaattgattattatagattgcggttcttttggcaattggatgatcataagaaaaagtacaggctcactaggtgggatattgtttgccaacccaaggaccaggggggtcttgggattcaggagatacaaaataaatgtattttgagtaaatggttgtttaagttaattaatgaggaaggggtttggcaagacttattgaagaggaaatatctttataataagtctacaacctaagtaggcaagaaacaatatgactcccatttttgatctggtcttatgaatatcaaaagtactttcttaaatatgggttcttggattgtcaatgatggggaacaaattagattttgggaagatagatggctaggcaacttggctttcaaggataaatatccgtctttatacgctattgtccgaaggaaaacatcatctattgccactattatgggatctgttccgcttaatgtttctttcaggagagctttagttggtcagaatcttatttcttggcatgagttgtgtgcctctattatacatatccagttgaataattcgtttgatagttttagatggaatttccatcagaatgtcttgttctcgatgaggtctatgtacatagctttaattaataatggttatattgacaggaataagtgcatttggaagcttaagatgccacttaagattaaaattttcatgtggtacttgcttaaaggggttgtgttaactaaggataatttggcgaggtggaactagaatggcagcttgaggtgttctttttgtttgaagaatgagtctattcaacatctctttataaattgtcattttgcgaagttcatatggagagcagtccagttctcatttggttttaaccttcctattagcatatctcatatttttgataggtggcttttgagagttgataagaaaacgactaaattgatacttgttggagcttctgccatttgttgggcaatatggttgagtagaaatgatatggtttttgataaatcaccattattttcctatatgcagttaattttcagggcaactcattgactccagttttgggcacaattataaaggtgtgatgaagatgaagagtttctgaaagttgcatgtcgcaagttggagactacggttatgcaactttttaccaaatatggttggagatttacaaatagacttcaatgattgtgatctctttacgttagtttggattctttgttatcctttgtggtatgttttattcgtttagaattacactctggtctttagtgctattatgcgataattggctgtacctcttttgagcaaaggctggaattttatattctattatcttaaaaaaatgtgttaatccaccgtttgattcagtgtgctaggtgggaagggttcccaaccctttttaccgaacacagtgctaagtggtaagggagttgtaaggtagaagatgacattacgacgccgaggaccacgcgccagcctgccagacgaggcaagaaatatggcaaaattccgagccagatcgccacccgcgcacatcgcaggtcactcgatcgcttcgctatcgcccccgctcactcgctatcatccagtggttggcggcaacttggctttatgcgcagcggcggatccatcgatggggctgattggggctccagccccagctctggccggccatagccccataggtgctaacaggtatctgcgtgcagctagccattgtgacaagaaacgaaatagctggctatgaagcattaccgcctagtgctttcggtcatatatgttggaaataatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgcctcgcctcgccgggcaggacgtacgcgtcgaatggtccgaaaaattggcttctcacccttgcgcagatgcagcctccttttgcagttttgttttgctgcaaattcggattcgtttttgttttggaaacgttccgaaaaatccggtgcgt

SEQ ID NO: 28659 - DNA, 2764 bp, Oryza sativa
gacgtcctgcaccgggagaaggcggcaataaggttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatcgaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggccgggtgcattattgcaaaactacctccatcttggagaagtttcggtactgcactcaaacacaagagataggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggtcaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtaggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtactggacatgcatgttggtacaattatggagtctcgtgatgctaccttctttgagagctttttcccaatgaaggatacacatagtggttcgaatcaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctg

SEQ ID NO: 28660 - DNA, 32769 bp, Oryza sativa
tttgacacttactcacctgttgctagattgaccacaattcgtgtgctactttccctagcagcctcagatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggtagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgttttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccaggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacaacgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttgaaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgccgggccgggccgggccgggccgggcaggacgtacgcgtcgaatggtccgaaaaattggcttctcacccttgcgcagatgcagcctccttttgcagttttgttttgctgcaaattcggattcgtttttgttttggaaacgttccgaaaaatccagtgcgtgcaaacggcgtggagtccggataagttacgcgcgacttatccggttcggttacgcgcagtagagatcgtgcgggcgccctgatcaagcgacccttctctatataaactgacctgccgtcttcacgcaacacttgcgaaatcaatctagggtttttctcctactctgtactacgccgtcgctcgtagactactccatcccgctcgccggcgtgcaccggcgattgggagagcaggtctccggaacctctgccttcgtcgtcctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtatgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatatatatatccaactaatttttttatattgtaagtgcaaccaaatacaaaaaatggaaaaaaaacattgcaccgtttttcaaatatatatttaccagcaactacagttatcacacttgttgtatttttattctttattttgagtcctttctggtacaagttagaaatttgatcgacaagagattggtgtgtatagtttacttgctctaggccctgttgttctttcagatctagagttcttgagttttttttttgtcaaaccgttaaatattatgatttttcaaaaaacttattatagagaagtttcttcaaaattcaattaaatcaaaatttaaagtttgtaagagtgaacacttatctaatcatacgttaattaagaggcttgtctaaattctgataagctagatgattgctcgtccgaaactcattcaaacaaggcacctctttattttcatcctagattcgtcgctgttatgcgccgagccacccacgttgactagctagcaatttgtacgtatactaaaacaaggaggtgcaggaactaattaatctggtcagctctcgtggtcaatggttggaaaagtacacacatatcatggtctagaagaaattaatccaggtttgttagttgtgtcctgtgtgtttcaaaccatttccaacgtcaaattgcaccgcggtctggcctggctcactatataatacttcctccgtcccaaaatgtttgacgtcgttaacttttttttaaagtaatgtttaaccgttcgttttatttaaaaaatttaagtaattattaattcttttcctatgatttgatttattgttaaatatacttttatgtatatatataattttacatattttacaaaaaaatttgaataagacgaacagtcaagtatgtttaaaaaagtcaacggcgtcaaatatttagtgacggagggagtaagtcacacgagccatcgatctcgaacatttgcaaagcacctgagaccatccctgcgccacagccttcctccctcaacgcagggcaggtaaacaacttcctccgccctttgttttagttcatcgaatttgcttagctcattataccggagtatattgttcttactagctattttcaggaaacacgtatgtttcaattattcaatccgtgaaggtttccattgaagtggcttatattgggtgccaaggccggtgttcccaatggaggcgaaggtagcagccggcgcagacactcaccgtggccgtggcggcaaccttgcttcagctgtggtgggaatcacggccgcctcatctgccgtcaccatggtcgccgccggcgacgtcagcccgccggtggcatttgggctcttcgtccttctgctcgccggcctcactctcgctgcctcgcctgttcgccgtgggtaaggtgaacaggtgatggttacaaataggcactccggagtgagaggtgtcaagttttcaacttcatctttgtatctttggtttgggtgcgtactgaataatttgggaggaaaatggtgatcgatgtatgttttcaaggtttgataatgggatgattttaacattctcctaccgaattttgctgtcaattcaaaatctcaggctccatgtacaacatactacaaaattcttttcattatcatgtgagaactgagtagctcctggtaaaacctcgtcagaatgaattttcgatgtaacaaaagcatatttcttctattcatggaattaaatatagcatcaatatgatgcacataaaaagttttagatttggtctcctctgcacagaagggcagaacagaagaacattgaaatggctactgtgcccttgtcctgttcagtctcaaatgctacctaggagatgttcttttctcctgaaggtgaagatgaatattaagttttttatacaaaatgaggtggtattaacgtatgattgattgagttttaattattacgaacttgaaaaattgattgagtccacttccccttcccctgacgggacttagagtgacatgaatgtgagtgtacctacataacagttgggtacaaacacaatgcagattttgtattgttctagaaagtgtgacaattttttgttatggttctagaaagtgtgactaatttttaagcgattattgtttgatgtctatagctgatcctagaattagaattgttcttcggtgattttgttcttcgttgatcctgtgagtccattaatatatgaaaaaccataactgcagttgaaaaggagccttgagaaagcttgatctgttgctcaaactcatccaggaccttgatctggtactgtacagtgcacacagaccttggttgtaggtgcctactgatctctttcagtgtctaatgcagaaagtgaaagtgttcccatccaaagtcattcaattgccatatggtcattgatttctgtagatgatatttaccgcaatccttaagtgcttccctttcttgcttctcgatattatctattcacatcattatcttgttctaatgatttctttttgcagatattattggaaaaattattgccatctcctgtgcagcaatgaaatcaacaagttcataagaattcaggatgagaagattagcgcctatattatccaataaaataaagcatgacgtaataagtatccctaatttcttttaaataattagtattgcataataattaatactttatttttttatgtagagctcatcttcacaaatggagtcacctcaagatatccagagcatgaaagttgagccatgtcatttggacacaaccaacatcttaagcaaacagacctatgaagatccaaacatgattatccaaacttggattttacttactgtaagcattgtggtttatgttgtctttgatttactaatgacaaacatgattaatagctgcgttaattacatgttcttggaactaattttgagtcatgactgagcagggtaatgtataggctgcctagagtaagaattgcatttattcgagatggagtatacatgtacaacctagaataagaattacattgttggtctaaagaaaaaatttcattcgacacgttcattgtactttgactcaacgatgttatccttttttttatataccacaagatgtttggggtttgcctgctatgttcacagttgaaagtaaatttgaagctttcataagcaagctgtgatgattctttacataatcttagtattatgaaatctaactgtttggcataacgttattgtccttgagtcctgaaaactccagcaaaatattgttgtggttagaattaggtacagacacctgattaagttattataaatcacatccaccatttgatttagtgaaggtatccccgaaacaaacaacatggatacaaattaatcaccttacaaaggatgattcctctatctttacaaagttcataaaaatacatccattgcagcaaaagaagtttcttttctacatagttcaaatgtttatgctgaagaactttactatacagtgcaatttatatactttggagtcatatatatatattagttttctgaaacattggagcaaatgtaatacatcgaataatatgatttatgatgccatttactcattacttatatcattgcttttttcaatatttgctattataaaggttgttgattcattgattcttaactatcttaattttctaggtttttactttagtagaaaagtagtagtgaagaagacatcgatcatcgtttgattcaaacaaacagtaaaaatatataagcgctctgcttgataacatatccgataaaaactgcacactttttttatatggattatgcacatcactaactttacttttggtgtatttataacagatgcattacatgtccatcgagaaaattgaaatatggctttatcaaaagctatgatcattttaggtcctgaacaatgtatgtctatataatagacaatttgtatttatatattcaataatctacaataatatgtctaggcactagactcaagtaatgcaaacttgtggttttatatatttttgcaaggaatgtaaagttatggttacgtactattgaaatggctctcataaagttccagtttagatgttcaattatcattgattaatcaagtgccagctttatctgtttacatgttgaagtactccactgtactgactgtactcatttcaatgactttgtgatatactcatatacatgtaacatgtaattacaatttgttcatggatcttgaattcctgattcgattgggcactatttcatgcagtgctggggctgtctcctgaatagttttaccatccataaactgaaatttctatatgttgaaaatggccattaaatagaaaagaatcatttctgtagaacagcacaatgataaatatggaactgagagtgtgttttttttccgaggtgaactaagggattttaggctttgcaatatgagcatatggcaatcagaacatgattaatgccttatttagctgataaggcttaataattaatacgatatacactgcgtccaattggactggtcttccgcgcgaagccgcggttactttctagttcaatatagtacttgtagtaatacattataggcgcattcactatcagcaaatacagtttcatcacatagagtttcatcacatacattataggcgcagtcactgtcagcaaatacagtttcatcacatagagtaacattatcatttactggtctctgggagacgcagtaaatacagtttcatcacatagagtcatcgaaatgaaaactttgacaggtttaaaaccgaaactttgtgcagccaatcatgtgattttcagattcgaagacggaatcttcaagttccatcaccttcgtatgaatccgtaactgctaacggactacacaaaccgaggcggcggatggggaggtttgatcacgccggcggcgaagggcagcacggaggtaaggggggcggagtcgggaaagagaactccgaaaccccattattgggccgatcgacgagttcccgaatgggccgcatgtaatggcctgttagaaaagtaaacgtgagatgcacgtaagggaacagtatcatggcccacgtgcaggcccatgattgggtttatgtgggcccactgcgaggtataatagagataaaaaataatagagtaaagtgcacgagttcttaaacttgtaattggtgtatcatttagatcactaaactttcaaaatgtatatctaagtcttaaaacttatcatattgtgtcatttaagtcccaaatcgccacaacctcttcgagatcctacgtggcaccgatgtggcatgccacaagtcccaaaacttatcatagtgtgtcatctaagtcccaagtcgtcacagccccttcgagatcctacgtggcgccgatgtggcatgtcacacggacaagacgtgacaaatggaacccatttaaaaaattttatttttattttttcttcttttcttctcctccttttttttctcctttctctttctctgtgacccgagcagaagaaaggaaaaaaaatagaagaatgagaagaaaaaaaagaaaaaagaaaagaagaaaaaaaaagagaatgacacgtcacgtccatgtgacatgccacattagcgtcatgtagaatcctagttgatttgggacctaaatgatacactttggcaagctctgagacctgaatctgtattgagagtttgaggacctagataacacaacagtacatgtttaaggaccgcctatgtactttactcttaaaaaatatgattgcgcccttatatgtacccactccgtaaaaaaaacaatcataacactggatgtgacattgtgatatatcctaatacgattaatctagatagaagcctgtctaaatttgttgtatatgttatcacattcagttctagttttttttttcagacagagggagtattttctgcctacgcatgcaagacaagattgcatatgagcgtttcaatagtgtgctggacagacttgatgtcttaatgaatatgtgtgttcctaattaactctctgcagatgaagatgttctcctagatttattaattagctgtagggtgcacaaacattttggcagagcgaattatttactgacatgcacgcattactctttaccttagattggtagtctttggtttgttttcttctttgtgattggttttgcctttatatgcttctctgaactatactgtatgatcatatagagtattgggatgttttattccattataaaaaaaagttaataatcctgtcctgatatcctgatggggtctctgccagtaattggcttattttgtttacattgatatggagtaatcaaatatatttcagattatatattttctcatggaatcttacattcttataaatggaacatggcctcacgtccttcaggtttgtcgcttcgcttactttcccattggctcttcttcttctcctacacttttttggagctgtctatacatttatcgagtgatttctaaaaaaaaaattcacctatttttttttagtcttagatttacatccaacagactacaaaagaaaataacaagtacatatttacttacatattatttttatcaaaattacagtacatttaaatgtcatatcaactgaatttgtaaatgtaattttagttatatagttgtaattttatattttaaagaaaataacaaatatatatttaattacacattaatttttattaaaattatagtgcacttgcatattatatcaactgaatttacaaatgtaattttagttatataggagtgtaattttatatttcacgacggctatgagagaagcggtgtcgctcgccaattcagaggccaccttgccaccgtgcttctctattatcgcgcgagcgtgagctagctgggtgacacgaaggccgacgtgccggccggccggcgagctgtaacgtttcaccttgcaagttgccgctcacgtcactaagtggttgtatatatagcaggcaaaaaaaagttaggctcctatcggttgcccattttgccttagaaaataaaaattaatttataagtaaaatttttatagatttgttcatagcgacttaaaagccaacattaataaaaattacgttaaaaacatcttaaaattaagtttaaaaatttaaattttagtttattctttagctgtttaggccaaacaatggggctgtcaaatgccaggaaataaatcacagatggatagcaaaattgacacttttttttttctgcctcagcctgagacaatggaagggcatacggggcaccaggcccatcaggcatgcggcccagccgaatgcttgggccgccctgtcccggcgtccctagcgagtagcgacctagcgccgtcttgggatttttagcgccgttttgggattattttttcctcagatcaattgatgatttatctgtgacatgattaacgataagtggcccaatcatctcggcttgagatttgagaatgattgatgattatgaagtaaactctgtcgaggtggacaggccgcaaaaacacctagcgggataaataaaaggaataagttcaatttcactcccttaattagtggtcgaatctgaatcgtatttctaaaccacaatactggatattttcaccccaaactattaaaatcggtgtaatttgaccccctcgacagttttggagggtggtttcgctgacgtggcgcatacgtaacggcattgacttagtcttcgttccacgtggcgcttacatgtataaaaatttaaaaaatatgagcggaacccatttatcatacacacaaatataatgtggcaaaaaggaaagttttgatagggtaaactgcgatgaatggcttacacagggagtacattctctcgttgataacacttgtagattaacatctccatccctccctgctgtattttttggttgcttacacctagagcctaagttaaacccaaataggttaaacatattaattaagttacatacatttataatcaatactaatccagtcctcatgcgcgaaatagaagtggattagaattttatttatttaattaattgtgtagacagtattcgaactaagagtgtcctctgaatttgctatcattttaagttgtatgtaccaaccagtttaacctaaaatttaagttggtgaataaaggtaggcaatccacttaaactctaacaaaaccaaataatgtacttgacaattgaaagcttaatcaagtacgtatcaggtatcaagtatgtttgttccacttaacagataacaaacgattcactttcaggccattagactacatatatgcaaaagtgttgagaagatccttacacaaaaggaatcgtttgcactaggcagcaggtataatcgccaacgtgctctctactcccttaaaccaagtgcaatcagttaattagtgatgaaaaagatagcactgaacaagctaagataacactggagaaggaagagaccaatgaggagacaacacactgatgaacatttcgggtgctgtagtattattgcaagtgggcatttcaatatgctgcattgaatttcgtattcgtaacctgaaacagaaggaccagctgggaaaaaaaatgcatttcgtcgtgtttcaatctcgatctgatgaacattctaatatatgccactactatctaccgctccagttatcagtatcaatgaattgtttgtgcgctacgtcgcatgcagttgcgcatcgacatcaagatttgaggtatacagctcctcagaacgcaactcttatctctacttttgaagcattttcaacatgtttttgtcgctcagatttcttctactatcgaaattccctgtgcttcttgatccgttcaatgataaaagatggccggggctgtaaaaagttggtcgaagacaaacgcacttgggagcgctcctatccctaaacttattagggtaaatggaaattctggataagcacaaaaaaattctggtcaaagatttcccatttgcggaaaactcaagtacgttttcgcatattctgatttgaaacgtggtcaagatcctaggagaggacgtcaccctcctacgtctgtcctcacgtacgctgtcacgcactatcagcaggagagagaattaatggaaaagagagggaaaaagaagaggatgagcaaaaagaagaggaggagattccaattgacaaaataaaattcacagtgttagatagacctcccacccgtcgggcccaacggcacaacggaccttgaccgcgccttgatcaggggtgtccagcccaatggctggtgggcccccgtcacactgcgccatataaaagaggggtggaggccggcacggcacaaggtacgagatttgtcgccgccaccaactctaccctacaaaccctaatccaatcgagagggggcgcagccagtgacgggaaacgccaccgccgcgccacgacctcgccgggatcgcccacgaccaccgctgcaacaacaaccgccgccgtcaagcacaccgtcgtcgccgtccacatcaagccgcgacgacaacgacgatgtccggcgcttcttcctccacgaacacctcaaccggttggtatctaaacccctctccctttcatctataatgtcaaacatcaacctaatagatccacccgactagatctaacctaggtgatcctagtgcaaagtctaacaatggtatcagagcgaccctagtgtttagatcagttcggggaaagaaacccacagaggaaaagaaagaaagaaatgcaaacgatccaacgatcgaaaagaaaaccctaaccctaattcttacctcgtcgccggccatcgttgacgccggcaacggaggggggaggggcacagaggcaccgccgagcagccactcgatggccgtgcgcgcacccgcgagtgcacgcgcgtgtcggcgagggggcccgcggcagcgccaccatctctgtcgtcgccggtctctcactcttcactcgcgtggaggggtgagacggtgggggggggaagagaaaagaggacgcgcggcggcgcaaggtcgccggccatggcgcggcggcgcaagggctgccggcgtcgaccatgccgctcggcgcgaccgcgcgcacgcgtgagagagcagagaagaagctagggttcggcgcggcggctgggggtcggggttttgatcgcccgatctccctgcccggccgtccgatcaaaccctagcggattggacggccgacgccggccgggccgaaatcggcccaagagggcacgccgggagggggtgctttcccggcccgggcccacgttgcggccgcgcgtgagcgcgcgcgctcagccgtgggccgaccgtgggccgcctctcccgatggaccaaaaaaaaggaaatgaacagtagcaattttcattatattctgtctattttcatgcaaatttcaatagaatttgaatagatttttgcatgttttacctctgtttaaatttgaaccaacgggtgaatttttacagagagtaaattacagagttttgctactgttcatatgaattttatatagttttccgctggaaatagatgaaattgatgaaaattagtgtttctaaaattatatgtcgaaccaacgggagaatttaattttaggaacattaattatgtgctatgatgttgtaattttctaaccaacgttgataattgcaatgttatagttatggttacatgtgttatgtctaattctgccaattccaaagtggcaatcatatacatcaaaatccaactttgatacacttattaaatttctttgcaaagaaggaatataaaagacatctcgaagtaaaagtgtgaagccattcgcgagttctagaggaagatctccaacagcttcaactttttcttcaactccattggcaactctaatggagctttctcttctttgcgtagtcctcgtcgaacggaatgcctttaaacaattacaagcatgaatagttgctctagaattaatccaccatgtggatctagagtaatcaacataatgagattcatttacaaatgtaataatgttctcacctttccttgccatgatcattttcaagaagtctggacaatctttcttgtaatgtcctgtcttcttgcagtggagacactgatctttctcaacagcgaactgttgttgctgaggtagatgctgagactgtttagcttttgaggtgggagacttgtggttctttttcttattatctgtaacatagttaattgaaccaccatttgactctttgtttctctcctcctcttgcacacagttagcgatgagcttttcaaagtttcatttctctggacttatgttgtagttgacaataaaattgtcaaactgctttggcaatgaggccataaccaaatggaccagaaagtcatctgttatgcccaaatccattggcttcaacttgaaagccatgttgctcatcctaagtatgtggtctctaacacctcctccatagtacctctctgtcacaagctgcttgatcagctgtgtagcataagtttttgaagagccagtaaactgactcttgattctttcaaggtactctgagacagcgtcacactctgggattgagcccaatatggtaggctcaatcgtgttctttaccacagccaaacatttcttgttagctaaggaccatttcttttgttcaatgtcatacgacatgacgagaggagcatctgttactgggttacttggcagatttcagagtagtccaggcccagagcactggaaattggtaaagaaagtcttgcgttatttgcaaggaacaaaatgcctcatgctgtcttacagaagatcagaatcgctccagatagtggggtattcagattctgattttgcaaaagataatacaaagtcaacatcgggatatgtgttcaccctggcaagaggagctatttcatggaaaagctcaaaacagactatcactgcagggtctactatgtatgccgagtttatagcatgctatgaggcaacggggcaggtgaactggctaaagaagttcatacccggtttaaaggtggttgatagtattgagaaaccactaaagttatattgcgacaatgaacccgcagtaatgtacgttcacgacaatcagtcaagtggtgctgcgaaacacattgacataaagtactatgttgtgaaggacaaagtccgggatcaaacaatcagtctcgagcatattagaacagaaaggatgctcgcggatccgctcacgaaaggcctaccacccaacgtgttcaaggaacatgtagccggcatgggtttaagggaagccttatgaatcctggactacagggcccaaaagtaaaagtatctatttttgaatagagatgtgtatagtggctgttgaatccatcggtgattgaccgtgacgatgaaacatgctctatttacaaatctgtgatggaatagaaaaagctaaaagaaatagtgagatcaagggggagaatgttagatagatctcccacccgtcgggcccaacggcacaacggatcttgaccgcgccctgatcgggggcttccagcccaatggctggtgggccctcatcacactgcgccatataaaagaggggtggaggccggcacggcacaaggtacgagattcgtcgccgctgccaactccaccctacaaaccctaatccgatcgagagggggcacagccagtgacgggaaacgccaccgccgcgccacgacctcgccgggatcgcccacgaccaccgctgcaacaacaaccgtcgccgtcaagcacaccgtcgctgccgtccacatcaagccgcgacgacaacgacgatgtccggcttcttcctccacgaacacctcaaccggtcggtatctaaacccctctccctttcatctacaatgtcaaacatcaacccaatagatccacccgactagatctaacctaggtgatcctagtgcaaagtctaacacataggactagtaagcaggaggaaaccagatcgatggacgatcacattttgacttgcgttatatataaaggaattgcacctacaaccatatctcacactctttatcagtggtgagctagctcatccgattacttccttccattatcgcggggagaagatcgatctgcatttgtcactatggagcctcgaggtaaatcatacagattcttggtgaatttattttctttcttcgcgatgggttctctcggcggcaagatcatcgccacagctgggtgcgccatcgccttcttcgcggccggcgccagcggccatggtttagtactcagccttctgggtgtcctcgccggcgtcatcatcgccatcagctccgcaacgctccatggcatccctctactcgtcgctgtggctctgcgccgccgcaacctcgccgtccttgggctcgtcatggcctcctccgccatcgcggcggccgccggcgaggcgagcccggcgctcagcttcattctcttcgccactctcctggtcggggtctccctcatcgccgccggagttcttggttcataactaattaatatcgtatgtaagctgcgattcatgcatggacaaaaatcgatatatacttatactctggtgattcaggtgaggcgatgttatctgattcttgaaacattcacgtcccttgaactgtttaattacagtgtctgcccatacctgcttactatatagtaatatactagtgtcatttgtgcagtgtgctttgtaacttttcacatgtgtgtatttgttaattgccttgtatagttgtcacatcctgaattttcgtttcaggatttataaattatttaataaaataataatagaatttatattaaaaaaaatctttaatttacaagtgaagttaaatgtgggaaataaaatttcctaaatataaagcatggatggatttaattttttattaaattctccatggttaattatactctctgaaattttctcggatttttcagagctcaattcttaaataatacaaagaacagttcagtaattatttgatcattaatgatctaagtatatttgttaagtgcttttcttgtttaaaatccttaaaattataaattgttgtttaaaaggaattattagaaatgattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggccaaaaaccctctctctctctttccttcggcccagtccggcccagtccgccgagcctccgctcttctctctctcggtgtcgctgacaggtggatcccacctgtcaggttcgtcttccccgagccgtcgtcgcccggccgaaccctagctgagtcgcgccgccgccgctttccttttccgtcgctcctttccatctccggccgaattgattgaggccaaatgatccttgagatctcctcttccttttctcttttggaaacatcggctaattttctttggaaaccggtggatttgagttcgattcggatcgacttctctctctccgggcccgacctttccatcccgccgccggtcgccgtgggcctccgccgccgcctcctagcccctttaaaaggatccccggtgtctcctctacccgctgcctctctcgccttcgcctctcatcgtccgaagcgccctagcgccgtgccgcctcgcgccgccgtcgtcgccgtcgctccagccgtgcgccgccgctgttccagtcgtcgtcgtcgctcggggagatcgccgtcgtggtcgccaagtcgccgccgtcctcgtccgccgtttcgccgccgccgaagaccgccggagcaccgccgtcaccgtcgacccgatctccgccgccgcttcttcctcgtcgccggcgccgtccgttgctcctccgccgttgttttggtcaccggtgagttcgccgcgtcgccctctacgtcttggtgccctccgtttgtgccgtagagccgccgttcgccggcgagcgtgcgccgtccgagccgtccgagccgccgagccgccgccggaggtgacgtcgtcgctgacgtcatcgtcgccctctcccgtgagccggtcgtggacagatcgatctcagccgtccgttttggatagggttgatctcggccgttcgtttccgtgaaccgccgccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgtttaagtctcataattcatctaaaattatgatctacatgtttgtttactttttatgtattgtttatttggtttttattagtctttttcttcgttttgcgtgttagcttgtcgtttccatcgttgtgaaggttcgcgagtgcatcggaagtgttcaagaagattaattgaagaccgaatattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttaatccttgataccttgggttattataatttgactagttgagctttatatattggttcagctagatattagatgtgattgcttagccatgcttagaaacattagcacactattgggataacttatgactcattattatttaatgatggtttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaatggctttaccttttgtatagcatggttcattgcagagcaccagactgagaagtggcggagataagcccacgggggtcgctggggagtccatgcctctggtttttgagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccatgcccgcggttatgggcgagttgagcaatgtttttcgtgattagtcccacacctctcaccataattatggatgttatacctggtaataatttgcttagctcctggtttggagttagatctgttcagccgggtatggttgttcagaatggttgggcctgtgcagcatgggtgtgctgttcagtgttgattaaaatttccgattaattactccactgttttacttctcttaaatgttttgctaaatgctacttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatgttgaggactaagtgcctcttaagtaagtatttattcgctttagttattgatgaatctgtatattaaattgtcagtttgtgtacctcggctgattcctggacgaggattttatgcacaaataagttcggaaattactagtgaatttccgggcgtgacaatagttttgtctccattgagggagacctgttataataacttgattaagattgatgttcctaattatcagtgtgccaactgtcctggattagtaggcagagtaaaccagcaattgaaatccagtaggcagagtaaaccagcaattgaagctagtagctagtacgtacttccgccctttttaaatgtttgatattaactttttaagtacatatttgactattcgtcttattgaaatttttttgtgaaatatgtaaaactatatgtatatatgaaagtatatttaacaatgaattaaatgataggaaaagaattaataattgcttaatttttttaataagacgaatgaacaaacatatttaaaaatatcaacgacgttaaatatttagaaacggagagagtaatttattcacaaatgattctgcttgcattctgtttgcttactggctttgaatccaggggtggaggtagtatatgttaggggggtgctcaggaacccggtcaaaaaaaatttttagctatacctcatctattttcaccatgtatgcaccccctcaatacaaatttaggcacctatatcagcttaaactcgatctaaattagagtaaattaagcaagtggcaccaccctctgtttcgctctagctccgccctgtttgaatcattcagcatggcttctgattcctgaatcgacgaccaggtttcctgaactgattgattatattattgtatccaaatctctgtctgtttgcaacatgcaaggattgtttgtcatgtgtgttcctctgtgctacaaaacatgcctgtatcatgtatgtcagtatgtgagaatctcttaagattcacgacgtcttttgaaaaatgtgtttatttaagctatattgcatccatgcttaggtactattattttcttattatatcattgtctgaatattactgaaaattggtagtccaaaatagatgattccaaaaaaaatggatgaaatctttagaattgctatgtctattactagcacacactttttttttaaaaaaaaacatcatctcaaaactttcatatgaaaatcaattcgaaaaacatttacactactaaaaaaatacaaatagatgcttcccaaccagcacccatatagcggcactgatgagagatatcaaaggtgctcccctgcaccctgaccagatcaaagaacacacatgaacatcaacagcatccaaaaacacatgaacatgaacatcatgaacatgatgttgacgcttggatggactactgcccgacgatgatacacggggcatcgacatcatactccacccctgccaccatcgccggatggagaggaggagcgagcctccttttccccctccagctgcaaccaccaccgccttccctcccgccggatctagcggaggagaggacaccgccaccaccgctaccatcgccaaaggctgccacctcccctcccgccaaatctggcagatgggagaacacagcccctgctgccatcagaggccaccgcctccctcatcgtcggatcaggcggaggggagggcacggtcaccgtcgctgccaatatcaccaaaggccgctgcttcccctcctgtcggatctggtagaggggagggcgtagccgtcgccgctagagagagagagagagagagagaggcatcggagagagaggcgtgggcgagagggcaagtggataaggtcgggtgcttggctcgccggttcggttcggtttggtataggtgccagtttgtttaaaagattaacacctataatatattaaaaaccgacacctataatatattaaaggttatggtttttataggtgtcagttttatatgttttcagcccgtggatgtgggaaaagcattataggtatcggttttagctgttctggcacatatagtgttaacttgtatgtgtctattttagtaatgttatttgaaagctttaatctgaaaacttccatatgtgaacttttaattatatgaaagctttcatatgaaaaactattggccgggaacgtacgtatgccaaaccgaaatttcggttcctcacgcaaaattgccattcaacagcaccaacaaaaaaaaggataaccttttcatgcagctgttccacaagcaatgaaaaaagcaccacgaaatcgtaatccaccgattttttagtactttcataagctttacttggtaaatagaaagcaatactcaattatttatcaactgttaggtatgatgaaatttatccttagccttgtattcaaagagtcaaatgaaggcaacactggtggagaaaccgtctttactcccggtttgtaacccactgtagtcccgatttttcaaccgggactatctttagtcccgggtgaaataaccgggagagtaaagatcgatctttaatcccagttggtaattaaagagagggatcaccgggagtaaagatcgatctttagttccggttagtaactaaagagagagatctttagttaccaaccgggactaaagagaggatagggacagtctaggttggtccatttcctttttattttctcccaaatcgagtgggatgtatatacccaaatcaaacaccaaatccccaaattgagtgccatgtatatacaaatcaaaccccaaatccccaaatcaaaataacatcccaaatcatccacatcacaaatacaaatcctaagttggttacacacaaatcaaatacatcaaaattacacaaaaatcaaatgcatcacagatcgattatacatctcagatccatacaatgaatcacaagttctaaaaaaaagaacaaattatacatctcttaatctcaaattacaaaaaaaaaagcggagaggagaaccagtgtgctgccgctcgccatatgccgccgcttgccagccgcgcgcctgctgccacggccagcacctgccgccccaccgcctgctgccgcctgcccaccgccgtcggctgccggatgtgaggaggagacgggaggaggaggaaggggaggagggggggaggaaaggggaggggagaaggaggaaggagatatgagggataggaggagaggggatgatccgatcttatataaatatcttggtggggaggaagtctcgtttgggacttaaccgatcagatatgggagagaaatatttaattccggttggaattttcaaccgggactaaagatagatttttagtctcggttgataatatcaaccgggattaaagatctaaataatttttacttccgttggtaaagttgtaatctttactctcggttggtagtatcaaccgggactaaagatcctcgacctcctgacatgcctttgacaggttatgaaccgggactaaagatcaattttttttataaccgggattaaaaataatctttagtcctagttctattgtggaaaacgaccaacccagcaaagatcacttttctagtagtgtagagaaactatatgccagccaaagaatcactctaccacttgacttagacatttttttttcatttcaatagcagaatgaccatgcttccctattagaaaatatgatggattaactgtaaaagaatgctaattaaagtagtggggggtggaggaacaacaaccaccactagtagtggttttcatagttgtatagattagtagtcgcttttccctgtcacaatataatgtacgatccatttgtacttttctaagtactttatatcttcaccatatcaccgtttactttatcgcagcttctttactatttcacatgacaattttttgcaattttcttgcctacttgtttccccccaatggtttcaatttttttcattaagcatctaccctcttcagttgatattcgaatattcttatctcatctctacttttatgtatataatgtattcagttccaagctataattgtatgtcggtcatagtagttgctatcctcttttcccactgcccgcgcgcagataagaagcatgaccttccaacctgaggaatctgaatgttgacccttttagagtttacgggccgcatctgtggacgttctttggaatttatttcgctggcaattgcctagctatgttggagtactgtacgacagtacgttattgacgcgacgcaatatcacacttgatgccgttttctcacgagttttcagttcgtcgaatccaatacggtccttgtccttataccggagtactccctccgtacgatgaatctgggtagtactttatcgagattcgtggtaagaaatcatatacacacctaaattgtgaatttctttttcacgcaggaaacaccaaagtaaaagtcgttgatgtgatgcatatttagacatcagtacatgggtacgtaggctgtgtttagttgactttaaacttctaacttttccgtcacattaaatgtttgaacatatgtatagaacattaaatatggacgataaaaagaaaacaatgcatagtttgcatgtaaaatacgagatgaatcttttgagtctaattacgtcatgatttgacaatgtggtgctacagtaaacatttgctaatgacggattaactaggcttaatagattcgtctcgcaatttacggaatctgtaattgttttgttattagtctacgtttaatacttcaaatgtgtgtccatatacgtcaatttttttttgccaaaacagctaaacacggccatactctctctatcccataaaaaataaatttatgattggatgttacacatcccaatactatgagtttaaacatatatatatatatatatatatatatatgtttaaactcatagtactatgatatgtaactttcggtactggaatacttcctcgatccatatacaatgattctggataaccctttgtccaaatttgtctggatgtgatactacctaggagaggacaacgagttcttagatggtgttaaattcgtactatgtatttttttaaaggagtgagtacgtacacgagaattatcgtttttctaaaaataattatccttttttttcaatgtgtgtcgttgcacctagattaatcttagccttgtgttcttcgtctcggacttgtgttgcgcacttactcttgtgttgcgagtcagcttgccccctccaacctgaagaatctcgaatgttcacgcttttcgagtttaccggccgcatctgtggacgctctttggaatttgtttcgctggcaaaattgcccatggtggagtacagtacgttattgatgtcacatcggaaaattgcccatggtgtttagttcacgaaaagaaaatattttggtgtcacatcggatgtttgaccggatgtcggtagagaatttcggacatgaataaaaacactaatttcttaactcgcttggaaaccatgagacaaatcttttgagcctaattaatccgtctttagcacatgtgaattactgtagcacttatggttaatcatagactaattaggctcaaaagattcgtctcgcaatttcccccctaaccgtgcaattagtttttttaaaaaaaatctatatttaatactccatatatgtgtccaaagattcgaagtgatgtttctgggaaaaaattttgggaactaaaccaggccttagttcttaaatttttttttccaaaatcatcacatcaaatctttagacatatgcatggagtattcaatatagacaaaaataaaaactaattgcacagtttgcatgaaaatcataagaggaatattttgagcctaattactccatgattagtaataagtgttacagtaacccacacgtactaatgatggcttaatttggtttaaaagattcgtctcgcggtttctagacgagttatgaaattagttttttttattcgtgtccaaaaacctcttccgacaccggtcaaacatctgatgtgacacaaaaaaaatatcttttcgcgaactgaacacacccttgataactttttcgcactaattttcagttcgtcgaatccaagacaggccttgttcttttaccagagaacttcctcctctgtgtacgacgaatccaaatatttttttatcgaaatttattatattagaagggatcacatctctatctatatatatctagattaattttttttaacggagacggatctctagattaatttttcttaaacggagagagtaccaaagtaaaatcgttgatgtgatgcatgcatgttcaaatattagtatgtgactacatacttcatccatactgagataaaccaaccttataccagtacacgagagttgtcgtttttcccaaagaataattattcttttattttcagcgttgtactgtcgtttgcacctagattatatattcttcgtcttggactcgtgttgcgcaattgggcttgtgttgcgagtccgcactccagctgcttgccccgtttgacaagaaatctttcaggagaaaagaaacgagccaacaaggcgctccgcgcattttgccgacctatcaaagccgaaaaacttcggcgtctctggcagtttcgtggaagtctcgaagcaacgaaccgcgtccggtgtgtcattattcggccgtgtttagttttcttcctattcacaattttccatcacatcatatcacatcaaaaacttttctatacaaataaacttccaactttttttttctaaacttccaattttcttcaaacttttaactatttcagaaactaaacacacacttcgttcccttataatactccgtacttacatatccatatccgtacaaatatgatttaattgcttccataccggttttcatgatgatttaggtttctagagtatttttttaggtaagatcgaattatcaccgaactattgggtgaatacgagttacctccttagacctaaaaaccagatatctttcaccattaactattaataccggatgaattacctctaacttaatccggagtgattttagtcctatgtgacagtgtagtaggcaattcatttttttaaatcaataggccccatctgtcagttggagtgaagacatggaaataaaaatatattctgaccttatactattactagtatagctaccaaatttaagtaatcttgcatgtacatgcctatgttttcaacaattaaacatttggtctgtaaattaaaatcatgtagcaattgatctatgttgcattgagggctatgtctgtaatgtactattgatatgtgaatcatctagaggcctatgttgcatagagctacatctggtctcagctagtactaactaaagtaagttttgcatgacattttctaaatggagaaaaagggaattttagagaaacatatcccttccatctgctcccactacttagggctttgcttggatggagccagtgaatggatcttggcccagaccgatggccattgattcgagccaagtccaagtttggaagcggcggtggcagtgttcccaaaagttcttgatctagttcttgttcacaaccttgctggccttctcgtaaatcgctgcctgcagattgacgtagtcctgagctttcgagcagctgccggtgatggtgcggccctcgatttcctccatgcaactgtccaggaaggctttgagctccgcctccgtccggtgtgtgtgcccaccagccatctaacaacccaagtcaagcaagctagtatgttgaaatgaacaaggcagaacctgtgctttacctttcgtaggtagtccgaatcgaggaggccccagtctagagaacactggtggagaaaccctctgtagtcccggttcgtaacccccctttagtcccggtttccaaaccgagagtaccaatccgggactaaagatcgctatctttagtcccgggtgaaataaccgggagtaaagatggctcagccggccacgtggctgagccatatttaccaaccgggactaaagatcgagctgaccttttttttttgcatggccctgttgctgcatggtttatatatatatatacatatatatatatatatataaaccatgcatatatatgtttcaatacatatatatgcatacatatatatatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaaatatatgaatgtatgaaattgattagtaattaaacaagaaatcgctacgtaatgaaattttgaatttatttgtacgtacatcgagctctcttgtggtgatgatttggtttgcaaggcagtggcaatactcgcacatgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgttttctttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacaggtgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggccgttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtcccctccagggtaatccagctcgaggtcctcgtacgcgccttcgaccaactcaacttcgaccttcgagtatcctgctggaatcggcctgcagtggtaagtacctgaagggtctgttgggatggccatgcccgacgccaccttcatgttgtgagagattatttattagtaatcaacatatataagcaacaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacctggaactctaggtctgcaatcttcgcctcggtatctctcttgctcctcatccgactcctgtacgtgtggatgtcctccttgaaaccaatcttccaaggaatcacccatttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttgcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttgcacttccgttatgatgtgccgaccctcaagcttcttcgctgcacctcattgcccgcgtgccctcttctgtccaacggagggttgactaccactagcctcctcctcctggttcccctctgcatccctctccacgtttccttcctcgttcaagtactggtttggatcctcgttcccctcttcttcataccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagactacaatagtcaattgctactt

SEQ ID NO: 28661 - DNA, 857 bp, Oryza sativa
tttgaattctcaatactagtgtatggtttccttcaattatgtagatgccattcatctcttaggcagagtaactgtattctttttttttaatttctaaagcttaatcagttaattgagcataatatttccttcagataaagtttaatgtgttctttcgtgaatatgatgtcatgataccataattaagtttctttttgttacccttcattctgttaccattaacatgttttaaaattcttatgctagatctttcaaggttccaagttaaattggaaagagatgatggaaccaaaagaagcactgaatttccagatagcaggactgcacacatttatggcgttgttcctgctgagagggatacctatcagcctcatattgagtctagtgaatggtattctgggagatggtcatgcaaaggtggtgactggaagcgaaatgatgatttcagccaagataagccttacaggaagaagcttgttctcaatgaaggctatcctctttgtcaaatgccaaaagggaatcatgaggatcctcgttggggctgcaaggatgacctctactaccctttacgtgctaaaaagcttgatctgccgttgtgggcattctcatcaacagaagaaaatgatgacactgtagatgatgccagtaaaagtggtgttatgcctgggaggtcaggtcagactaaacaacctcctaagggagtgaaggggacaacgcttcctgtcgttaagataaatgcccgtgttgttaaggaccaatcctcttctgaactccgtataaagcccaaagtagctgatcggccaccttctagatcttcgcgctcccattcaattgggactgataggagttctacccat

SEQ ID NO: 28662 - DNA, 559 bp, Oryza sativa
ccctttacaagctttcatcagaaaacttggtacacccacgccctgaaccctctatgccgttggcttattgcagcttcaggttgaatgaaccacacatcacaacacaattttttcaatggccattggacacttcggtgacggcttgacctttgacggcgtagaacctcctgtacatggagtcgacgtgggtgaggtagtaggtgcctggagcgagcaggctcgtgtcctggctcgtcgtgaaatccttggcgccgtaccggtgctccatcagcttcagcgccgccacgaacttctccggcgcaacctgcggcccaaagcatttgttgatcaggaattcaggttcatccgttcatgtcaagctactagtttcaggttttcagtcaacaagatgaagcagtggtcagcagctgcacttaccacatgcctggactccagtttcttggagacatccagtatgcctgcaatgtttgataggatgaatggatgctggccttcattgatcttgaaagagaacattgttgatgtcaagccactgccgtatgagaacatgacaatcctt

SEQ ID NO: 28663 - DNA, 965 bp, Oryza sativa
  unsure (1)..(965): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttgaagaagctggtggaagatggatatcttctttctgatcatctaataaagcatgctgacagcaatcggtgggtgactgttgagaatgcagcttcaccactggttccatccgaattcccctcagtatattcagatgtctcaacacagctggttagcccgccagaagccccaggtaatttacttgatgaagctcgagaggaggcatctggtactgaccatgaacaaatgaaggaagcttctgcagaagagcaggaagatttctacattgatgacagggttgatgcattgatggatggatctatcatggtggatggtcaggagcttgagattcttggaggtaaaaatgctcccttgtcgtttgaacctgagattcaaaatgttttttttttcccgttctcttttggtgccaatgggctagctcaatttgggtttttcttcagtttgcttggttatatcctttttggggttgcataattcttggtggtattggtacacccctcgatttctttgtaggtttgtagagggcgggtgatgcttcatccgtgattttgctgtttaaacctaatggtgaggtgtttcatgctgtccacgtggttgggcccgggttttataaggtgtatagatcttcttttggatacagttttttccgttgcaaaatctagtagcgcggacct

SEQ ID NO: 28664 - DNA, 996 bp, Oryza sativa
gtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagactacaatagtcaattgctacttgtcgcaccaattccgtagtcaataattatacatactaagtctaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacagacgactccgacaacacgtcttttctgcaagatacaaaaagatgtattaggataaatgcgaagtaacatatatatatatatatatatatatatatattgcatttcacgttaacgttcgtcctcgttcgttcgctcgttcacgttcgttcgctcgttctcattcacgttcgttcgcttgttctcattcacgttcgttccctcgttctcgcttgtcttcgatcgatcattctcgttctcgctctcgttcgttcgatcgttctcgttctcgttcacgttctcgcggcaacgtacgttgacgtgttcgttctcgctctcgttcgttcgatcgttctcgttctcgttcgttaacggtggtgtggcggcatcggggcggtggttggcgcggcggcgtggcggcggcggcggcgtggcgttgcggggccgtggcggcggc

SEQ ID NO: 28665 - DNA, 3303 bp, Oryza sativa
ggatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtagataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataatttgcatatgaatgatagtaaattaaatgttaaaaactctaattaacatatgaaattgccacttgcgtgatttaaaactttcaaaaatcctctagtcaattataattagcatatgtatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtagaaatatcaactcaaaactgacgagacattgcaccacttcattctgaagggcttctaatctatctggatcgatgaccttctgcgaaattgcgttcatgaatgcacatagctttgttattgttgcccggacattgtctggaaggataccccttattacaactggtagcagttgtgtcatcaacacgtaacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttcttttttcacatcgccgcgtgaccatcttcgctctctatatgctggcttccaggcccctttccgaacactactttaagatctttaaccatagcaaacactgttttcccgctgcgatgtttaagcttcgtacggtggtcggccttatgttcgaagtgcttgcctttcttccgtaccgggtggtttgctgtaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatg

SEQ ID NO: 28666 - DNA, 52251 bp, Oryza sativa
aacgggcagactatcttcttagcttggtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtgctccaacatcttgtccaatttatgggcctctttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgcactccgtgggatgtccaacaattatagcttggcatgaaccccgactcaaacaagtggaaataaatagtcctggatgcagaatactccttctaattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataataacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttaaagcttgctcgggcagctggaggaggaagaagacatatatataggggtgggactttagtctcggttggtagcaccaaccggggctaaagatcaccgggatcttaccaaccgggactaaagttacgatctaccaaccgggactaaagatcccgggggggcctgacaggccctgacagcattcgaaccgggattaaagatgagtaacacaaactgggactaaagatcaaatatgcccgttacccttttgaaccgggactaaagatcatctttagccccgggttttattgcatccgggactattgtggaaatcggccgaccgacgaaagatggaagaagcaactttcatcggggtgatgaggcgtcagaccagctgccggattgcttcagggaacttggcggcgatgaggattatggcgcaggctacggattggacgtcgtcttcggcagtggtggtgtagctggcgtctgagcgcagagaagtggaagaacccaccgaagaatttagattcggcgccagctctcgccgtttagccaaagtaaatggcaacggcggagagcatgcgacgagctaggtggaggattggtgaaagatgcagcttccgcttcacggctttggttgccatggccggatccataggatggcttaatatagccgccagctgaactccacctctccaccaaatctggcaatggcgcctccttggacatgggaagggacgcgaatctccaccactattaattcggcacgagagctcatcaggatcagcaggcgcacgcagcgaaagctgatgcagagccggctggaatcgacgccgatgcccacgccgactgcggcgctcgtctttctccgcctccaatgcgcgatggaggcagagattcggtcaagctgagtactccgatgcgcctaccaaccatgcttgcccgagccgtcgacgtcgatcgtgtggtctgccgctacagatctggagccgcctcctcgaccgccggtagctgtagtgcttggaggagaaaggaggagactcggcaatatccaatggacaaagcaatgcacgcatgctcgacagaagaagacgatggactaacacccatacatgccatcatacgtccggtgggcttctacggtactttaacaagccagcccaaaacgcgctacagtagtttttgcgcaccataatttcagcccatcagaatcatcgcatcgaacgcacccctaataattcaggtcaggtgatggctgctgtccgattcctgaatcatattattatcactttgtcggatgaagaaatgactaaaataagatcgatcggtggctaggtctttcagtcctccggattgcttatggtatggttggtggtgagattatgattcgatgatcccgtacccccgaagggcttgtatttatatacctctaagtagaactcagagagggcttcacatatataagatcataaagttggcatcccctccgaataggattctaacacctttgaattctattcaaggggacagtttctttctacattggtcaaattcctcactattaagacaaccttgccgtatactttgtatactgtgtaaccccaaggatagatggtatatatcttatccataaacctaataccccttatttttttttgcttgtcatccaaaaagtcatcagaaaatttaaaataatttaacaagagagatcaatatatgacatatctttccacaaacatgtaagttaaaatttaatttatacgagtagaaacaaaaatagaagttctgactttgaagagaacacataattcacaacagtcaaatttgttattttttttttctaattatataggtcgaattttaacttgtatgtttatgaagtggcatattacatattaaattatattatcaatttatttcaaattctaaattttcatcatcttattgcgtagctcgatcgattgctgcaatcggtttatcagctgtagccaaaatttaaaatttaattttaattatattttgatgtttttcatcgtaatttatattttgatggtattcaattttgttgtcatgcatgttcctaggattgttgtcatgcatacttgtattaaacagaggggcgatcgagaattttactcggtcacaggctctccgacatgtgattcctgaaccaatcattttgttttctaaagtctgaactacttggttattgtacctgaattactgtatgcttcaataatttagggaaaatagatcctcttacttactgggcctggtcggtaggcctgcctggctgcagccagccagccaacagccggtctagtcgctgtaggggcccaacagtcgctacaggatatggaaacgataaggagcgatgcagccgctgcagccgaacggctgggctgtgcagcgcagcctagacagctgcgaaaacgggctgccaaataggcccactgtcatttgattttaagtggttcatacgtgggctccacagcttataagcccacagatgagcaacctatgtcatttgattttgagtggttcatatgtgggctccacagctcataagcccacagatcagcaacctatgtcaaagatcagtaaatcacgtactccttccgtccaaaaaaaaaagggtaaactctagctatgaatcgggacatgcatcgtagctagagtttacctttttttttttttttgaatgaagagagtaggcctgaggccaaaacaggagtataatactagtgtgttttcaaggattttttttcccttctggttatgctgcataggtgacatcatgataagaatccctggagacctcaccattgttactatagttggttttgaccactttgctgttgaatgctttagttgattcgatgttggggcagtacgctttgctttagccctcgaggtatttgaggccagtacccctccctctcgaatcacctacagcagtaaaaaggaaaaatgaaaaggtaaatatgggttggcaacatgaaactatcttctgaaattgtccttagtcggtgcaatgctacactttgtttgattcttaaactgtcttctgacataaaaggaatttgacagccaaacgactgcattatataattgacatagcttaaaatctagagggctctgaactcatgaacaaaacagataattattttagtgctgaaacttagctatccaaggctaatcttgtgtgttcaaagtcagcgccaaaaaaagcagttacatgtaaattattttttaaatttgttttcatgtgtgctgttacatgtaaattgttgtttaatcactaactttagagaaaaaagaagcagtgcgtatatatagtaacgagtttatacataataatgctgaacaggaatcgaacagcgaataaatcagtctattcatataactcaaaacaaagtctgaaaagtataagattaatgtacaagattcaatgatgttaatcaaacaggcatatcacatatttacatcccaggtgaccatcaagcatgttatgtaaaggcaagccatcaagactgcacattgttatgtcacgaaagcaactaatcacaaacaagcaggaactaaataatcttctttttttaggtgaagtgatgcgtacatccttacaaaattaaatatggtttgaatctgaaaattacatccttgctttctggattcatcctactcagattcactgcatctgcatctccttttcactgcatccacatcaggggaaagaatcaagaactcacctgtgtagaggttgatgggattgaagcagaagctggtctagcaccacccacagaaattgacagaacaggtggagttggtgcgacgagcaacgatgagtgcgctgctatgaccgacgatgaccacgaagatcccttggagggcgcattggaagcggcagtgatggcggaggtctgcgagatcactaggaacggcggcggaggcggaggcggcggtgaaggcggcggcggaggcggcggaggaggaggcggtggaggaggcggcatcgaatccatggcggcagcggctagggttcaagccgcaacagcgacgaacttcttcgttcccctcctctttgactcctcgttcctcctctttctgatgctcgatgtgggctgtggtggcgccgccgtacgtggtggactcgccgcatcagcccacttactcctaagtggtttggcctaagtgggtaagtgggtaagtggtgcgggcctgtccagcggctgcatcagcccacgcacgccactgccagccttagttatgcgtgttctgctgtgtgctctcgatgctagttgagataataatttttgtttgctgcctacggccacatatagtggagaaggtttgtgtgaattgaattaagtcctataaaatccgtgcaatccaaaagatccttggtaaaatttacaagttcatcagtctctgaaaatctttaaaaaataattactcccatgacccattagaggataaccatgggaagcgattcgcccttacgtgaattgggtcctatatatgaataagaaagcttgaacaaggaaagtgattgatcgacgtcccgtttgatttattcatcacataagtggacaattaattctttgattttgcctttgatttttttagtgacgtcatgcatgtgccttgatggagagcacgtttgctatgcatttatgcggcacacacctcgtcgtgtactacatacgtgacaataattgttatctacgcattttgttttatcatgtatgacgtcactaaatcatttattatatttattttagtggagtaatatagtactaactgttgggattttttttcttaccatgctacccaaaataagaatgtgatatattatcatagtataatgaatctggataggatatatcctatccccttttacgttgaattattttgggacggatgatgttatgaagtcatacgaattacatacatttctgttgctcaatcttacaaatgatagttatttgttttgcttttaaagtaaccaatgatgcactcgtgttaccaaaatattggttttggtatcaccaatatggctgcgtttgagaggagggtttccaaacaaaatatatattattgcatgattaattaagtattaactaattttttttaaaaaaatagattaatatgattttttaaaacaactttcatatagaaattttttaataaaaaaatacactgtttaacagattgaaaaacgtgcgcgtaaaaaacgagagaggtgagttgggaaaacttagaggagaacacagccatatatcatcatgatagtatgataccaaactaaaccagccctgaaccaatcgatgaatatggtgatataattatatttcgattcaggtagatatactacaatcttttgttttggacggttggacacaaggaagaaaataggatgtcatgcgatgcgatgcgagcgtgccgtggggcgtacggtcgcgcggggggtctttgggttggcagttggtgacttggtggatggatgcatgcagcgtcgacgcgggcggtggcgtgcgcgggagggccgtgcgaatgccaaaccaagttgcggttgatctgggagtaccacacacgaacaaggaaagtgacttgcaaggcggcagatagaataatcagagaacgagagtattaaggtcctgtttggcacagctccagctccagctccacccctcctggagctggagctcagccaaacagtttcagctccaccaaaactgggagtggagttgggtggagctctctcacaaaatgtactagagttgtggagctgggtttaggcagctccacaactccactccagactcaactcctgaagttatatttaggagttggagttgtaccaaacaggccctaattttctcgtcacgtacgtcgggatgtactgtttggtttgcggcggatactaactttaccaactttttttccctaaccgaaataattagtcaacattaaaatttggagtaaggtttcagtttggtttgctatcaaaaggcattgccatgggctattttttatttgactaaaccaaaatatttgacaatgccaatttttctgagaaattttcttacaagtccctaagttttttttgcttaatctcttatatattaaattaaatagttgataaccttgttaataaaagcaactttagtacgtacagtagtgcttgaaaagaagagtaataataagctctacttttgagtaccgatggaagtctatacgaatagtcactactacagaatactcttttggtaccagttggaaaatccccttagatgttggttttcccaaccgacaccagggaggcggcactattgactccccggtttcaaaccggtacctttgaggcgttcgctagcaaaaaaaaaaaaggctcgatgcaccggctcgaattgaccacatccatcccccgcattgcccccaaatctcaaatctacaacatcaacaaatcaaccaacatcatcacaacaaatcaaccaacatcataaagaaattacatactataaactcccgaatcaaccaacatcaatcacagacatcacataacaaacattgaaagaacaatgaacaccaccgctgctcaccgtcgccgtctaccagatctgtgactgctgcctccgtcgccccgaggattcgctgtcaggccgccatcgggccaccacaacctcccctcccatagtcgggccgtcgcctccacgccgtccgccaccgcccctcccctcccgccggatctggtggaggggagggcgccgccacccctcctgcccctgtcgggccaatgccgccgccgccacccttcttcctgtcggatctagcagagggagggtgcctccgggcacccgccgctcctccctccacgcatcgctgacgccgctcctccagctgccgcctccgccaccaagagaggagaaagagaagagaaggtgatcgaaagagaggggagagagagcggatagaacgagagagatcgagaggagacgagagagttcgagcgagtgagcggacactgcggaccttatctcctcgacgttgtgttcgtggtgggacctgccggctcggctcaatttgtaagtgccgacacctaggtttttaaaattaaaggttccgtttttttttaaccgacacaaaatggaataggtgacggtttttatttagaaccaacacttataattacttaaaggtgttgattttttgcgattttaacctgcggaggtgggaaaaggcctataggtgccggttttagcacttccggcacctattgtgccaacacctatttgatgttttgtagatgagtctgtttgttgatcttatctattttttctgaaatatgtactagatggtgagacaggaacggcggagtctggagcggccgcgacgatgcatgagcggtgatgatgggagagagcgcgatgacactggaggggcggcacgggcttgagctagcatcggcggcctcacaacgggcagatccagccctccaacaacgacgaaggggtaaggagtgccggcactggaggaactggatctagcgctactgggacgggacaacgacaacgatggtggcaagccgcgtagtggcagcagccttgggagcggtggggactatttcggctatgacgacgacaatgacgcactgcgacaacgacggcggtggctagggtttcgaattttagaaattttctttttttgctttttttaggtggacggcttaaccgattttcatagacaccttgaggcaggcgggcagcgcagccatttgcaaaaattttgtttttaccatttgtaaaaatcgtttcggactttctgtagtagtggttgctaattacactactagaaaaaacatttttcccaacataggggtctttttttcgcagacggacatgactcttagagccaaatgaccgcctacaaaaatataaatcggggtgaagtttgttgtccgcctgcgaaaataggcggaccacttaagcggcgcctgcgaaaatctattttcgcaggcgaaccttatgtggtccgcctgcaaaaatcgtacctaacaaaaaaaaatccacccttatcttctcctcccacccctcccaccactcaactctctctctctccctctccctcactgactcagtctcctctcctctcctctcctctccctcactgactctcctctcctctcctctcctctccggcggcgcggcggggacggaggcgcggtggcacggcgggaatggaggtgcggcagggcggcggcgtggtggggacggcggcgcggccgcggcatctcccctccctcccttcctcgcagatctggccggaggagggaggggggaggccggcgggggcgacggcggcgacgacagcgtggggcggcggcggcgacgacgcgcgcggggcggcggcgagccgcgtgcggcgatttttttttttcgtttttttgcattttcgcaggcgggccgttgccccgactgcgaacgttgtggtgcaggcggacctccctcccgcctgcgaaaattagttttggtcgcccggaaaaattagttttctagtagtgttattcgtgccttcattgtcctttaggacacatttttagtcgatcggttcatgtgatgtggccttttatccacttgccacagaagcttcctttttgtcttttgcaacgtttcatcgaaagcattttttgttccctttttcctctataccaacgttgagaaaaatggccaactttgccatagatatggcccagaagactgcggcatcgaaataccgaagtaacaagggtaaatttcatcgaagctgccgcttataataaaatagagtccatatggtgtccctaacctataaatagagaagagatcagatcggtttcacgccgtaacctccatggttctatcttgacagtcttacatatagagattcaggaattctccgctcactcgcattcgatcattgtctcggtagaattgatgttctagctcttgtccctccctagaatttctggtgctaaagattgatctcagcgaagaagattgcagatactttcgtttgatgttgacgttttctttccatcgtttcttccccattcgggcgatggccggcctgtcaactgcaccggaaatgggagctgccgtcgtcgccggcgtctgcgtcgtttcggcggccgtcgcagccgccgccgccgcctcaccctcaccggaggctccaccaggtccgtaccagacgtgcgccattatggccttgtgcaccgtgttccatggcggcatggctctcctgatccatggattccggcgagcaggagctccgctgcggcgcccttgacaccgccgccgccgctcgccgccggatatgcgggctagtcaccgcagttcttgactaggcctaagaaggacttggcttctctgcatctacgtcaagaatccatttgataaattaagcttgcattttctttccttgtgaattcttggttggatgcagggaagccaaggcccgcttaggcagacgctgctcctttagtgtttgggaccaaatcaacaagtggtgttctttcgaattgtccgtctaactgacgttgcttctactttgatcttgatggcagtaagaccgatgatttcgaaatgattccactagctggattgcttccaaacacagacggagcaccgtttgcccaagtgttaattagtgttttttatcctactgattttgcgttttattctttgtatttatatatactttctccatttcaaaatatatgacgctattgacatacattagtgtccttttttaagtataagtgtccaataccttttctttaatagtactacctccgtcccaaaataagtgcagccatgagtttccgcgtccaactttgatcgttcgtcttatttgaaatttttttataattagcatttttgttattataagatgataaaatatgaatagtactttactcgtgacttatgtttttaatttttttcaaaaaactttcaaataagatgaatggtcaaagttgggcgtggaaaatcatggctgtacttattttgggacggagaaagtacatgagatcttttgtgtatggtcaactaattatgatgacattttgctatttttagtgtctattgtctgattttgaagtgttacgaaagcacggggtcttcatgcgttcgtgcgtactatacttgtcttgattagtatggtcataggtcaggttaggtcccaaataattggcttccgagacggttgatggcttgatggttgtgtgtaaagctactatgtactttctctgtttcacagtgtaagactttctagcattgctcatattcacttaaatattaatgaatctatacatatatatatatatatatatatatatatatgtgtgtgtgtgtgtgtttagattcattaacatctatatatatgggcaatgttagaaagttttacattgtgaaacggagggagtactaattatctgcacgtttaatttgctactgaggtcaatcacagtgcaggccttacatctgagaaagtacttttcgtgtggatgagggatcgatcatggctattgatatgtttcaattctttttcatgtgtcatgatccctacaagaattgaaaattttcgtgcctctataaggaggtgcatgcctggattgtcctattaattgatcaatggttgacaacaaggaaaggaaacggttgaatgtttggaacattccacccatcgtcgttttcacctttctataagccacagtactcatgatagttacgcatgacttaataattcagcactacaactcagatggacgattattcttacgataaacaaagacaggttgggaatcttgtgatccagacgacatctcattaaacgttaaatattgttttcttccttgacttgtgcccatctgaacctatatatccatctgcagtttactccttccgtcaagaaaaaaaaggcaaaccctgagtttccgtgtccaacgtttgaccgtccgtcttatttaaaaaaattataaaaaaaattaaaaaaacaagtcacgcataaagcattaatcatgatttatcatctaataacaatgaaaatagtaattataaaaaatttcatataacatgaacagtcaaacgttggacaagaaaattcaggtttgtcttttttttgggacggagggagtaggtcacaatgacagtaaagcgcttgaaacttatacccaccagaatccaaagcttgacgtccattttttatggtttgtcaaagttcagagataagagttcttttggaacatatgtataggagttccatcgtttcagagataagagtttttttaatatatatctataaagagaggccgcacctctcccgctttcattaacgaaaacaatagaaatacaaggtttgataggtccaggtaacaattaaacaaaacaaacagcaaaacgatcacagccgacatatcacaagacattgctcccatgcatagacaagaaagaaaagcactgaaagccagcaatcatcatagcatcagcctaggtcatcatcaggtctccatcccaaacgtctgttagctcctctctagccaaaccttgagtgaaagacttcatttgctatctgtttgagaagctgagccccccaaagcaccttttctctgtctgcctccttgatctgcaaattgctccaagaccccaaagtgaaacaaatggtggatatcaattcagtaggatcagttggtaaaatatgatcaaaacaagctctattcctggctttccaaaggatccataacacagcagccacacccaccaggactatttttttttgtattatttccaaagaaattcccttgcccaaacatactaccaatatccttattaggtctcacccccagggcacactcgatcacgcaccaaataaaatgagctacaaggcatcgtgacttcgcgattttagctataggacgccgcacgaagtgactttagggggaacactctcaaaacttgaatatttggtggttgacagagcacccattaaaataatcattttcgattgaagaggaaagagaaatcatgtgaatgttagatctcccatctctcttctctctctatcccctccttccacactgccgggaactcgagccactctgaggtcgacgccgggggcgaactccttgggttggattcgcttggggtggttctcgacgagggtggagacgacgatgggaatgggcacgaagtccattctgctcacgtccatgagcagcctcacgtcggtgaccaggcaagcgttggtggcaaggaggttgtgctcgccgtggcccggcacgcccatcggttgccatgcaaactgcgcctgcaccagcagtgtcgtcaccctgaaccagtaggagccaaacatcagctggcgatcagcggcgatgagatcccgttgtggctgaggagtagggggagcggcgccgccatggagggagggggaggagtggagatggagggcatcgctggctgaggcgagtgcgcggggggggggggggggagaagagataagggtgagggacagatgagaggagataaggataggtgggagaatcgaggcgcgcgggtacactgctctctccgctctgatgggcggtaaaaaaagcacttttataacttactttttttattaaaaaccgacatatataaaatttataggtgttggtgtttaacttttatcttttgtaaaagtcatatggattagaaaatgctctataaatactgattttaaataaatcagcacatataggggtgtccctaatctgcacgtataggggtgtgtccctaatcagcaacatacggaacaagtaagtttatccgtggaaaatttttaatttttagtcaatttagtgattattgattccctgtaatctctagaaaaaacttatctttttatttattttctaagtatagtcaatgcatgtgtaaaaaaaaaggaagtaacttatgatccttccttgggttcgttttttcaatgttggtgcatattcgattgattacagtctcacaggtgcgaatgtatatatatactagaaaaaaaaatgctcatgcgttgcaatgggtaaagatgcttttttcggtgatacaacaactgttagaagccgaacaagaaattgaaatattgggatcactatacactataattgaaaaagttaataaaaaatcattttttggttttggaccgcgaaacgttattacttccttccttttcagccctagcctagttcaatacctccctacgctcggcatgtatttcttcggcccaacacacaaacacgtccaagccacaagcacaagtggagttgtaggcccaactcacatagcctactacgatcttgaacctccagaagacatcccatgcatgcatgatgccggagccgatcctcgtcatcaaatccggccgaatctttctcgatcttctaaaattagttgagggcttttgatccactcgatctcctcttgagagaattcgtaaaaatcgggataaaaaggcgaagctcgctagtcggccatcttcaatggagattaaaaggagaaatcataggaaaaataatgagttaggagtggggaatcgatttttacaatcaataatacgatgaaacgtgcggggagacaaatcgatatcgcggcggtgctagggtttgggcccgggccctgagagcggtaaaaaggggcgatcgtatcggattgagtggaaacatgcgatgatgaaaaaaccggatggataaaaaaaaagaagcccaatcggagatttaaaaaaccgtcgaaaaaaatagatgggacaataaaatatattcaattaaaaccgaaaaccgattcaaatacggatgtacaaaaaattcagcaaaaacattttcaatttttataatagtaaagatagatatatttcttgctaaaaggacacatcagtatatactacactagctacatttttcccaagcactaaactctgagcacgcatgtttcaagactagtaaagttgagtgtatatactgattttacacaaactcgtgtgcttcaatttgtttggtatatacactgatttttgggtagatgccaatttttggtatgtgcactgactttttttgcgcatacatactctgaacttagatacactgaatttgtgtgcttcaatttgtttggtatatacactgatttttttgcagtacacgggaacttttcggtacttattcatggtcatgcaaactaattaatacggtgtattttggtacatcgacagaatatacacggcacacgagacgtatatacctaaatttagatacatgtactggtcagctcgtactgtacagacttcagcaatattccacatacatacctagttagagtaaaaaaaataacttaattaaaaagcctagctagtttcaaattcagttctagcaaaaaaaagggtaaacttcataaaaaatctattttttcagacgcatttatatgggtatataccctattagaaatggtatttacccaaaatatgtgttttagtggtatttaatgcgtgtttaaatagatatatacccaattagaattagaattattgtacgccagacatacccaatatatatggatgttctcaatggatatatacccaaataaatggtacatctggaatgcatgcatctatatacctagctcagtgttacatttggaatgcatgcatgtcgcatgtaccactttttgggtagctgaaaaaaattgatacacacatcgaattggatatatacccaaatttttgctaccttagttgagttggtatatgtagcttacaaaatggaaaatcgttgatacagacacacggagctaaatgtctcaaaaacagcgggcaaaaaagtctttgaacggttaccttattaatatgtacctaaataccagtacagatacctaaaatttatattataaattttcaaaatatttgatttatataattggaaagcataatgtgctaatttagatatgtgtacacatgcataccatactataaatgtaccagattatttataaatttgattacaaaatatttcaaataattagtttttgtatttccaattactaaatacattattttcatattttcaaatatttagattccaagttccgatttatattaccatataccaaccatcttatgtgagcagcttcttgagctttgtgtggattatgagcaggcagtaatgtagtagataggctctgctgaaggccggcccagtggatgcttcccataaaatggctcagtctagggtttgaggctcggctgaaggccggacagtggatgcttgtcgtaaaatggctcagtatagggttttgaagctagtggatgcttgttataaaatggctcggtcttgtgttttgctcctcaattcgtcttgggagctgctccgctagtgtcctctgtagccgccgccgcaccgtcaccaacatcagcctcgccttcgtatggccatgtcgagcatcaggaggctttcgtgctgccacgtgagtaagcttccctagatctcactcttctacctccctctctcaatttctctataagatgggtgtgggattttgtttctcccatctttgcgcactaacaccttattcccttaattccttatacgagagacctaacataattacactaccttggtcggcttctaaatgggattccttcttctccatactgatggtggtgcaaaatagctaaaggtatacataatagaaaatcaacatagtttgtgtatatgaccttgacataatgggtgtatatgacctttaaaatccacatagttaacatactaatatatttttttctcttttacgattttgagcattaggtgtttagatttggcataagactttacatatggatccaacacagacataagtgtttgttttattagaattgtagcattttttaaagttgaaagatttacatattatttatttttagtataagcataaaatacatatatttagaaaatggttatcataattacagagtttaaaggagcaaattgtttacgtcatttacctgtttattatttttagtttcttgaaacataggatatatggtcacgatacttgccccgaataatttgcttgaattttacaaaaggtattttttttgtctttttaattatttttagtttttgaaacatatgatatatggtcacgatatttgccccaaataatttgcaaagaactttacaaaaggtttttttgtctttttaatttttctcccaccccttttacatgtttgtgttagtccgatcaggcattgttgggttgtagtgctgtgtggtccgctacgcacatggagcggctcttcttctctttctcttgtcctcttttttttaattcaccgtcgtaacttgcacgcttgctagttttatacatagggttccttacctgacgcttgtgctgcttgtatcttgccacgtgtcgctttagtaaggatggtaagggcagccaatcagctaacacgaaaccaaccaacatatatatagatagatagaatgcaaaggggaaatatattttgagaagccctctagaatttggatattgtgctttttgtttcttttcttatggatattctctagatttatgtcaaagaggatagataattgggaagtctcaaatggatatatgtcttttcttttcttttggctattttttcttatgcataattttcttagatttatctcaaaatttaacaccgtcatgtggcccaataagatgttcgagacgagccatctttagaaagataagatatctttttctctttggatatgttttgggtagattattttgttgattattcagttcatttgttttggttagattatttggttgattattcagttcattgttaaaaaaaaccccttacgattagattaaatgtaaaggtggtgtttagtttgacaccttatcaaatctatggaaatttggttctttactttactattttatagtgacccattatagtgacctgttatggtcttagtttaatttgcatttcgtaatttaatatgaacaaaatcaatctatctacttctattattgtagtttaccttcagctgagaggcatagcctctcttatttccttaaaaaaaattgcttttatttttcccttttttttgctttttttttatggacgaaggaaacatctcttattttttaagtagtagagaagagaagagatatagcaggaggaaaatacagcccctagggataaaaaagaaaaatgtccaacatagctatacactatacaagatgcggtagaaactcgcgcagacgcttagcactggctagcatccacagcctagcctgttacttgattttggcaagcaggtatttcgatgtggactacatgtggtcgaagatccgttgattcctttccttccaaatttcccacacgacaaggaggatgagggtgcgcagttccttcttggggacttctgtcgtgtttgctagactttcccaccaatcctggactgactgagcggcctcccatagtgcccaagttcaagatgttggtttcccacccagctggctacgaaggtccaaatcctttttaagtagtgacattcggcaatgaggtgcagtgccatttcaacctctcttatgcaaagaggacaacatccattattctgccagcccctggtcgcgagtctgtcagaggtccacactctgttttggatgataagctaggcctgaagtttgcacttcccaggcgcccaaaccttccagatcagcaagttgaaggttgtgctgggggcccaaaacattgggcttcataagctaaagatgccgagtagtgcccatgactggtgagcttccaattaatctgatggggctactcgtcgctcaaatgcacgttgtggaccatagtccacaaagccaaaagctggtcaattagctcgagcgacattagcgggttcgcttctaggtctagatctcagacccatgcgtcgttcttctttccttggtgcaaggattttcttttcttcatagagattgcgtagacaagtggcatggcgtcttttggcctgcgcccatcaacccatggcgagttccagaagcgggttgtgtttccatcactgattgagaagtttgttgctgccgcgaagagggtcttgtcgattacaaagcatctcgaggcccacccaatgcttgctcggctctttccattcatgccataaccaacgcagtcgtaaggcccttgtgaatttcgccaagtttggtacgccaaggcctccctgtttggttggcatgcacgtccttgtccagatgaccttgcatccccctgcgatgtcccccgatgtgttacttctacctctcttttcactatccagtggcaacactttactcgagaacaccacttttagcaatactaatgtgtttttaatcctactcagtggcaatgctaatatgttatattctctcatttcagtttcctccagaagacaagggacctgagggtgctatggggggtgacaagggacctgagagtcaaagctgatcttggaattatacattttggtggaggggtcttcaattgatgcaagggatgaactgagtgtgttttttattagaaacttggttgcttaaaaacttaggcagttctgtgaaatattttttggggggcgcatcattttgccctggcccttggggagtactaattccatgaacttaattattaatatggcatgtttatcttaatgcttgaattaaattcaaagtggctggctggagaaatgtgaaagtttctttgtctagattactgcaagactgcaatactattgttgaatgattctattgaatgacctgccttacattactttctcttccattgactgaccttaatttgagctatacttctgcactacttccttttgaaatgtgccccttaatactcctaaatctgccttctggagctcagttttaatccttaggcaaaccctaagagagtccgtcgcctggcagttggctaaaggccaggtttccatttggagccagccatgatatgaaatttcttcctcaatccatgatcatcttaaccttgactctattccagctcacatatgtgatttaaaagttataagtcattaaagaggttaaaaaaagacatgcgccatactaaagggagatttatatatgggatgaagtggtcttcggttaggatataaagcgctaccgtgcattacctagtcacggcccgagagaggacactcttctggattaactcaacatgtatttgcaatacaaagagtgcctacaaggaaattttgaaaagaaagaatcaatctttactggaggtggcattcgaacggcctacacagaaacttctttcaactctagagaccattcactctctttaacattcacctccaacctttctgacctgagtttctccatcacaaacatctaacccctgccgataacaaaataatctttgacttcctagatgagcttagctatatagccgctcctcctcatgagggccttcaacctcaccagagacccggggaataaaaacaatgataactttgcagcgaacctagcctatgccttcaatgacacaaacaactccttgtttctttttgaattgcctttgccggacaaactctataccaggtcaaacaaaagggagattcccgtgctcgccctgcttgatcgagttttcatcaactactagaataatcttatccaaaaccccatcctgaaaggcctcatttggcagcccgggatctggccgggatcccggcccataccttgggaaaaagccccgctaggaaaatttcccagggccatatttcctgaccatttggaagcccacgaggtggatttttcagacccaaaccgtgtgggatacttggggaaacctcccatacctcacgaggttaggaaaaaaatcctcgttgtggagcctcatcacctctgtgcctcttcctctcgcgggaactccctccatattaatatgtaggaataagttcatttgaggtcccttaacttgaccacaatagcagatacaacaggtccctcaactatcaaaaccggttcagacgagatccctctgtggtttagatggcggttttggctgacgaggcgcctctgtgggccctattgactaggtcttcgagccacgtggcacttacgtagcaattttatccggaaatataataaaaccgcggggctcacatgtcagtcacacacaaaataataaaaatggtggtgccatttggccccacatgtcatccctcttctctctatcctttctctcacctaggcggcgcaggtgacgggcgagatggggcagagcggtcggcctgtgaagcggggcggacggtagccggtgtaggccggcggcggttggagcaagccggcacaagcgacggagaaggcggcggaagtggcacggtcgcctcctccgccattgtacctaccgctgccttcgtaaccacatgttaacgaccaaattttgtaagccatgaactaagttcaacatcggaatcgaagcggattcggcagggaatcatattatgaaaacagagtgcgcatcggctacgagagcatcggctgaaggctgcatcagctacgagggcatcggttgaagactgcatcggctgagatggatcggacagaagatagccgatgtagccgatttcgttgagatggttgtataatcgtctccaggattgatcaacgtgctacgcaaggattgtcgcgatggagataagctcacagataggcaattgtatctattagttaagatattttaaatagtttctttagagatgtgtttcggcaagagtctgctgtatagacttgttcgtatcttagagtttgttagagataggagttgtgtccggcaaggaccagtcatgtatctcgggtataaatataacccgatcccgtgtaatttacaacaacagttcaataacactttcggcgcatcgccacccttttctactttcattgtttcgacgagttcttgctttcgggttgaactgcatcgatttcaatcttcaacaagaggtaaaacttgtcatggcggcttgcgttctcgggattagtgcttccatctttatgatactgtaatcttggttatgtaaatcgtcaagttatcatatatgcttcataatctttattaatatcattacctaatcttaaatcggctaacagctaccacaagaaggtagctgatagagttagatatagttgttaatatagattgtatagcatatctatcatcttttagaggttttcatcaactcgtctagatcttgtatttattcttatgcttaatgctgcatcggttgggttcgatctattaagtaatattcataactacaatatctagcttgtctcatgatcatcggtagagatagtatcggggtttcagccgatcttacctgatttagctacctttattccctatatgtttacttgatatgctgaatctgccctttatattaagatcctattgcattaaaatatattgagcttgatgtttgatatattctatctgttttaacatcttaatatagagttgtatcggagtattagccgatacatgttagatatatttgatcggctatgctatgaacgtatatataatctttatcttaaagtacttttaggcataagtgatttatactatctcgacttgctgttcgatctatcccaatcacttagcttaaatatatttcgagaaaatgattatacatcattgatatctatagccgatcgagtagacttaactttatattgctttattattcatggccgatctaatgtcagttacattggctcaatggtcaacaatatgtcatcggtccttatccgatcggctatcgtttatagatttaacctcgttttctttgttcttccttcttgttgattgcaggatcaaatcaactggcacgcctttgaacccaagagcaagatttaggacttgcactggagttaagcagatctcccaggccagtgtgtgtttttcgcatcaacaccacggtccccgcagccgctgggaagggatccgccggtgagcgcgacgctgcctggcacggtgatgtgcacggccttgatgcggctaaggtcgtcgtcaccgacggcagtgacttgccggtgttgtacaactggatggactacgcaccgacgttgtgatttcgcccgccgctggccacgactttgcatgtcgccgctgctatctcgccatcgctgccaagcaaccgtcgctttctaccgtctcaagccgctgtcgtcgtgtcctccttggcgacttccaccggaatcgccactcgccgctacggaccaccgctgctatcccactcgaatgcgacggtggccgccgtcttctcgcttccccaacggctgctgccaccgatgtcattgaggtaggaggctgaagaggacggcgccgctcctggccctgccaactgctgcaacatcgcgcaaggacgatatgggacacccctggccgcgccggccaccacagcatcacgcaaggaggatattggacaccacccctggccccgtcatccgccggcgctggagtagcggagggccgagcgccgtccctagccccgccatccaccactgacatgagggagggaggaggaggcgctgactcgctgttgagatagagaggagtgtgggaccctggtcccactgtttttttcgaatggtatgtgggccacacattttccaatggcataccgtcgattagaccaatggtatctaggcggttagacctaaacatctacactagtcattccaaacttggttcgcacgtatcagataagttggtgcacagaaatgagtattttataagttggtgcactaaatacacccacatgacaagtccatatacttcaaatgcagcttacttttatataaaaaaaatgctttttagagtttcagaaccaaaacttttgtgtgcttaatgcgagcctcagatttctgaactgaaccatcatgtttcggacatttgcccgatgtgtctttgtacgtactgcttccatgcttcaccctttcttccaaaacagtgaaacagaattcttaaacagggaggcaaaagcaaagttttatccaattggcaaattttgctacaggcgcaacttcgtggttttagctctagaacactgcacaaagtcacttttgggaaggcactctataatcttggttatttgccaatagacaccacacccatttattaagtgttttagtgctgactaggagagagcgggcccactttttgttgcaatgtgaccaaattgtcccttcccatctttctcacttaatccaatcccctcagccggctccttcctcccctcacccaccgaccggcgccactcccccctggcgcccttacgggcggcaggcatggaggggagcaactgcgcgctaatcgagcgtgcctccgctagcgaagtgagcgaccgcgccaccacctcgactccgttgctcgtgggccagcaccactctccctccccctacccttggccagtacagaggagccactgcagcggaggcgaaggagggagggccggggtggtcgttggcagcaagcggagatggtgttgtggccggagtgtgagagggagtgagatgtggaggaagaatatgacaagtgggtccaggggcatttttgatatttcacattgtttatctctcctattcaaccaaaaattaatattataatgtcggcggtgtccatcagcaaataaccatattttcatagtgcattcccccaaggattgacttttgacgtgttctagagctaaaaccacaaagtcataatgtcccacggcaaaatttaccttgtttctttggtggttccaattaattgtggacaaggagcattgatcccctttttctaaaaacaaaagaagatgagggatgtggtacattttctgtggtttcccattgctgcaataaaacagtaaatcattataccagatgacagaggaatttgttgcatccaactcattacaagggtaatatttctacttgtgctgttgtgcagtgctaaaaaacattgaccgatagaatagtcaaattagccacagactaaacaaaaatacaaagtaaacagcagtaagtaatgatgtccatccctccatgctgtaatttagtttggctaaacctagaggcaaaaccggataaattaaacaaaatcatggcaactgaaagctttatcaggtatctttatctcacttaaaagatactaacaacgaaacattcacattcagaccattagactatatgcaaaactgttaagaagatccttacacaaagtaatcgtttggactaggcagcttgtatgtaaacatcaacttgtcatctactcctttaaattaagttaaaacagttgatgataaaaaacataacactgaacaaaggaattgtccatcaataaggagacagacacaggaacatatttctggtgatctaggtcaagttggaatttcataatgctgcgtagaatttcttattcataaactgaaacagaagggaaaaaaaatggcaaactccgtcaggttttcatctgatgaactagtgaacccccccccccccctctctctctctctctctctctctctctctctgtgtgtttaaagagcagtagtataaaattataatacccggtgcctctatatgcttttgcagctaccgctactctttgtctgctcggtcgcaatcactcatccatatcgatataaacacagtatagaagtgctttcaacatgttttttttttgcttagatctaatcgattatggggattccttatgcttccatttactgatagaagatagatagacgaggctgtaaaaatgttgatcctcctcgcgaaaaaaaaatgtttatccaacatagttcagagtacgtgaaatgcaaattctgaatataccccaaaaaaaagaaaagaaaaatccagggccgacataagacttcgatttgtgcaagactcaagaaggagaaatcctacacatattctgatatcaatttgcacaaatcttgctcaaagaaatgaatatgtgtacagaacagattccagaccttgtccttggaggaagaagcacaatcacatcagcatgaatgtcacactcccacttactccctccgtccaaagactcaatttctagctttttcgtgttcaacgtttgactatccgtcttatatgaattttttttttacgattattattttcattgttgttagatgataaaaaataataatattttatacgtgacttatctttttaatcttttttataatttttttaaataagacggacagtcaaatattgtacacggaaacctaggaattaagttattttggaacgaagggggatcaagacaagaggaacatgacagagagaggatcagggtgggtcaaaagataaaagggtaggaatgaatgagacaattggcatttttttgactttccatgcatcggatcgaattccagctacatgcagacgttgcttctccaaagtccattgcggaattgcaccgcccgattctccaaagtccaaactcaaacatctcactcctttcatctcttgtctcttccatcggcgatgtcgtctgattaagtttggagaagtattgttcagcctcatctcggttacagtgtgcctgtactgcatactagtgtcatttgtgcttgtaaaggaagtaatagtagtttgtacgatgatggctttacgtactggatatggattttttgtgtcccttgtttttttcttttcatgtaaaccatatatcactgcacaagtacatggttaaattcgatttctataaattgtaaccaaaataataaattaaactctaactaacatatgttatactctatatgaaggccaaatatggatgtgcatgtttgttgtgtgattatctcatattagtatatcttaatgtttttagaaaagatataagtatttaggtgacataaaagaaacgataaaagaaacgataagacatctccattgagtgataaaagaacactatcctctttttaacacaaacaaataaaatacatttcgacccatgtgttcaatggaatacaactaaatataattactagttaaattttctttgtgatttctctgagtatcagagggcttaaaaaaacgtgtaagggtgcgcgtgtcttgcatgcataccctcaggccattcacaatggcgttcagcctcaccaccaaaaaaacgaatattccttgcatatcatcaatctgcgcagcctcattagtaccgcggagccaactttggctatgggttcctcgtggtgatgacgttgtttaagtacgtttagtcaatccggatctgttaattggatatggtgagagcattagcagtgcgccgttcacaaatgccgaacctcaccagccccatagaaaaagaacaatataagctacacgtcttaaatgtacttaaacaacgtcatcaacgaatataatattgtgcgcatatatcatcacgcgaggcttccatctctctctactctccccagtttcctctaggactcccttcgtcccattttaagtgtaaccataattttcagcgctcaactttgatcgtctgtcttatttgaaaaaattttaaaaaaaacttaaaaacataagccatgagtaaagtatgattcatgttttatcatctcataacaacaaaaatactaattataaaaaaagacggacgataaaagttaggcacgaaaactcatggttgcatttaaaatgggacaaagggggtaccttctctctctccagtcttgtacgcggcagacaacttcgcggatgcttcggcgggttcggcctcacactcgactgcaagcaagactgccgactttcggacaaggtgtgaaaaaccgccggtaaccgcgcggttaccgcccgtaccgcgggggtacggttacccgtaccgcgcggtacggtttaataaaattcgtccaaattcaaaaatttaaaaaaaaagaaaaaaatcaaaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgctttcggacaatagttacgtttcaaaaaaatacttcggacaacagcttgcgaaaacgaaagctatcgagcacctacatagtacttaatttgccctggggctggggctaaggccagccaaaccttcatagcatcatcgtcctcctcctctacaaacaaacattctccgcaccagcgcaggtgatcgatcgatcgatcccaattccacctgatcgaatacctgatactagtgcagctacagctagagtacacacaacttcctcgatcgatcggacccttgtgttttcgtttcgcggattctgccgatgatgaccgggctgggcatggtggcggctgccgtcgcggccaccaccgtcttcaacgccgccgccaccgccgcaccaccgccggtgggggccgtgctgcttctttgtgccgcgttccacgcaggcatggcgctcattatcaacggcgttcgacgcggacggtgacgacgacgccgcccccctcgacggcgaccgagcgggtgcgctagtcaccatccgccgcgcggcgccgcccgtgactaggcctaagcgggagcctggctcctctgcattcacggtcagaatccatggggaaatttctcgtatctgaatattcctttggactctcacggtgaaagcagtggaagcaggcctctcacttaggcagatgctgttcttccagtgtttggaatcaaaccatcaagtggagttcttttggatcatctgtctaactgttgttgttgtctcagtttgaacataatggtagtgagacggatgatcttgaaatgattccactcgctggattgatcccaaacactagcagaacatggtctgcccaagtgtgagctgatggttcctttttttttctttgcgtgccttgttttttccccttgtttactttgtttggtgggttcagtgtctgtttgtttttattttctttctttacagagagaatgagaataactgtaaaatttgtctatcagggaaattaaataaatatgacatggtcaacgacaaaataattccatgtgtcggctcgcaactgatcagataagttgccatctgaaatgatctgtcagacaacgttggattgatccgaaacactagcacaacatgcgcaagtgtgcgctgatagtatttttctttttttccctctcctacttttggttttctttttgtcatggtgtgtgctttgtttggtgagttcactagtgtctattcggttttagtttatttcttcctttttttagagaggaaaagatttacatgaagtactttacaaggaaataaatgtgagctttattattttgtacgaaaaggacatagattttagatggtcaacgacaaaacagaaattccagttgtgttggcacaaactgacgtgccaactgccaagagcttccatctgaaataatctgaaggaagaacggactctttcctcgactttgtctgaaactctatggctgtgttagttcctttctaagttggaagtttgggttaaaattggtacgatgtgactgaaaagttatgtgtgtataacaggttgatgtgatggaaaaagttggaagtttagatccaaaatttgaaaggaagtaaacacagcttatgatagacagaaaagtgaatcttctggcaacgtaagacgaatggtcaaacgtatataaaaaattaacgacaacgacgtcgtgtattaaaaaattgaggttaattttctgattcttgaatctcgtctgcgtccaccacaaccgcttaattaccgtgtacaaattgaggttaattttcaaaattatctgtttgcagatattctaaacagttaaactagtactggggagaagaatttagcagagccaatcagcggttacgcagaaagatcgagaattttatatttttattcggtcacaggctccgacgtgtgattcctgagccgaccattttgttttcggaagtctgaactgtttggttattttacctgaacaactgtgtacttaataatatagggaaatagatctctaacgtattaccgttctcagattttaagtgacacagtatttagttccctttaaacttttaaaaatttcatcacatcaaatatttggacacatacatgaagtactaaatatgaacgaaaaaaaccaatagcacagtttgcatgtaaattgcgagacgaatcttttaagcctaattacaccataatttgacaatgttatgttacagtaaacatttactaatgatggattaattaggcttaataaatttatctcgcagtttataggcgaaatctgtaatttattttgttattagtctacgtttaatattttaaatacgtgtccgtatacttttttaaaaaattaggccacgaactaaacacggcctgagtcatatatcagccccacaacccatgggttcacatgacaacgacctaggttagaggtcagtaaggccaatatgcatgggagtataatagataatactagtgtgtttgcaaggatttttttttctttttggtcatgcttgttctgctctgtgctctcgatgctagttgagataataagggggtgtttagatccattggtaaattttttttcatcatcacaatgaatatttgaatacatagacggagtattaaatattgataaaaaaaaactaattacacagtttgcgtgtaaattgcgggacagatcttttaagcctaattgctccatgatctgacaatgttgtgctgcagtaaacatttgctaatgacggattaattaggcttaataaattcgtaccgttgttttcatgcggattatgttttttttattagtctatatttaatactttaaatgtgtatgcgtatatctgatgtgacccgataaattttttttgccggtggaaattaacacagcctaaattttgtttgatgcctacggccacatatagtggagaaggttttgtgtgaattgaattaattcctgtaaaattcgtgcaatccaaaagatccttggtaaaatttactagttcagtctatgaaaatctttaaaaaaaataatttctcccatccaacgaataaccatttgaagcgatgcgcccttaggtgaattgggcccatgagtaagaaagcatgaacaagtaaagtgaaggatgaccgtacgtttgacttagtcgaatcagtggataacggtgtttctttgtctcgacaaccacacacctcgtcatgtattacgtcacaacatctagtttctattttgttttatgatatatgacgtcatgaatttatcatttgttttgatgaacttatcttttttttctgacgtacggagtatatacatttccatggaatataattatttttcttgcttccaaagtaaccaaaggccgtcgtgttgtaaaaatatcggtacccaaattaagaaaagaactagaaaatgggcgcacctttggcgcaccaactaagagtaccctgtaaatatttatactttttttaggatgtataaatgttttagagttatttacaattagtttgatttcttagatacacacacacacacacacacacacacacacacacacacacacacacacacacacacatatatatatatatatatatatatatatatatatatatatatatatatgagatggagtaaaaataaaccgaagcgacaataatcaatgatatttctatttggaaaataaatctggagtatttttatttgggaaaaattctagaaatgtttatttctcaacaaacatattacacttggataaatgaaaactggcaaaaaaaaaatataagctcaaaataatatctcaaaagagacacggctttgccgcataatgggtcattggcgcgcctgcttagtttgcatatatgttcataaatatatggtgcaattaatgatgttttaattcctaatttttggtgttaccaatagtagaggtagtacttatgtgaagatttaaaacatgtccaaaatatatattattttaaatatcataggtctataaatatttttttctaagttaattgtctgagtttgtagaaaatgcaccagtatatataataataaataaataaaataaagacatatttcatgatgaatctaattaaactaatttggtgttacagattttttttttataaagccagccggtgttagagaagtttaactgaaagataaacttaaattacaatatgaacatatagagtcagtgaatttccgttgtattttagagaaaagaaacatgaaatgctaatattttttttgttttctatgcatattgtttaggccccatttatctttatgtttgtgtatttaatcttgtgttaaacatctattgctggacttcgtgactttctgattttaactgtagcataaaagtgaacacacttttaaaatatgcatgcggttgtcataaatgtatctaattaatcgatcagtgatagtcgcaattaacttaatgttatcggtagatatttctcttattgatgtgatatactccttaggtgattataagttatagcatattctaatatagcattaggttaggttggtgccattttagggagtacgaccgatcacctagtcggctagtcagttggtctaatctatactccttaaaaaaatacagaatttgtcatctagtgaatatgtctatcacacctactttcattgtaaattttataagttgccccttaaatttcttaatattaaaaagattaagtctaaatagatagtcacataaaaaattgatattatgtggtgtttgaatctgctgaagatgaagataaagatggagattaagtgtttcatgcaaaacgggtggtaataacgtgtgattaattgagttttaattattataaacttgaaaaatggattaatatgatattttagagcaactttcatatataaagttttcgcacgaaacacaccgtttaacagtttaaaaagtgtgctacgagtatctaaaattttatcctgagattccataagaaatgaacagggcctaagatgaatattccctatagcaaaaatatggttaacatattaatacattttttatctatagcaaaacacaaacatttagttaagtgttcgaagacccattatttttaacaattacttagaaattgcttttttttaaggatcttttctttcagtccatgtaacattggggttaccaatatttgttgagaatcttgggagaaacatctagttagaaataaatcacaccaatatgtagttctgctatatccagcccacatcaatctgctatatccgtttcaggatggaggacgatttatctagaaaatagagatcctatcttttgcctccaactctctctaaatagcaaattttacagttaggttctttgcaccatctctaccgttgattttaaatcagatggttgtgcgtgggtgatgaggaacataccctaaatttggagggacacatggcaacatggcagatttttagaggggtccaactaaatttataggttgccacgtggcttaatgggaagccagatcctacaccctgcaatcggttttagagattggatgccatgcgatgcgagcgtgccgtggggagtggggcgcgcgcggggggtggatggatatggatgcagcgtcgacgcgggtggtatgcgggcggtggcgtgcgcgggagggtggttgatctggtcgacgccaatgctgcagtttttctgcttggcacgtgggtgggggctcctgggccggcgacgcgtgcaaatcaacacacaaaacaccctgcagcgcttaaatgagcaggaaattattccctatgtaacataaaaaaccaatctagtattaaatatgacacatcttaatattataaatatagatatacatctgaacagatttatcgtattataatatgtcacattcaatactatatttgttttactacgagagaagggagaagagaaaaaggacgaaatagaaggaccctgcagccttgcgcgcccggccatctcctgcttagcgctaatggtagtgttaatgttgctagttagtgttaatgataatttttatatctaatctattatatactaaaagtcgattaatcttcctataaacgctcctaaacttatcatatggcgctcctacaaaagcaaaagcagatgccgtttatagggaaaaaaaattcccatcggtatgtgtttggaaaaaactaaaggtacgtttaggtactgttcacttaaaaaaacgacgtactttacatacgataaaaactataaatcaggaaaaagaaactgttcacttgaaaaaataacaaaaaagggctggcaattttcatttaaccgggaaaaaaacgcttctacaaacgctcctaaatcaccacgtggcattttataatctcatcgtcgattttcatttaaattggtgacccattattttaaactattagattagatatatttgcttatataagcatagatgccgtttatacgggaaaaaaaattcccatcggtacgtattcggaaaaaactaaaggtacgttacttaaaaaaacgacatatatatactttacgtccgataaaaactataaaacagaaaaaagaaactgttcacttgaaaaaataacaaaaaaaagctggcaattttcatttaaaatgatggacccattttttagattattagattatagtcaccgtcacatgatactcctacaaacgttcctacgccgtcacatagcactctaataaattagagaaaacattagaaattcttaaaaaaattcaattaaagcggtgaacccattattctaagtcattagattaaatctattaaaagattgcatcccacctaaccttccaccaaataaaaaaacggttttactatatttctgtcaccggaattctggctccatagcagtcagttttgtggccactggatacgctataagtttcgtgtcaagttaaatccattgtgctcataccatcgctgcccgctgttttgctgcgttcacacttacatgtatgtgactgctggggtagttatttatatatttacaaatttacacagtagttacaccccacttacatatgtattaggatgtaattttgggatttacatatgtaattttaggacttacatatgtaattttggtatttacattgtcaatacactaaaattacatatgtaatttagagacttataatgtaaatacatgtcgagtattttttataaaaaatatgacgccataaatataactactcccataaaaaaatagaagaagaagcagataaggatgagcgagggaaagagagagagcaaatagataagatctccagaacgacgcgactctctccctctcccgtgcggcttgccttggtttgtaggctacctttttaaaaaagtgactataatatattataggtgttggtttttttaactaaccggtatctataataaataataggtacgtataatattggtgttcatttttctctaataccgacacatataattgttcaaggtgtcgattatatatttggtcaacatgcgggagtgagaaaagcactataggtgtcggtttatctatttcagcacctatatactgacctttaggtgtcggtttatctatttcagcacctatatactgacctttaggtgtcggtttatctatttcagcacctatataccgatctttatgtgcttttctgtagtagtgcttcataattctcgaataaaaaaaatagacaacaagtaagaaattggtgtcaatggtttctgctaagtatacttgaggagactcgaaaccgggttgatgggtgcatcatgaatgctaatcaccactgccaccgtgctatgaccacatcttgaataaaaacgttattatgtttctatgtacaagaaaatatccattagcttcctgttaaacatatgtaaattatataggattacatataatattaactatatattaatttaaaaatattacatgaaaatatatttagctctatctttctcatccaaattatcttaataattttttaaataattaatagtagccactgtattcatttacgaaccttcaccactcatattttcttaacattaactatatttttattaaacagataccacatgaaaccaaaatttacattcttccatgtcattctcgtccaaatagtgttacaattagtaaaaaaaataaatttaacaatatatattattccatcatatattatccaacaaatattcataactaataagaagagaaatatcactcatgtattagcacatgcatgtatgaaggattactgctcgagctttttttcgtgtggttctcagtttctcaccacttaagtattagaccttttaagaggtagatgtaatcaatacaaacaatgtgattggataaagtgccaaaatttatctgaattaaatgttgtagcttaaagctaatagttagattgaaaaaattatccaagcaataccgatgaagaaaatttgtgaaaagatattacttttgaagtgtggcaattatcattcgattgatattctggccttataaattcttcaaatacatataatcatacatgcccgcgcgaatgcgcgggctaccttcctagttttcttaagaaatacataaataatttagtttaaagttacagaaaatagttgaaagtttcaaatcatgagttgaaagtttttaaactttttactaagatttggaaaactttcagctcagatttgaaaacattcctatcaagatttaaaacttttaattcagatttaaaaattttcaactcaataatttttttagaaaaaaactttcaacttagattttaaaacttttaattctgatttaaaaactctcaactcaagatttaaaacatctaactcatattaaaaaacattcatctcaaaattttaaaaatttaaattaaatttaaaaatttcaaactcaaaatttaaaagtttgactaaaattttaaaagctgagcttatggtcaaattgtccagctgacattctgtcaatctttttttcatttttgtttttcaagatagaatggaacatatcgaccccaaagtagaaaccacaccgccttctcctcaccccacccaattcgttttccagcgcattacgatctcagcgtcgcattcgtcgtcttctacctccatcacttgctagttcctactagcaaataattaattaatttttaattattataaatttttaaagtgaattatttaatatttttaagtaattttaatatagaaagttttagcatgaaatatacggtttaacagtttaaaaaacatgctaatgaaacaaagataaaatctctattttagttagataagaacggagccatatgtagatgttggaatccaaaattctcaacccaccaaaaattaatacttcctccgttctaaaatataacaatttatagcccttacaatttatcccaaaatatatttccaaccagtcacaaatctttagcatttaattttcttcgctaaccttcatttgtcaatcaattataatatcctacattaaattcttactacttctttattaatatatatattcaactctaaagattcttatatttgtggaaaaaaaattatatttgagatggaggcagtaacttaagtcggtagtcaatggtcataatagtacgtacgtactccttttggcatcttgcgatccatcttctgcaatcgtccgtgcgtgcgtgagcgtcgtcttggcccgccgcgccgcgcggagacggcacccgtacgaccacgagacgcgggttactctgccgaaaagcagagcatttgtgtgagcgacgagagcgacagttcataaccgacaggcttgccgccaccgagagcatggttaatagtatagtcaactattagctttaaattatttataaccaatgtaataggtaattcttataatagttgtttactatactattaaatacctagtcccacctctcatacacacattacgtcttggagtccatgctgcagctgattacagctgctcttctctcttttcttttatctttttaaaatatatttatagctggcttacattatactattgtacctgctctaaccgacaggctcggccgccaccgagagcgacagcccatagccgacaggtcccatgatcgagtccatgacagacaaccgagagcgacaggtccgctgcatgacaaccgccagcgcccatcggacagcggctcgatcgatccggcgtgcgtagcggccacgcgccccttttcaccctagaaaatctatataagtgcggggctctctccgttcagcttaagcgcaaactcgatcgcacgcctactccctactacgcctctccctctttgttccttctcccttcttgtgacctgtgtgaaaaaaaaaaaaaaacaagaagagaatttctgagactgacctcaccggaaatgcgcgcctcagtcgtcggcgccgtctgcgtggtctccgcggcaatcgccgccgcgccggagcttccgcaagatccgtcgtcgtgccaggcgtgcgcaatcatggccttgtgcgcggcgttccacggcggcgtggctctgctcatccacctcctccggcgaggcccgaggggcacccgcacctccggcgctactgcggcggccgtggcatcaccgccggcggcgagcagctagtcacctcgttcgtgactaggcttaagtaggacttggctcccctgcatccgaatgaccaatccatgggggtaaattttgcttttttttttttttttttgcctccatgaattcttcttaggttgttggggtgcagaggagccaaggcccacttaggcagacgctactccatcggtgtttgggatcaaatctaacaagtggtgttctttcgaattgtctgtctaactgacgttgcttctagtacttgatcttgatggcagtaagacggatgatttcgagataattccactagctggattgattccaaacacagacggagcactgtttgcccaagtgtgctcactcttataatcttgttttgccctaattgtttgggttctttttttttcccttttccttgagtcactctgctttgtccattgtctggtcagatccatatgttcttttataccatattcttctgttttgttctcctgtgagaggaaaacactggcataaacataagtgagatggccaacgagaaaacagcatcccgtttccgttaacaacaaaaccgaccatgcatgctggcaagtgaagacatagcagattgcaaacaggggcacccagatccagcactattacaattattaccattttccacctttggacctgacattccaattgcatcaggtaaagaaaaaataacaatcggaaaaaggaaccatgactatagtgtcttttttgaggtagaattgcacccaattatatgtaaattttagcatggcaaaaaggttctatctgtcgtcgacacttacacatcagccccaaggtaaatgcagtaaaacccatcatagcaaattcagaaaccgcaatagtaactcaatggcactaccattcacatctgtgttataatcctaaaaatgccgatacaataaataacattgtacgatacatcagaacacccagaggtgtacattttgtacattccatgacaaacgggtgaacgactagttctatacacatttggagaagaattgcagaaatattaagacatactatcatctgctagatgtctaatacagtaagccgaatgagcagtaaactctttccaacagtgtcctagattcctaggttagaagtaccatgagtatgtactttgtgaaaatcttcagcagcaagatgtcttgtacagcatgcagcctgcaaaattgttgacaggaacgtctaatgttagaacattacagagataaaaagagagcaattcgatgagctgagcagtatttgaatatagcagaatgattttattcgatccaacctagaagcaaagtcatgatccaagcatgtctacatacaacataagctaacagtatgcctcacatccatcagattacaacctatctatctaccactacattggtttgaactttgaagtacctacctactacgagatgatgctgtgacaaactttaattttgcattcctaaaagatgtttgtcgaattctttctcgagaagtaagaagcaaaagtaaagtacgaaccatgaagcaagcacatgcttatttaaacgaactcacataagtagctaaggaaaacaaacagaactcaggactgcagaatttaccattctatctaatccaatcctgggtacacacaagcgcctcaattgtcttgatgttcaaagtgctccattgcttatgaattactggaccctcactgctgaaggcggccttgcaatgaagagcagatgatggcattgccaagacatcctgtgccataactgaaagagttggatactttgtagaatgaatcatccaccagttcagaatatcaaaatcatctttccttggaacaaggccatcctcgagataattgtcaagctctgacaaccgttggctccttgattgtgcactaagatgctgatcccaatcctccaatgaatcactgtcaaatccatccatttcaacatcacgagcttcattgtttgacgtgtgaacacctttatccacagggccgcaatattcatgaaacagctccctgattatttcacgtacagcagctacatactttgctgcttcagcaccgaaagctcgtttaagacggaactcaataaaagtaattttgaatctgggatcaagaactataggtattgacagccataggtatgaattttcccaatattcatggaatgcttcctgcatctccctcaccatgctagcaacttcagtgtgatcagtagatgcttcttcttgcaaagttgttctaactttccataattcattgaagtacacatttgctgttgggcaaacaggaccagagattacttcaatagcacgataaaaagccctcagaatcttgcagatagactcaacgaccttatagtcttctgcaggtaacaactcttcagatggaaatgccttcttgcaatgcagaacaacttcaagcctgaagtaaattttgtgccaccattttgcgtcttcctggggacacttcaaacccatgtttgtaacagcttcaaaaagttgctgttgagttaacgatgagtacgcatgtgccagcataaatctttctagtatattatcaacaaggtgaagcattgattgcccttttgaaacaatgttgttaagcacgtcatccacacaggcaatattgtatagctcacctctaataggaagactatttttttgtatgagcatgtccttaagctttgtggtaccttcatggtttctaatttcactgacggatatcaagctaaaaagcttattatcaagattccaatcacttatagcttctgctatgacattatatggcccactttcagagtctaatacacaagcctccttataaagtatcattctttccaaatcagtaggcaacgaccaaaacacaccaaacttgattattttcctttgaagcctccattctgcatcaataaagtgcgctgtcaaacagatgtacttcacagtgggctcagctccatgaggagcccaaatgcttgctgataaggaaatccgtcgggatgaaagtgcagcaattttctccttaaggtcagccttttctttctgatataaaagagttgaatactcttccacatcaatgcttgatgccatgttaaacaacgggttgaggctttttgcaaatcttttcatttcttcatgttccacgattgacaagggatatccatgcaaaactatcattctaattagctcttgataagatgtttcctgatcaaatttactggtgcttacatctggagcagcatgagtagatgaggtattttgttctttggtcatgttgtctcgtgctggcaaagctagaatgtgctggctctggggagttttgtcaactgagctattaaccttgagaagtttgctagcatactctgcaatctgaactttaccgtttgtcaaggcaggtgaaagctcatcctgaaccccagatttaaaacttggtgcactggagggagaaaacggactcttatgatttattccagtttctcctcgtgccggacaagtctgagtatgccggttcaaatggcttctacctttatctgcactaagtcgcttgtggcaatggagacattcagcaccctggattctcccctcaacatatacaggcgtaaactcctcccacacctttgatctgaacctgctgttgtcactgtgacttgccaattttatatcatcaagtgaatctggatgaatttgatccaccggattaatatcattcatcactattatgtataaagcatggatagtttagtcagaatacacataaagatgaaagatatgcaacttggccgaaaaaaaaaaaaacaaaaggatgcttccaccataattacagccacagacagataaaataatatacagcagagaagtttaaaaattcccatggcattgacagaagaagaaaaatactagaaattcccacagggggaacatctaatcctaaaataaaccaagtaacttgcagcttttcaaccaccttggtagcagccattctactcttgctaaactaaatgggcaatcgtatcactcatcttgccagaaaaagagttattctatgagcaatgcagaccagcagggtgacggagatgaaaaaaatttaaggttttgaggtaaattagtaaattatttgtaacttatagcttactctgatgctcttagtattgtgacggtatagtttagatttaaaatttttaacacactattttttgcaaacaatgctcctggccagggttgctggtaaccaccagttaccagcagtttccagtaaggacctgaaccctgattaacatatctatataattccttatgtgatcttcttaatcatggaaaatcatcagctaaagcctagcccattctgtcagctcctctgataggggatcaaaatattaataaaatattgtcattgttttaagaaataacaaaatatataccacctaagtgggaatgccctataattcctatcattgatttaaccaacaagctaatatacagcacctaaaaggcaatgccctcaactattgtcattgttaaaatgtccctaatcattatcatcattgcctaaagtaggttaaagtttgaatgctttatacaagggtaccataataagttgatgatcatccaaaactctctcaacgactataaaacagtacaaaatttacacactgtcaaatcaactaatacaccgatgcagatgccaattaaactgaagatgatccccaagggaaacaaagcaagcataccatatgggaaaccagtatcatgtaactgagccagatccaagtcctctttcgcccggcaaattttctgatgccgccacaaatgactcgttccattggaatgtccatcagaacctttgcaactcatcagaatatggcagtagcggcattccgcgctttgaaccactccgtttacatagataggcttgtactcatcccacaccttggaccttttcttagttctcgctctgaaggcaacgtgagcttcatctgacgccacccctgacggcaactcgtcactgtcatgatcatccatgggatccataactgcctacaaagatacaccacaatcatattatttttacagtatgtggttaaacaaaacacaggaaaagtacaacaaagctaagataagatcatacgtaaatgattatgaagcatgcagcaagcttaacacaacaggcaacctcaactacagtctacagagagaagtcccaacaagagatgatacgactacgattttgtgcaaattagcagtgcttgcgagcttcaaccacaatttacaggggcaaggccacacgggagttcaactgaacatctggaccccaaatttttttcggaaacaaactgctcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagttctgcaccgctcatcaacgaattggagcggaagagatgaatccaaatcctgacagatctacagtctacgccacacaggcacacaccgctcgcgaagcgctgtggaggagtaggaggatggaggagctacgagagaaagagcgaatacctccaattcgagccgaaccgagacggaggccggtggagcgaggccggccgcgtcgtcggggcccctccctccttccacctacctgctcgccggccgcgcgtggtcggtccggcaagtaaaggaaggccggtccaacgccgcgcacacaaagctcttcgccggcgggcggggtggcgcttgcgaggcggcgaggcggcggggagatggccggcggcgcgtccgccggaagcagaggagagagagggggatggagactggagagaagcggaggcgggttgagatcctctccagtgcttagcttcactgcaaattgagcggtcgcgctcatcaccgttggattgaaaatgaacggtgcagatcgcccaagatcactttgccgagctgctgtagcagtaattaggaaaacgcctgttagccaaagtctcttaacggttcatgaacttgacggatttcgatcaatctagagctgtgggtcaaaatgcgcgtctcgttcaaaatttgtcgaaattcattcgaaattatgtgttaaaattagttcgaaattagtggaaaaaaaaaacaaatctcactaggcaattgggattgtaaagccgggtctcaaccattcaaatttcaattccttttttctctaggaaattaaatttcattcccttttttttgcgaggaattcaacaattcggaggccgagttatacaaaaaggctaattacagtatattgagattgaaacaaactaggacagatattgagaagtatccattgtcatggattaataaggatctaaccgcattatgttttgttcatggtaatttgttatactccactatagcataaactgaagctccaaaaacctgcttgagcattccacttcagtcaacttgcatacatagctcatttctgcacaacagatcagcagcagttctaaaacgtatggagtgactgaacccagacaccattgattggagacaataaaccagtcccgagtaccgactgatgtaagatgaaatttaaaaatgctaagaacaattttgcggaaatcaactagaacatgcaaactgaaattatcgagagtaaccatgaaaacattatggagagaagtcataatgaagggctggcttttttattgcagtgaaccgttacttttcaagacatgataattgcaaactgttttgcaaactgttttctttgcttcacagggctagaataaactgtatcaccttcggaatgttcttatacccttacaactataccaaaagagagtgacaatattaacacaggctgcggagtgaatgcaattagacagaaatatgtgcgtacgattgctcgatgtctcgatgtatctgagaacgagactgtaaaagaactatatcaggtgcaagtaactcctatccacaactgttcaagttccttccactaagcccaagaatttgctagtctagttgatgtagtgatggacacctggtacagtaaacatagataatcagccaagtaaaagaagcaaagcaccgcaaggcagtctgatgatgcatatacgtagtgtaataacaagatgaagcaattggtgaacattgaacaatacatgaaaaagaaactttgttggcactacatgtgctgcaaagaataaaatagaggaaccagggaaatatattgcctactctttgctagcaatcagtccttctcggtcaataaatctacgcccaccaaaaggaacttctataacgatttttcatgaatctggggttaatgttataacacatgaattctagatacttccatccctccaggcaatttaatattgaagtactacagtaagcacaattaaaatcttcgatagttcaagactcaggataatgcttcaagatcaggacaacaagtagcttaatacagtttgtctacactttacaatgtcaggcaagttctcagtcaatcgccatcagcagtatgacaaatgcatctgttcaaaaactgtctttcatgaaaaactactagtttatgaattaataccacaaggcttaaggataactttgtaaagcatttggaaacccatgatacccacttaaaattccaattggcataaataaccgaaatgcatagcatccacattatttttaatgtgtagaaggatgagtgatcatcacctcaagttgaacaaatgcttattcacaaatgagaaacaaaattgcccatgctacacagtgcagttagaagccattctcaaacaagagtggtaccctatcaaataacaccaaaactgttttgcagaagtgataatgtaggcgtgtagcatggcatcaggcatacatggtgatgtcatgttccatgcattgtaattcctaccaccaaaactacagagtttgggaactcatgtgtcctacttccatcaagcagataaacacaacaatgaaatggcgagactatcctagaagggatgattacacacaaggtatgatctatagacaaaatcatcagtgccatgtatacagcagtactcaacagtcgtgcagaaacatcaatgcacaaaagatacagagtatcataatcaatccatgatttccatgtccagaaatgtttacctagtcagtgaacataggtcacagccagaactgcaaactaagctgccgtagctgggatgttgtagcggctgcgcagtccatcaatagctctgtctgccgacttcgccatctcagggatagtcaccttgcacactgaccatcaccggaaagttagagcacaacacatgaacacaatgcttaactgacttgagcaacatgtggatctgaactaaaaatcaagcgaacatagcaatgtatcttctccacgccgtaccacgagatgtagaagcctgcacctccgccacaaacttcttgtacgaggcctggggttcacaggaagcatcagaaattcagaatattaaccaaagtgcggtcaaattggatgcaaaccgtagagaacatagtgatctagggtaccttcactgcctcagcatgctcggagatcttgtcggccatcttcctgtgctccttctccgcctcatccgccagctgcaggcagctctgagtctgcatctgaagagagatcatacgcgaaatcacgacatcactcggtgcgatcggcgatcatcggaagggagcggagaagaagggtcaccttgaagcgcttggagatgcgggagtgggaggcctcgaggtcgcgggcggagtcgccgtggagcgcgtcgagccggcgcttgagggagtcgaggtgggacgcggcgaggatcctcaggtccgcgacggtggagacggaggcggaagcgggggaggcgtagggggagatgggggaggaggccggggcggcgagcggtgacctcggcttgggcttcaccaccggcgaggagggcgagaggaagctgaggtcgtcggccgcgtcgccggatgccggcgaagagccgccggagaggagggaggcggggctgggcttcgtcttgggcttgggcttgggcttggccctagccgtggccctcggcttgggcttggacgccgcggcggttgctctcgccttcctcatcgctggccgccgccgccgcctgcgcgcgccctgtgcgaaagggccaaaggggtagagagaagagaagaggagagggggtggttttgggatttgcttttttctttttttgaattttgaatgagaggcgtattgcggctctgcgggatggagacggctttctataaagggaaacgtacactttccgctttctcgcttaggatacgggaagtttaactgcacgagttcattggtttgtagggcttggagatcgtggggtccacatgccagctacttctgctctttgaatttgcgaaattttgatcattttcagctcaaagtcttgaagatccaactgaaagcttaggccatgtttagatcccaccccaaaacttttcaccatatcacatcgaacgtttaaacacatgtatgaagtattaaatataggctaaaaaataattaattgcatagattgcgactaatttgcgagacgaatcttttaaacctaattgctacatgatttgacaatatagtgatacagtaaacatttgttaatgacagattaattatgcttaatagattcgtctcgctgtctactgacggattctgtaattagtttttttattaatgcccaaacattccatgcgataccctatataatatccaatatgacacgccaaaactttacacccccatagatctaaacaaccccctcagagtctcaatcaagcgtttcaaggcaatgtcaggctgtcagcgacagaatagaggaagagaggaagagagaaaatggaaggggtgggcgtatcactgacaggtgggacccacatatcgtacgaacagcaatacccacaagcagcgtatgcccactcacacatgcaataagtagtgacagaatactcttcgaatattaagttatatgttacacagaacaacattatatggcacatatatatacaccaccagatggatctcttgataaaacagggagcaatggcagaattctcctacaagctggggtcaaatattcaacacaggctagcgactaagcctactacatttcgtctagcaaatcagagcatgacaaaactggagctgctgcgagccatggaaggacacaaatccgcagtacctcgcaccaaaatactcagcagcggtacacagctgttggagttgcatctaggcaaagatcacaggctactatacaatgtcattgtatcgcagagatcacgggtgcttccaatcaaaacctaaatagatacttcagatcatccacggtgagccgagtcgcgtggccacccgatttgtcttcgccaaaagcagagctaaccatggctctcttttcctcctgtaaagaagcggaaacatcattggacgagcatacccccaaattatcagggatgttggttgtgtcaagataattcatatctacatgagattatgcaatcaaaattgttgtcttaacccccatgatcgataaaaaaaaagtattaaatcaacctcggtaaagttgtttagttatcggtacacaactaacaccccctaaaataacaataacaagaatattacaacttgcactatcagctgccctgttcattttccaaccatcacattaaagttttgaaaagctgggcttgaatttcaagcacctacgacatattcaagtacaagcatcgaatgaacgctgacacgatttgagaatatcaatgctactagtataactcatccctcaaaaaaaaaaaaaaaaaaaaaagaggcgtatgttattgttatctaagtaggaaaaagacaagtttatgaaagcacagtgcaaatgaaagacaagctattacctgcagagctaaaatgcgatcttccaccgtatctttaatggttaaacgggagacagtaacaggacgagtctgaccaattctgtgtgctctatcaattgcctggtcctcagcataaggattccaccaaagatcaaggagaattacatggcaagcagcaaccatattgagaccaagattacctgctttcagtgacatgatcataaccctgacctgaggatacaaaaggattcctttcagaataactgctgaatgaatggctgaaagtaataagagaaacaaggtagtaaaaaagagagtggaaacagaaaatagggacctctgggtctgtgttaaaatctttcactgctttatctcttgaattgagggacattgttccatctagtctcctgtactgtatgagattgctattcaatgaaagctccagcaaatccagcatgccagtccactgggagaacacaatggctttcactggggccactcggctaggatttgattcgacggtatcactgtcggtaagggcataggtgttaatgatcgaattcagtatatcgattgccgcctgtatctttgaggatatgtaactagtttgactaatagaagatgactcgtcatctaatgatgaactccctgatgcatgagaactggatacaccagacatgcaaatccttaacgctcctgacgaaaatactgaatcggtacttaatgtgtttccacaattaggggagggacacatattctcatcagtagttatccgctcgtatatacattgatagcagaagacatggccacacatcgtcacgacggcatcctcaggtacatcctgccgtaaaagaagtccaaagattgcaaaagaagattgaattacaccagtaattagattgtccaaagatatagaaacaagaagggcaaggatatttgcaaaaacatatagcctgacagcttggcattgcggcattgtagctctggatgcataaccccaaggtgttttctcgttaaatatgaacagttgggctgattcaggttatcagatattctatcattgttatcatttaattagcatccactgcccctccacaatgcatattatgattttattccaaggacacgaaataacagaggatataggtaggacaaatttatgtttcagtctgactacacaatttttcatatgttgcatggaggttgtgcgcctatacatacacacacagccccagacaataacaacaataatactggtgattacgtgtattatcatttcaacataatggagagagaataggtcagattcaacataatggagagagattagattgcttacactgcatacagaacaaaactctccaacttccagctttgcaagcaaatttattatcatttctttaggaagttgctttgccatttctatagaaccatcgcctttatactctgactgatgccccttcacaagaagaggatgatcgcaggcctgcctaaggcgcaacagcattagaagaatgttggcatagttctgtttgagtgtaccagcagcagcgtatgcctgaaatggatcacaatatatcagcattcagaaactacacttgtgaaatctccagtaatcagaagggaacacaaattaacatccactttataacatttgatatgagacaatggttcaatggaagcatgaggaaactttgttggatcataacaacaatattctacacatacttgctccagcctccaggacaaaaggaaattcagtaatgttgaagatttaacatcacttctcctggtcacatcaatgtcattttggacatctacgtggtgttcaaaaatgcaaatttgaccactaacttttataatatttgta

SEQ ID NO: 28667 - DNA, 1489 bp, Oryza sativa
  unsure (1)..(1489): unsure at all n locations
nnnnnnnnnnnnnnnnnnnnnnnnnnnnnnnnnnnnnnnnnnnnnnnnnncaacagcattagaagaatgttggcatagttctgtttgagtgtaccagcagcagcgtatgcctgaaatggatcacaatatatcagcattcagaaactacacttgtgaaatctccagttatcagaagggaacacaaattaacatccactttataacatttgatatgagacaatggttcaatggaagcatgaggaaactttgttggatcataacaacaatattctacacatacttgctccagcctccaggacaaaaggaaattcagtaatgttgaagatttaacatcacttctcctggtcacatcaatgtcattttggacatctacgtggtgttcaaaaatgcaaatttgaccactaacttttataatatttgtaaacctcaataaaattatgatattatgagaagtgccttcacatgacaaatctccatgggtgtctatcatgtatacaatccaaatataaattttcaaagttttgaaagtttagtcgatgcatgaccaaaatggcatttcatgactagaattcggaataccagatgcaacacaaatctacactatacggaggccgtccacagaaaagtttgactttaaaatttaaccaaccttgaactgttgccgcgagcgttcttccagcgtcaaatagaaagctcgctcctcttttgtaaaatctactttatccagattaattgtctttggaggtagctttatgattggctcaccatcaatcagagtttctacataaaacaaggtaacatgtgatcaacgacagataatttaatcaaaggaaaaactagagtaacatactagcattaatatgctattaaaaatcttgcaacaataatgtaaccatatcaaatttctttgaaaaagagaaaggaggtatagcatactgagtagaaacaagtagctgaggagtgaggacttgtagtaaaatggcaactggcaagcaattgtaatgcagtgtcctttatattgacgaaaaaaaaggaaatatcataactttccactatctgctcatcaattaaggtaaattgatcgaacctgtctacctaatgtttgtatggcatatatcaatttaatacaaagccaccacaatagcaaatacagaccctagtagatgtttaaccacatgcagagtgttaagcgtgtttctgtaatctgtagcaacaaagaatgctatgtgttgtggttgaaattgcttccttacaatgaaatatcctaagctagtatataggcaaaaaaggaacagcagaaaacatatggaataaaaaaagttttatcaccttttgtgcggcgcaggagaactatcctcaacacagtctgaagtttcttatacccatgaactgcatttctagcaatcgggtgctttatcattgtacaaaatgaattataagtagaatatggatcgtatttcaagaaatggaaatagctgtagagctcatc
